United States Patent 10,724,096 (METHODS AND COMPOSITIONS FOR INHIBITING AND TREATING NEUROLOGICAL CONDITIONS) - sequence listing, part 80

SEQ ID NO: 1606 - DNA, 691702 bp, Homo sapiens
gctcgcagtttcgccctctcttccgctaatgattgcattattatgctcccctctctggggggtctcgcccctcttgggtcgctccggagccccggcctcccctggctgcatttcttaaaaatttgggagcctgggagtgagttttctccgaggcgtgtgtgagaggcggcgggggtgttttcctgcgcgaggggcgggtgaagttcattgcccccacttttcccgcgacctttttcggacccgattttggatcgagttgaggggggcgcgggcgttttcggggggcggggggcgcggcggagaatggccgcggggagggctccccggagcctcccagtctcttgatcaaagcattccgctattctgatttattgcttgcttggtgagttatttttttttcctctaaaggagacctgtgtgttcagccattactttgctcggcgctgctcccaggcatctccgaccctcggtgctgtggggagccccacacttgggctcctcgcctctcgccctcgctccccgtccctcctcccctctctccgccccttcccccttttctttctcctctctttcttcccctctctcccttctttcggccgccgtctcccccgcgccctcctcggggcggagggaagccgtgaagggggagggagggctcggtgtcaatttttttttgtgtggctgcggccgtagcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccgggcgctctcactcgcctcgtcgtcgggctccgacaaggaagacaatgggaagcccccgtcctccgccccgtcccggcccagacccccgcggaggaagcggagagagtccacctcggcagaagaggacatcattgatggatttgccatgaccagctttgtcacttttgaagcgctggaggtaagggggaccccccttcccccgggttccctttatgcacgaccccactcggctgcgcccggctctcctgcctccctcgccgcgctccgggctgtctgtctgtctgtctgtctgtctgtctgtctaggctgaggtcttattgttggtggggggagctgggggcgcgggcagacaggcagcaggagggagtcgcaaagccgtgcctggtctcgtttcctcgctcgcctttcccctgcgccccctccctgcaccccctccacagcagatgggcagaaagaaaggggttcgggcatcacaacaatgcgccccctctccacagagagctctgcccccactccttcctcctctccctccccaatcatggcttcttggctggtggaagtctctttgctgggtttggggcgcctgtggacggttctgtgtgctttctacagagtcatatgttcgtgtgtgtgtgtgtgtgtgtgtgtgtgtgtgtgtctgtgtagtatatacctttcccgggtgtcctcgggactggagactgatggggttttgtgatttctttgcgcctccccccattacccccccatattctttttttttttttttttttggtgaagctggggaagggggcgttttctcctggttgggagaaaggagggaggaggggagagaagagggaagggtggaatagctctctgtattctgtatggggttctgttacagaaagggttaattataatattatctatacacatacataggcacatgtgtgtgtgtacatgagcaatttagttaaaggacagaaaaaggtacaccagggaagactggtgggagggaagaataaaatcctagctgctatctgaagggcttgtcaccaattgtccctctccctttccttttttgtgttttcttttttttctttctaagtgattggctttgtgtgtgtctatgtgtgtgtctttctttattccttgggcacctgcagcgttgattttcaaatgcacattttccttccagccaactggctcctagggtagggggaaagggaaaagggagggagggggagactgtccagggttggggggaaactgtctttgcctggacctgtctcctttggtgtggtattggtcattggcctctataaatttaaccgcctaatttcctcccccacctccctgtccccaccccccacacaccatgcacacacacacagaaggctttgagattctgcagagttggtccacctttcttaagcacaaaaccaagatacggtttatagttggcttatagtgtttcatgcacctgatgtgatggtttgaggttcctgaaggaaacttttccctttccatttttttttttgcgttattatggtattgtttcacatgctcagatgcaagctttgttaatgacagcttaaatctcacatacggtaactgtacaggtttagattgctggttctgtttatgtgtttgggtgtcagctttaaatatttttttcaaaggaaggcttcctatcagtgttgtccttttctgtgtgaactgcttttggtttgggctgctggtggtgatggtggtggatggtggccagtggttgggagtaagggaggtattggtggtggtggtggtggtgcaggtggtggtgatggtgatgttggtggtattggtggtggtcgtagattttgatgttagtgattgaatcagttactctctggttctagaattggtgctttattggccaaaattttgagtgttgaggttcaccacttattagaataattccaactgtggctttaagtttgccaaggtgggtggtggttaccatacagtgtgacctctttctgtctctctctcttgttttaaaataggagttgaaatggcagcatgttcctattagaacatgctgcttggaatttggttcatcattgctgtctgtggttgttttggaaagtacttgtaagagctggttacaagtggttctgctttctgcatggttatcctgagctcagcaatcaagaggggccactggattcccacgaacatttttggaggacaagtagggatatatgtgtgtgtgtatatatatatatatatatatgtgtgtgtgtgtgtgtgtgtgtgtgtgtgtgtgtgtgtgtgtgtgtgtgtgtatatctcacttatgcagttctttttgatggttttatttttaacaaataggtatttgactgggcttgtgatatatatctatttatttggcttttgcgagaaaatgtgctcattttaatttattttgtgcctaaaaaacttgtaattttaaaagcagaccaagttcaaaatgtacagttaataccatttctttctttgctctgattatttttttctgctacttttctagattaaaatccaggatattttggttagctgaatactatgtcaccttcatatctaaatatcatatgtctatctatgtgtaggtagaaaaggtctaacttttaaaaaagtttacttaaaattctgtagaaaaaattaaacatacagaagtagacagaacacccaacatccaggtttgagaactaccaactcatatctcatcttgtattttctatatttcatctatttcctctcccacatatgatctcatccatatttctcacacagaaatacttctgtatgaatccctaaaccataatgactccaaaaatcctcagaccccaccaaaacccgcacagcagtattatcacacttaaatgaatgtataacagttcactaatatcaaatatcctgtcagtgtttacattttaagaggcccaacttttgtagggaagccgtaaatacatttgtcagattaaaaacacacaatgggaaatagaaatcatcatatatgtctggttctttggcaaaaggtagttttgttggctgtgtgctatcacattgtgtccatgctggatggtcagaacatatgtgttagtgattgttaaattaaaacctctggtggtccactctattcagtctggaagatttattgaactatcaccaagaaatgtgagggcttattgggaacaggcaactaaactatgagcttggacaaaaatgtgtgttgggggagtgtttgtaaaagttaagaattattatagatgctaagagttatcctaaatacgtagtatgttttcgggccttgtgtttagaaatgaaatcagttgtcaccacatgtcattaaggctgctgctggtatgatattgtgaaaagaaaccagaaatattggcttgcacagctaggtttatagcttgtgccagttcagagcaatagctggcaaacagtggagtagcatactttgtgtgttaatggacacattatttgactccatgattttgttctgagtagctggttttggacttctcttttaaaaaagaggctcctaactcattatgaaatgtgctaatataaatagttccagttcaactgattttactgatactggagtaaaagtgataacttgcctaatgagaacctgcatttttatcttgattattttttgctgttgttggattcttttttgagatgatgaaagctttaggggtagtttgacaagtctcacattttataggcagtgaaactggctgaaacagtttcatattcacagggacacttctcttgagtaattgtgccctgaagttcaagtgtatgattatgaagagcctcatgatagaagataagagggtaggcgaggaggctaaagttgaacatggtgttcttttcattatgcagttgagaagcagaattaacgttggtatatagtatattgtttgtttggatattcttcgagtgacaggatgagagcaaaaatccccagataagatgtctagttttcttaaaaagtggcttttagcaaagtataaatgggaatgttggggtcctactaccatcagtgtgtcctgatgtgttagatagtgttggctttctgctatttgggttttttttctgtgttgtgtctattaggaagccacgtgagtaccatggctgaaaacttgactttgcaaatccattatttttcccctcattcctcttttgtgcactgggttcttagggcagcctccttttgtacagctgaccaagggaagctaagatgaaatttgtggaattagcagaaaagaggccaattggagctttataggcttatgaaagtaaaggaagactcatttctagtggttagagcatcaaaccaagactttgatgcggtcttcacttcctggctctgttttcagggcttcccccacacatcagtagcataagtgggctatacagaatttggtgtacttataacatgccatgttaataggctctcacaatttattatggtcaaatcactttagttgtttaaaaaacaacatgagtcacatgccttctgtcagtctgcagatatttatggagtgcttaatatgtacaaggcactaagaatatagagaaaccaaacataaatctagcgttttgagaaagtatgtagtttagttgataaagccagcacctatgaaataattttgaaacaggtacttgaatgcctgatatcaactaagcgccataggcttttagagacaggctagtgagataggctgaagtgttccagaaggcttcatgggtggggaatgggacctagaagggtgaagtgatttggatatatggggaaggagttggagctagggagagcattctaaaggaataatgaaggcacaggaacaagatgctacatggttaggacttgggggcaaggaaaggctggtggaaatgagtacaaaggtggtaagtaaagagtgcttgttagtggggcaggagacctgtggagacccacatgccaggcttggcctgcctaactagtgtggcctttgaaagttaactttctaaaagcatcatttcctttatccattagtggagaggtttaaactagtttagagtaaagcttctcaagctggaagggaacatagctttacaggatgttcataaattgttttttagtctgaaacagagtgatctaccgccaaatagtttctgaaacttgatgggctagacaaaattaaatggatgccatgttctgtcagaattaaaagtctattgtgtgaatgtgaattttgaatatcagagaaggcaatgtgttgtgcctaatttcctaaatctattttgaccacagagcacttttattctctgcattgtaatctataatccagtatgggaaatactagaaaggatccaaaaaagtccctccagatcttggaatctggtgatctctgagtctggggtgagtgggctgatggtagacgacttggaaaaccaggcacagaagcttgtagtcggtgcgtgggagctgcttcttaagcaggagtggcaaggggagtgaaagtgaggaagatgtaaacagtgagggagactagtccatgtcttttcctgctcccctttcctgcctgacatctgcctttttactgattgttaccaaccccaccaggaggtgaatattggtgagtggttctcattaatagctctttcagtgtgatgatactagcccaattctgatgccaccaagctgcccttcagccaatgttttatcctctttgtcccttctggtttcatatattgctgctctttggcaacctgtaaaaaaaggttggttgggaaaggaggttgacattgatgttaaaacaacgatttcaaattatctgcctttggcttgctgtatatgaagtggtagttcaaaaaagggtcagaaccgctcttttgctgttacatagccaggaaaagctgtggaactgtgtttctgttgcatttttcactttcttttttggaaaatttggccatgggactgtaaaataaatgggtcagttccagcatttgacttctgaaagtatgcatagctttaggatctgagaagggatgagagaatttggaggaaaggaagggtgtgaatagtgtgtgtggttatgaattcaagtattttactgtacttactgagtttcattattttactttataaggcagagcatcacttgaggagtatttatgtgagatgtggttgaacgttgtgatatgatgattccatgcagcttttgttaattgtggagattaactacttgcaccttttttttggaattagaatgtaaatgaatccgtgaatttaaaaaatgaattatgaggttaggaattgagcctttgatcctgagagtagtgttctgtagttctcactgttgaaaaagggttaagaaaacagaacagtaaacatgattcaaggagtgttgagggtgatagattctgagactcttctacaccacagttttatgtattatcaaagataaatggtgattatttagttttaaagaatgttaggattagaaatgaggtccccagatggacacaacaatagttgaggctagctattaggaataatttaggtctaagagctacgagatttggaagcctttggacgagaaggtctgtggcatttcgggtgtttgtgtatgtgtgcacgcacctgtgtgcacgcaaagggtgaaggatggtgggttagtggctttacattttattttattttacccctatcctgtatagtagtcataatatactaaatgcagcctaactttgtaaaagtgtttcatgctgtttttttcctcctcaagaagcaacttttttttttctttcagaattaggattaaacccaatatgctgcagatgtaggataaagaacctagtaatgggagagcaactgttaattttagaaagttctgaaaagattcaggtagatttgaaaacttagatcattgaagtttagaagagcaatatgataatgaatttggtaaaacttgagacaggagaagatcaaaaataattagtgagctggggcagaactgttttctcttatataatcagaacctgttccatgaatgtagacttttttcccctctgggaggtgaagaggacatagaatttaagactggtgagaccctaagtgtgtcttctttcttccaaatctgagctgtgttctccttcgtttcttctaacacaatagcagagtaatgatagtttctattatagctttgcatctgttggtatgcaattaatacatactgtgaggtcacaaagaataggccctttttatgctattagtatgaggaggggaggagtgagttttctagaatttgactgcccctgcttgtttaggaagaaactagacaagtacaggcttctgtgtcttagtcctgttcaggtctctgattccatccattgcaaggggctctggaccctgaaatcatatgaattggtgccttctttgaaggtgtttatttcatatattagtgtatgtggctctcttagggtccagttagattccccgctcacctgctgcccacctccctcctttcctccctttctctctccttcatatccttcttctttctctctcttcctttactgaggtagagctatcaaaattatgaatgctgttaataaaaggtaatgcatttaggacattgtgtatgaaacgcagaaattcaaaaatttttaaatttcattatttgaactgtgacaatctgcttgaggaactctaatttagctctctaaaggtgaattgcttgccacagttttcttggccattacagctcacttttctaatttctcagcttatgtctgaattctagttagtttgtttgccagagcaaaccttataaatgatcaactacatacaaatatttttaaaatgacttaactgtcattttagcttgcactatacctcacggtgccatacccccttgttacctctggagccctggaaaacccatgtgcagtaaaatggagtcacaagagaaaagcccacagtttgtaagtaatggaaaattgctaatgcaagttgggattcatttttggcaaaaagtctttaaattgcaagtattgtgtggctgctattaactgaagcacagcctgcaaatatagattgtgactcttggttacatgggtgaaatctgatattttctttcttttattttgtttttttgagacagtgtctttctttggttgcccaggctggagtgcagtggtatgctcatggctcactgcagccccaaccttcctgggctcaggtgatcttcccacctcaccctcccaagtgctgggactacaggtgcatgccagcatgcccagctaattatgtattttttgtagagatagagttttgccatgttgcccaggctggtttcaaactcctgggctcaagcaatccaccctcctcagcctcccacaatgctgggattacagacgtgaggcactgcacccggcaagaaatctgatattttcaaactgtggctaagttctaaacctgagactgagttttagtcattgccagggacaagttgtgatgacgcctgagggatctcattttccttgttgtccccacacctaccctcgtctgcagcacaaaatctcattttaagtttttgtaaagtttctgatggcagtaatattttagaacttaaaaggaggaattaagagattacagtcccatattataagtatttcttagttgttatgttgaagtagacttcttttttcttgttttcttctagatctctttgttcagttatactcgttggctaaaggttgctggttaaatgttgtttagcgaaatattctatagttaaaatctttacaaagaaaaaagtaagaatgaagatgtggatagcacaataattgaacattagattattacttgttttctagccacatgatagaaattgcagtgacttccacccattctgtctgtacatgttcagttggcaaagagaatgaaggtcctggaccgtgcttttctaagaaatgattttatatagttgacattatactttcactggagcaaaaagggaaacaagcatttgattagtgtgtcttactgcatattgtggtctgctccctcatttgttacggtggtcactatgattgcttgacaattacagttttgagattaatatgcagagctaaatctttaggaggtatcctaaagttaggacctaaactttttcatagcagccttttgatccattttattccagccattgctagttgatgtgctttctaagccgtgtggcatcagaggcacagatgttgtctttagtgatgtagttctacctctcattttgcaaatgaaaacaacagcccacaggggttaattgacctgttcaagatcacactgggagttagaggctctcactgttaccctatgaatctaggagtctgcttcttgtaagttagtactggggagtcccaaggattgggaaccttggaaggagattttttaaaaacaaaaagtcttactacaaatgtggatgagcacccatgattgtaaagcttcccatttcagctaagaaatgttctgatttacacaatatcaagaacctttaaaaagcgttgttctctccctgcgctctctcccagtgtatcaccctgaaattagttggcctttctctgtaggtacattcatcgtttttaaacactgcctcccacctcccttttataaggatgtaaaataaaaaaataaatattagggtggtttctcatcattgaatgtctagtggaaagataaaataattatttggaagtaagatgaccttaatgtggcccatgtaaaatttttaacataatttctttgtgtaaaatattttctttagcctagcaatctgtggaaactcagagcaacttcataacattggtagcaggatgtatggagtgagtgaactttggagtatagtggagttgaaggctcaacgaaaattttcttcgaggaaatacttaaaatattaaatccacatgacgtgttgactaaggcatcttgtctgttcattgctgaaccagaacatttataacaactgtttctcatgtgtatgtattcatagccattcatataatgaaaagaagttttcatgggattgtaataacatatcaagatggatgtaattaaaacagaagcagattgacaccctgaattaaatgtaaaccataaaccaggatacctgagcattgtgccttacatatttgctgtagggggcagtcagccaaatatgcaaataaaaagacattgatgaatcttcctgggtgtgtatgtggttgcagagaacccaactattttattaatcttttatcaagcattgtttagatttgcagcagccatggaatgtattaatttggcagaccaaatagcttaggaccagaaagtaggaaataataaagggaagacatgattgatacgctgtcctataaataacacatgcgactgacaaaggggctgagtaatctttagatctgtgcttcatttcattaatggagttgttaaaccaggatgtttgagttgaacttcaatcagagaggctctgcctcccatttaaaatgcaggcctacctctactcactctctggactgatatgttgacaaaattggtgtaaatcgaatttttgtaaattggatcaaatgcactaggggaatcttgctgtgaaaaatatgagtcctttttatcaactatagtactcctcctctctgcagggaggctgggattttggtggagtgagtctcttcagatgggcattgcttcctctgagacagtttcctgcacgtgttcccggtgctctgttccccgtgctcctggaagacagtgactgtgagatttgcattttttcttcaggttttatacctcacttggtcggtgcttccaggaataattggtggtgatttgaataagcccgcatcattcagatttcagagcttggttttcaagtgcttgctaaggagggctcccagctatgaatatggaatatgatttccatatctgttccattggggagtccaggcgtgtcataaccacttcagagtcatgattgtatcgagacaccctagctgtaatttttctatatgacagttcagttttaaaattgtaaagatgccaaaagcagggctgcattgttattagggaagtcagtgacatctgttatatcttgttaaccaggggaggaaaatgctttaatcaaaacatctaattataccctatgaactgatgaaatatcctttgctaaatttttggaattggccttaatggaagaagctggcctctatcagaactgtgaagtaaatttaccctttttatttggaaaaatatttattcctaaccatagtgacataagggtattttaattgtatcagattacttttatatgtctgttgaaaatagttatttttcagaagttgttcaagccagcatcacgtttttgtttttgtgctctctgactcccttagcatatgaggcccccagagggagtttgtatttccagatgtgagcctaggaggatatgtggtgtcttagagccacctggggagggagcaaatgataattgcaggtgagatgcagggggataattcagcctgtgtgctgggaggtgcgatttcacacctgaatgttgagacctgctgtgttagacacttgtgttgttttaaaatgttttattactctaatatagaaatggaccagattgttccaggtcaccttcagttgaaagaatataaatgtttttaaatattgaagtataatgtgattccagaaatggttcctgtgtttaaaagtagttttacatatatctgaaagcattaaaatctgtttaactcagcatgtctatactgcctctacctctgttgatcattttttaaaaattgtaggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaattgtaaattattttggcaatgtggctttccactttgaatcattcaagcttcaaactgtccagtaaaactatccttttatctatatttcaaaactagaattaattttaactatagctgttagttgtttccagaatcactgacgatgattataatattaatgatagtacattattgatagtcttaatgctgggatatggattatttctgagaaatgattaggtctgagaaatgctttatttcttagttttgggggtatttcatctttctgacatggttttcccatgtatggagatcttggggcccacctgaaggagttttttgaagtgttgactgtgacactatgggcttcatgtttactttgggatctggtgggaagttcaagtgctattaatttttccttggtctgttttatgctttgtaatggctttctgtgtgttttttgggagttaagactagaaccttggaaaagagagagccagagttttctccctatatttctattttaaaacttttttttttttagacatgttctcgctctgttgcccaggctggagtacagtggcgcagtcatggctcactgcagcctcgacctcctgggctgaagtgatcttctcacctcagcctcctgagtagctgggaccacaggcgcgtctcaccacgcctggctaatttattatttgtagagacggagtcttcctatgttgcttaggctggtcttgacctcctgggcttaagcgatcctcccatcttggcctctcaaaagtgctgggattataggcatgagccactgcgcagcattttatttcttatgtattgttattctctctgtattctctgcctaaatgtaacccctgcactctttctgtatatatccttctggggatatttgaggctttcagaactgtttctttcttcactcagtaatctatgcatagtaggtactcagtcattgcttatttacagttgacaacaattccatgaaaagaaatttttgaagagggagctgctatttactattcgccttgtgccaggcattgtgctagcaattttgcattcgttatcccattgacgcaccccatgaaaaaaagaataataatctctgtttgatagttgaagaaactgaagcacagagccgttaaatcaacttggccaggatcagtataagagaggcaagaaatgtagcagtttttgcctgacttgaaagcttgggctccttatccctttactcattttcatacagatgcattttgtgaaagatggccacatggtctctagtagaccacatttgttcattgttgtgctgaaaattgttacaaaggattttctaggtataataataggatttagggaggggagagtacttattgtccaggtctttatttcctttgaaaagttggagcttacagttaggttgctgccactcatacaatatatctgtaacatattcgttgttgttttttctctgtttcactgtttctccctgttataaaatctgaccttttcccgggttatactactcaggtagattttaaaccattgtcaaaggcaaggattcaggctgatgatatagagggttattgtatgtcagtgtctgttctaaacccttgcactcatttatctcactgaattctaaaagtagctctctggaacacaaatgtaaaattggaatgaggactagcatgccctcacagattactgtgcatataagcttatattctgctatagattctgaagtattttgtcttgtctgcttttaaactgttctaggaagcagcacttgtcttgagaatctatttcacaataaaagagaccttgttttgagggctaggtgtatttttttaaaatctattaggaactctattctttctggtaaaagaccacactaaatagctctttttgcttttcttgatatctgtatcttgaagataccaggtgacaaatagtccattgatttcctctgtcattgtttcctttcattattctaagcagatttgcaaattgttctctcccatttcccattccaccctgttaaggtttgtttatgctacaaagagtatgctaatgaatataactgttagatttacttcttaaggaaatcccaactgcatttagagtactgtacatttttgagaaggctcctcctcatttcccctcggctaagatgggcctcctcacaggtcattctctgggacttcacgattcagaactggtccattaccattcatttacaaggaatgggggttagtataaagatacacacacagaataccctcactgggcctgaattttctaaagatttctagatgaatatgaagatcagtcaagttacacacttctctcaagagtcactctccgtctctttctttctttctttctttctttctttctttctttctttctttctttctttttttaagagatgggatctcactctgtttcccaggctggagtgcagcagtaatcatagctcactgcatcctgaaactcctggcctcaagcgatcctcctgctgcagcctcctgaggacctgttggtgtgtgtcaccatgcctggctaattttttaatttttttttgtagagacagggtcttgctgtgttgcccaggcattctcaaactcctgggctcaagtgatcctcctgcctcagcctcccaggtagctgggactgcaggtgtgaaccactacccctgctaattttttttggaggggtagaaatggggtcttgcaatgttacccaggctgatctagaactcctggtctcaagtgcttctcctgccttcacctcccagaatgctgggattacaggtgtgagccactgcgcccatctgagtgtccgtatgaagagaggtggcagtttcttcttggaatcaccatgctctgagacacacagtcttgcctttctctctccaactgtctcaataaacacaattgcccctttgtatgtcccgaatggaaataccatactagaattctattttacagattgtaattgttggggagacccaagtcaaaacatgttctttgaaatttaaatataactgtaaaaggaaccacaaagtctagggctttaaaggtgatcttttatgctttgattttatgtatttgtaaaatacaagttctatattgactctagggcctgtctcagattgtaaacccttagatagtaactgtgtctttttaactgttccttgtatccttccttgcccctctggtggtctataatacccctgttgtgatgattttgattaaagaaacatagtgtgaagatgggctgtcagggatgggtgtcagtttcacttcagggtagtgggtgccatctattttctgattacaggtgaacattactttagcattatttttttttgagacagagtcttgctctatcgcccaggctggagtgcagtggcatgatcttggcctactgcaacctctgccttctgggtttaagcgattctcctgcctcagcctcccgagtagctgggattacaggtgcccaccaccacacctggctaatttttgtatttttagtagagacaggatttctccatgttggccaggttggtctcgaactcctgacctcaggtgatctgcctgcctcagcctcccaaagtgctgggattataggtgtgagccactgcatccggcctattttagcattcttgttgtagatttctacatctgctgcccatatttcagctgtactcttattttgtttagtatggtgtacctgggattagggacagacaaatatgtatgctcagcctgatttggaaattacattgttgaaatacagcccatatggccattgtaaaatggttagtgctgcatataattgcctttccaatgatgtgctttgtcattacttccatcttccaagaagcactcctgtagcatgctgacagcaatagcatcattagaaaacatatggacatgcaaaggcattaaatcgtctttagtttaaggattagattacagtgttagaggataggtcaccaggcttgcaatcgatgactcttgcttagttcagcactgctagactggatgatagagatttgcaaaagtcctatttacttgtctgctgagtgtatttcatatcttccctgcaattgtgagaaggtcctttagctgtgtataagcctctatcacagtattgcagccagttggcttctcaggagtgtttttttcaactattcatgtcctgtgcagaattcttttctaggatgctccctcaacctctgtttttctgaatgtgagcccaaagcaggctaagccaggaattattttatttgggggtcatttagatataaaaagagactaagtggtggagtcaagaaagtaccaggtggctgccatgttgcccaaatatttcctcccttgtacagcatctatctccacatgggtctcaagtccacctcccttcttcctttcccctcttagaagcaatgggattattgcagcctagaggctcagtggtaggtcctagaggccgagggaccatgtgatagagcctggaaagagaccaccccctgaatcctgccctttgtagttggatgttttttccccccacaactagataggtttactatctggctgtaaatattctagggatgcaacagttgtgggacatggtatgatttgaattttcagggtcctttttgtagttgccagtgaatagtaagtgaaatcgcagaatggaacatcattcatcaaatttaatatttcttctttggagtttaacagaaataatgtggatttggggactttcagagtgataagggactttggagatcctcatgggcagtggttttgggtacctcagggtacgctgagtcatttgaggggagatcctgactttattaaatcagaactccacctttacctgtcttctatatttatacttatgtattaggattacattctctttgagaagaaaaaagtgtctggatttgtttattctttcattcaaaaaaaatttattgacagcttctgtgtgctaggcaggcagtactccaggcacaggaagtaccatagtaaattagaaaaaatagatatctattttaatggagtttatattctaacaaaggatggggggacatactgtaaataaacaaatatataatatgttgggaggtgacaggggattttataaagcagggtaaagcaagagtgagaacttagcacagcaggtcctcaaataacattgattcttttcattataatgttgatgagaaaaaaaattgattcctggccagggcaactgtgtggagtttgcaccatctcctcatgtatggtaaaattgctttcattatgcatcgtgtcacgtatttaactgaggactcacttgtatgtgtatgcttacgtgatgctttatccagggtgggttagataaggctcctctgaggaggtgatatttgagcagaaacttgaaggaagcgagggagcaagaaatacagataacccggaggagagctttcaaggaaaggggagaacaagtgtaaaggctttgaggaagaaggagtggcatggtatgtgagcaacacaggagatgttggcggctggaacaaagccattgaggaggggacagagagtggggaggggcctgcagtcactttaactgagtgacgccagaagcttagaaacagcagaaagcaactgtccaaagccctcatttcccaactgaaagtgtttttgaatttccccaaggtcacccagctgatgtataaacaagagcacatctggagctcacgttatattcttttaaagtagcttctcattgtaccttgtgccaccactccaggtcttaggagacatggggcatctttttggagacaagatttgtgtctcctttcctgttagtgggtatggctcctccaagagatgtgcttcaagactctacagaattccagtgcccagtcatcacaaagtgggaaacggctttgccagtgccagaatcaccaccatttggggaattattttaaccacaatggctcatgtttatcacaggcttactgcttgtgatgtttgttgtacccagagctttacatgcattaacacatctaaccctcacaacaactctgtataataggtcacattatcattattttagagatgaggaaattgaggtgcagagaagttaagtaatttctgtatggtcatgcagatagagttgtagagttgggatttgaatttagactatttgcttcagggcctgcactgagcctctgacaaagaggagggggatgagcttgtctctagataaactaattggaatatgctcccctcgcctccattttaagatggttctaggtagggcctagccttgggagtaataccaacttgtcacaacccacttctgtgactccaggtgttagtttgtgtagaggatttcacagccagtctggctcagtactggcaactttgctgattttaggtggattcctgattcagcaggtacctttggtctttctgagctgagtttgactggagcgtttttcaagacctgcatgagagtgtgttacggaatacaggccagtgttttcaagtcagcggacccagttttagctggtctgtcttttttagccccagtgaagtaaaagccccagacaccaccagtgcccataatccataggaatgtaaaatcatctttttagtactggtgcttttgaggaccagtacactatgtgcttgctttaaatttgtctaaaaatgtatgcatatgtagatatgtgtatatatgactatgaaatattttctaggtatggaaaagtataaagcataacatagccaacacccatgtacccaccaccaactttaaaaaaccttatgactttactgtaattttcttaaaattgtaggttatttttagtgagcaggaaccacagtcaaccgtaagttttagagtccaggaggctcaaacctggccacacattagaataccctggggataccctggggagctttaaaaaagtccttgtacctctgggagggtgcaggaagcccccacctctatcatcagaattttaaaaagctccccaaggcgaggattctatcatgcagtcagggtaagagacctgctgtttggagggttgtgtttggtttttcttcactgggttctcagatgcctggtaccaagccatgtgtggtactcctggactttatatttcattttcttaaagcattttttaatgtggttctactttcaagattctggagggtaatgtcctggggagttcctctccttagactcttccctcttcagcaccttatgaggcaagctgcggatatatttacatattcattacaaagcataagcatcaggaacttagagagtaggagtgaggcattagagaggggactaagaaattcagaagtattgggagctactgtctgttgaaagtgtttgagatgagtgaaagttatagcattaccttggaagtcagggggatgcagggttacatttagaaaacctggagtcacacataccttcacaggaaggctctgagctgtgggatggtagttgagggcctttttggtctacatcacaggtttatcagtgaaatatgtggtaagatgtacaaataagatgtgccccaccaccagaatgatcagttctgtgtggacacgtccgtgactgtaccctctttcagaagtgctatcaattatgtgttatgtgtggcctgattatcctctgtgggccttggctccatgcagcacctccatccccgtctgcccactcattcattcaacaaatagttgctgagtttctcttctctatgccaggttctgttctaggcacttgggataaaaacagtgaactaaacaaagcttctgccctcaaggaatgacattctggggatgtgggggagaggtgggtgagtgggtggtgttacattctggtgtcgcattgttttttgatgtgtctaacacagaaaaagatgtgtaactgtaatcctcctttagaaagctctaggggagccatttggcaggtagggaagtgttttgcctaatttggcttaaattatgattttttgattctgaggattttgattacaaatgccttcatgaatctacttcttcaagagaaattaagtgctgagacattaaagcttccagggaccttttgaattggttggattttattagcagcttaaaatgagcatgacatacagtaaggttcaagcttaggggagatgctgaagaaataaggatacttgattttctttccacttgaagtggaatccactaatccatctgtgctcataaatttgagagaaggagggcggaaaacgaaagtttatttctagggctctctactgggcaaggctatcaggttaccttcattgaaaagacttaatcagaagtgaaacttaaatctgttacagtcttccacagctgtccagggaattgggcactgatgaataccgtcagatggacccctgaatagagggaatgccttagaggtcatgtttggagttagtcaataaaatggatctcgagaagaaaatagaaagtttgagggaaaaaaattactggaaaagaaatcttaaagcttttgggttagatgttagatggatgacgaaaacagtgggtgatatgatttcctttctggattaccatcttcatcagatattgttgtcgactacagaaaaaatattcccagcacgtaaggactctttatacctgtgagctcttaaaaagaatcatctaaaatactaaaaaagcaagaatatgttgtttcactagcttttgattcctaaagtagattttgacttccgggtgtgggaaggtgggtggaaaatgagtttttgttaatattcaaaggcatgaaaacatttttaccagtttatgttttcctggtgcatttagaaatctgtggatccttggggatggtgtatgcaggcaaatagagaatccagtacttgtgaatctgcctgaatccacaggtttgggaataagggcagggacttgagggttcacagatgtgaaggttgtacacagaactcatgcagagagatacaagatctttttgttccccctttgattagaaagaataggacatgaaagtacttaattgtcaacttcgtcttcaccataagcccagtattgatgcaaaaatgataataataatgagaacaagcatttattgagtattgggtattctaattgcttaaatcaactcatgtaattctcacagagtggttctatgaggttggtgccgttttgattcctgttttaaaggagaggaaacaggcacatagagtttacacccaaggacgagtgtgtcagtggtggagcctatacattctggctccagaacccgacttgaaccactacataagggaactaaataaatgcttcttaagagttttattctgatgttgcttttactgggactttcactcttttttctacccaacccaccccacccctaccccactcgcctccactttatctttggatgtcttcagaatctataatatatcttaagcttgcaccttattacagatgagaaaatagagagctataaaattatgttatataattgttctgtatgacctagtgaatctttggtagaacagggatgtggaacccaggttttctaatatttaggtcactgctttttctcactgcactgtatggcttccattaaaaatattttaaactaactgaactaaaaatttataaacttaatttgtgtcactcatacttctgtggatgaactacattaaaataactaggtgctgtgagattttgctctagggaggagggtggtagacattttaggagctaacatttgcctctggggttatttgacctcctcctgaggatgtctttctaatctttggtaggcgtacttaaaagtgaggagaaagtatttgaggaaatacaagagccattcgcagactttagtatgatctgtgggtttatggaagggcttttttttttctttctttcttcatttaggccttttttactttaacctccagtggggacacaactaacttaaatcttaaaaacaaataaacaaacaaaaaccctaaatacaagccttctttcgctattgtttggcaaataagatttcacaagagggtagaaagaactgccttgattcttggtgttttagactttcctatagtctagttttttgtttttgtttgttttttcttttggtcctgtgattccttttgttgttacctgtttccttggctaatgctttgtttaaaaacaagtgctctggtattccaaaacaaatttccagcaggcttcccgattgtgttctcagataaaagaccccagggtagtgctttaacttgaattttggttgcctatgcatgcctgagagcaaaattcagtttactaggtggcttccaacccagattaatatggttatatctaaaacgagggaatatacatttgaaacaggaaatgtggattggatttaccctttcaaagagccctaatgtgaatgtaatgagtagagttttgtctggggttagatactgtgggctccagtttgtttttgagtttttagctgaatgaatgactttagtcctgtcattaaacctctggaaatttaaactttcaacaatgtaataatgataatgaaaatagggaaaggctcctagactgtgctgtggaaaaacacatgttcagattttactgaagacccagaatcccatgtggccacagataatttgatttcacagtttctatttctagatatacaggatggggttgccagcagaagttacatagtgataataacatatcagcttcctttttagggaagatattgtaattgtgagaaaaatattcagaaaagccttggccaaatattgtttgtagttggtaagagaatactcagttattaaagcttctgcgaaccttttccaaataattacactttttccctaaaggaatcctcccacctcagcctcctaagtagttgggaccacaggtgctcattaccacacctggatgggtggatggatggagatatatatatatttgtagagacggagtctccttatgttgcctaggctgtgttacattttttgtcacacatgttgggtatggagaatttggagtaggtagtttcagatttgcacatcacaagttcttgccttgtgcagtggtttctaaaccgagttgcatatctatactccatggtaacttggtaaacatactgattcctggaccctgtgtctgatctactaaacattaatccctgctctgtggctctggaacattagtgttttgttttctttttggggtttgtgacagggggacaaggtctcgttctgtcacccaggctggaatgtagtgggacagtcatgactcactgcagtctcaaactcctgggctcaagcagttctcctgccttagcctcccaaaaagctgggactaccaccaccacgcccagcaatttttttttttttttttttttttttgcaggggtagagacagggtttcaccatgttgcccaggctggtcttgaactcctgggctcaaggaatctagctgcctgggcctctcacagtgctgggattatgggtgtgagacactgtgcctggcctggaacattagggttttttgtttgtttgtttgtttgtttttaacatcaagttccagtatagaagtttcagaaacactatttcttaaaatatttttgagtgttttcctggggcagtggtaatggtgatggtttacaataatttatttctatgctatgtaacttttctgaaaagaaaacattcctgtgtatttggttttaaaaccttatttactgtaaaatagaacacatcctggaaaaagtgtagtgtacagctcaatgaatgatccaatgaatgatcacaaagtgaatacccaggtaaccagtactcaggtaaagaaatagaacattgccccctccccacaaaaaatgatttttattagattcctcaaattttcttttctattcctcctcaaatcccaagaaattagagatataagtaaaggttgatgaaacaatataataaggtgtaagtgaaaaaagcattgtcttttggtaggtggtgtttcttaattactcttttcagtaagtttttggtgatgttaagtttgtgttgtttatctatgttttgattcagccttaagccagttcttgacagtgactgtctattaatgctcacagctgatattaagattacgttctaagatctatcttttctgcaatctgtttcactgaaaatattctcatgatagttttgaaaatgcgtaaggacagattatcttctgactctaataaacaagtgagtcttgtcattactgtccaggtaacttaggaaacctgtctcagtagccaggtatctttatctggtacatgataaaatgtggtttcttagttttttttaaaaaaagttccttcctcctctctatccacccagaataatctctcctccattccaacccaatcagaacatttaaagccctgatggtttttcttttttccactgaagaatcattcaattcttagtgagagaaggtctagctgtattaaatagcaagcttgcccattttctttggaaagggatgctcatggtaaaaggacctcaagcaaaccctgcacttaagctgtgtgcaagtggagggagagagctgtctgcagccacctgccagcagctacacatctgtgctctgctagcaagcatgtgggctctgtggatgtgagagctgctccctttcccctctctgcctcatgctcccccatcttagtgatcgccactatcaactaaacaggtgacaagactccaatcaccctgctctgaatggctctccatcttcccaaaagtataccagaggcctgttttgtttcagtacattgattaaataaatattcctgtgtgcacaaaggaactgaaatctgttatggcactctgcagttatctgtccattaatagtggagaaactactgccagttttctcccctcggtgcccccgccccccaccccctttcttgtcactaccacgcagattctcaaaggtgccagtaacagataaattatctgacctctgctttcaggcttgtgtgaagcgggaggagtggtgtcatgctctttggtgaggcatgccgttggggcagtgcccaagtgtatggataataggagagcccgaatgatttagattagaagatgctttcttgctttggggttgtgggacctttgtctctccccttcaattcttagcagaagcggactcagaaaggtctttcaaattagcttgcctctcttttataggaaaagggtgcttctggccctgaagtagttctgtgtgtctactgtcagatgtggaagccacaaagtgcctgtgaaacttggtcccttgcgtttatttacaagtttctttcaaatggcagtggcaggaaggatctttaccatttgggcagatagccctagtggttgatgggagggcttggtggaagggcaggctttgtgaaagatccaagtgtggaatggtaggaattctagccatggtggtgctgactggtttcctttcttttttggcggggcaggggctggggtggagtgttggttaaaagaacacctagataaaaaacatgacggatttcgaaagtgttatttgggctgcgcacggtggctcatacctgtaatcccaatactttgggaggctgaggctggaggatcccttgagtccaggggtttgagaccagcctgggaaaaacagtgagaccctgttctataaaaaatttaaaaattagctggatgtggtggcttacaatggtagtcctgtctactcgggaggctgaggcagtaggatcacctgagcccaggagattgaagctgcagtaagctgggattgcccactgtactccaacccgggtgccagagtggggctctgtctcaaagaagaaaagaaaagaaaaagacagggaagggaaagggaaggagaagaaagaatgacaatggaacataggaaattagggttgtagagaagactctatgaacattattgtggtgtgaaggaatggcatgcagagataagtgtgatggaagggaggtgttgaaatgtttacagctcctaacatctaccaccaaggagggggcacccctttgacagaaacgagagggtgttcctgagtagttgtgacattaaaaaaaattgcagggaaccttgtagctgcatggatggcagagacacataagtagggaaaaatgttggaataggtaaagtgaaatctcttagtgtgtgtgtcttccaactgactgtgggtaattagttggaaatgacattaacctgagcttaattgtaattttgcatagtaacaacataccagctgttcactgtattctttcctggaggtgcgatttaattattattatttttttttgctatcttttaagctccaattttctgttatgttttacttaaaccccgcctggttgccgtgtccacagtccccacagtttagcagtaatgtcatttttgttgctttcatgcccactgtgtgctgagggcttgggatgctcttgattttgctaatgacttggatttataaagggccacattggaaggtcactgagaagcatgggtgattggaaaccttgtgttttgggctcttccacaaggttttagtttattatataaatcatatgcataattctaggcctatcagaggtgctcaaagtatcaagtgaacaagctgaaagagaagttaattactgaacagtgattgttctgatataaccaattattggatcattaaatgtttattaccttttatatgctcctttcccccataagggcagtttcttttttaagtcattaaaacagaaatgggatcttaaaaaaattctgcttaaaaaatttccacgagactgaagtattaaaaaggtcttgtgtgatctgacagctaaatagcctgtttttctttggtctgttgaattagtaattaatgaaatgtattgcctgagcagagaaaataagattagttttgtttaggaagaaaacaaaagcaaaacattaacccccaaatgcaggttaatattaaagtgcagtataagaaatagaaataaaacagtcttcttgaatgataagatgcctaatggtaacatttgtttcattcattcattcgtcactttcttgagcaccaacattatgtttagaaggaatgggtttatgtaaatacagaggaggcaaggtgccctgtccccaaagacacatgggttagcagagcagttaaaccagacactttaggcggccaggcacagtggctcacacctgtaatcccagcactttgggaggctaaggtgggcggatccctgaggttgggagttgaaaaccagcctggccaacatggagaaaccctgtctctattaaaaatacaaaattagccaggcgtggtggcacatgcttgtaatcccagctacttgggaggccgaggcaggagaaacacttgaacccaggaggcggaggttgcggtgaactgagatcacgccattgcactccaacctggacaacaagagtgaaacgccgtctcaaaaaaaccccaaaaaaacaaacaaaaaaaaacaataaaaaaactcagacactttagtagctactgttgcaatgtagaaagtggtaggataataggtacaggggcatttctttggggaggagtggttatgaagacaggttacttctggaggctgaggcatcctgtggattaagagtaggggagagcatggttatgaagatgaatcttgctttttgaggtcacggtgtcctgtggattgagtagaagccccattacttgggttcacagcccagctttgccactacctagctgtgtgaccatttatctcagtttccttgtgtataaaatggaataatagtaatgcaaccctcacaggtttgaggattaaatgagttattatatgtgaagtgcatataacagtttacagcacataatgaacattataatcttaggttgtggttatgtcatttttgtgggataatgtgatagaacttcttaggggagattgcatttgattgaatgatgaggagcggaaagatgtttcaggcatttcttgtattgtcccatgtagccacatacctaatttataatgcctgcagtaatgtgtcggtaatgtgtgcttatgtagtgccattgtcaaaagattacaaagggcatttacagacgtttattctaagaacagtcccctgaaacgagatggtttatgcatattcttctgaagtgtgagagggtgcagagcaagcccatcctgttcttccattgaggtgtgcttggagcctgtgtttgttgtgggtaatttagactcacagagagaggaaacttttaaatcttttaaattatatcttaaattcttaagttatatttgcaaacaaatgtggtaaatagattttaaaaatgttttctgtagcttctagcaatagtggaacttgtttattcctgaggtaccagatcataggcagttgaatttagaggaagtttataataatgaacatttgtcgtaactgtgaggttgccactctgtattagttttcacactgctaaaaagaaattcctgaaactgggtaattttataaagaaaagaggtttaattggctcatcattccacaggctgtacaggaagcatggctggggaggcctcaggaaacttacatggtgaaagttgaaggggaagcaggcgtgtcttcatatggctagagcaggagaaagggagagggggagatgccacacttttaaacaagcagatctcatgagaactctttcacgagaacagcagcaaatggagaaatctgtcccccaggatccagtcacctcctaccaggccccacttccaacattaggggttacaattcaacatgagatttgggagggatacagacccaaactatatcttattatcctcattttacagtgaggaaaccgaggcactgagatgttcaggagtgttgctgaaatcaaaaagaagtgttgacccaggatctaaggtctttattgcatttgcgtaaaccatttcatttgatttgtgtgttttacaataaccctttgagaaaggtcagtcagctgctacgtgcattttgggaagtatcgtttatgagaagttggtggggcatcacagtgagcttagcatggactgaaaattttggggtggctgttgtatacccttttgctacttcaagcaagacacttttgggcctcaagatctataaaataacagagtttggaggaaacattgagtctgtaaactatgaaattcttgtgtagcttggagtgagacccatgtgggaatctttggcagccaccgtttaccaccttaacttttctgagcatgttttattattggtaatatggagctgtggtactccctttcttcagggctgttttgaacataatgcttataaaatacctgacagaccttgctagctctcagccaacggaggtgggattcttgttaattgtttcaaactaggggtcatacaggtagctgagcctgggtgagaagtccagcttcttaactcctctggggctggttctcttcagcacccaagccatattgctggggataaggaagacattttaatgagatgagccccaacttctcattagaagctgcagtcctgattctttctctagatcctatcaggttgccagttgatccagtaagtaatgtagtaaatgtaatggatccagtaaagagtttggggttttcatggagtaatttcctaaaatcaccgcagtcagtagcctgtgagccacatgagggcaggggacttgctctctgtggtgttcaccttgtataatgcaaggtgatgggacagctggcacatagttcggagtctggcagtatttattttgtgaaggaaggaaggaatgaacaacctcagtgagctgtagaaaatggtatgagaaagggaacaggatttttaaaatttcagttttgtgggacagaggaaattgaggcactgaatcaggcaggttatgcccagtctctgtggtcaccaggccttaaaattgggcataatttatacccttgaagatgttgcatggcaataccttctggtgggtggatcacctgaggtcaggagttcgagaccagcctggccaacatggaggggaaaccctgtctctactaaaatacaaaaattagccaggcgtagtggtgcacacctataatcccatctactctggaggctgagacaggagaatggcttgaactctggaggcggaggttgcagtgagccgagatcgtgccacttcactccagcctaggtgacagagcaagactctgtctcaaaacaaaaaccaaaaaacatatttctattgtgaaacaaaattttatccatgtcaggaatttcctctgaactagagtatgttcattcctcttttgtgatttgagtctgtgggagtcggaacttgtcaggaagacttagtgtagctgtgcttctaaggatgtgctattctcacaggcagccgtgctaaccatcttgctgtaaactagccacgagtaaacgtctggttgtgaatcacagcgtgacctttcagggaaaacaaaacaagcaaaccaccaaacacatgaatcagattttctttagtatcaggattgtaaagtctggtatttaacagtttgtcaggcccacttggagcagttgagacaacttcctttctctgtttttgtttgttcaagatgtggaagtgtatatccttctttagcaacatattaggataaaaactttaaagttttcttccactgagttaaactatattagttttcctaactgtcatggactttaaacaattaaagattcctggttaccactcaagacctactgaatcagtctcttggagtgggacccagaaatctattctgaagagcaccctaagtgattctatggttaatcagatttggaagccactgagatacagaatgataatattgtattttctatccacccatttattcttttttttttccttctctgtggtccgaatatccatttgttcttactcatttatccacgtcttgagtagattagaattgattacctatagggcattggtcattttaagaactaggcgtagaaacaagaggtagaacacaatgcctgccccatggggttcacaggtggtctcagaagtttttaactttgggttgagtgttaaaggattcacatacttcccaaaagccaggagcagaagattttgtgtacacacttttttttttttgttttaagctttcatcagattctccaaggggtcagtgacccataaaaggttaagaaccaaggtcttgtgcttgcacagctgttctggaaaaagtagaagagggcagtgtttctgttgccacttaagatgtttttgaccttttgagaggcaacagcggtttgaggactgtacctgttttctgtcctacttaaaatatttaaaaagaagaaaaaatagtttaacatctgggtcagggtcagaacaagaccaagggatatggaaaatagttatttcgtgaactgcatcacatttaatgttaaagagctgctgacagccaaacagcctggtggttagcgtgatggaggaacttcttaagctggatagcataggcaaggttcattccagttttcttacagtatataattagccaaattatggataacaattttcaccccatggatatacataaagactaattgtcttatttttgttccattttagccccagcatgtccattgaattgcttaattccaaaataactttgccagccgtacagctgatacattcttctttatcttctaaaatccccaaataacactgttcatagcaaaacagagttggatattaagaaagaacatctttaactgctgtggaaagtgtttactttgtaaaacactagaaccttgtatgtataatgttcttatccctaaggataactttataattgaatttcaattaaggatgttctcttccttttcctcctcctcttctctctaagttgtactcattgaattcatgtttcaatggggaacaaaaatttttcaaatattgttgttctggtaatgctgcattttaggatctggagagggcagtcagtgggattaaatgttatcaaataggttaaattatttggccatttactttggtatagttcctctggagctcaggaggatgttagaggtctttgttgtcagtgaaatcttgtaaatgtatttttaggctgttcaaatgtctggatcacctattttgaacttttgcatataccaccttacattacttatttttataaagtggacattttatctttataaggttttgccttgctggacagtgattatgtgttctaggtctttatagctttgccattacccggcatactgagcacataacagacactcaataaatatttgattaattggatatgttgattgggtacccaagaaaccagaagatgaaataagtctggagttagaacttgatacatgcttagaaaggtaggaacgtaaaagtggattatgaggtctatctcttaggctgacgtgctctcctttctccttccccatccctctccaccccctctcctcccttctctcttccatcctgcctctcctctccctccccctctcccctctcccctctcccctctgccttctcccctctcccctcttccctctctgttttctttctctttcctttccctttctctttccttaattttcttttctttctgttcatatataggtagtagagccagctcacgtttgctagttctttaaaaatcttaagtatttagaattccacagttacaagaattttatggtagagccacaacactaagttttcatttggaaaatgttaaatgtagtgaaccttgagagaggtttttattagttattgcttttatttatttttaaaataagtttcattgtgtatttgtaagatatataagattataggatgcatagagatagtaaaaaggttactatatatagtgaagcaaattaacatattcatcaccttacataggcaagagcagctaaaatctactcatttagcattaatcccaaatacagtacaattttattacctttagtcctcatgttgtacattaaatctctagacctgttcatcctacatctcctccatttccttcctacccctagtaaccactgttttgttctctgtctctgaatatttgaaaaaaatttttaagattccatatataagtgagatcatgcaatatttttttttctgtgtctggtttatttcacttagtacagtgtccttcaggctcatccacatttgtggcaaatggtaagattgagtttttttaagggctcaataatattcatacacacacacacccacccacacacacacaccccccacagtttatccatttgcctgtcgacagatgcttaggttgtctccatatcttatgaataatccttcagtgaacatgggagtgcagatatctttataagggggagatttcatttcttttgggtaaatgcccagaagagagattgctgggtcatatggaagttctatttttaatttctttagaaacctccatactatttttcacaatggctgtatcaaactacattcccaccaaccgtatacaagagttccttttctccactctttccaacatttgttatctttttactttttgatgtaagagctgtcctaatgggtgtgtagtggtatctcatgaaatggcattgatttgcatttccctgatgagtaatgatgttgagcaccttttcatatgtctattggcagttttatgttttctttggaaaaatgtctattcaggtcttttacccatttcaaaatcagattatttgtttttctactattgagttttgtgagttctttatacactttgcatattaactccttatcagatctagtttgcaaatattgtcttccaatttgtaggctgccatttcattggttatttcttttgctgtgcagaagccttttagtttgctgcagccccatatgtttagttttgcttttgtggtctgagcttttgttatgttatccaaaaaaatcattgccaagacaaagtccaggagtttttcccctgtattctcttctaggagttttattgtttctcgttagttagtgcttttaagaaggaaggaggcctcaccagacttgattattattttttttttttgagacggagtctcgctctgtggcccaggtgggagtgcagtggcgcaatctcggctcactgcaagctccgcctcccgggttcacgccattctcctgcctcagcctcccgagtagctgggactacaggcgcccgccatcacgcccggctaatttttttgtatttttagtagagacagggtttcaccgtgttagccaggatggtctcgatctcctgacctcgtgatccgcccgcctcggcctcccaaagtgctgggattacaagcgtgagccaccgcgcccggcccagacttgattattaaaagacatctgctactcaaatagatgccacccttaatctgtcctaatcaagtaaaatcttgttagttatatttgggtagaggaaatattgtaggctaatgaacagtggctgtcaacagttatcttgaaaatctagacttgtagccttgaaggagagggacccgaactgtgaagagatttgtcactaaccatgctatattggatgtaaacctgggagtggttacaggaggtggcttagggtaatatgtgctggcatctttaagtatttcgggaagagggatttagatccaagtggtcactcctactcccattggagacgcaatttggcattgtgtataaaagaagagtttttctaatagtgctgtgttagggtcctgaattccagctgctgccattcaaacaggctcacttaacactcacctggattattctaatgggaattcaaactgggtattggtgacctttgagggctctccctcccaaagagactatgagtgtgtgatttttcagggcaaaatgttctaagtaaatcaagtcatggttcaaagtctagatccgctccttgtaattttttttttttctttttaaagaactcagtcttgggtgctgtttacttcatatttaagcccatggtccccatgtgtattgaactggcacaaactaaacttgtctgctcctctaggtctcttctcatagtctgagttcttaaaattaaggtcagttaaaagaagcaccttggcattttccttattggagtttgctgtgtgtttgcaaatcaaaatgggaattgattcagtcatttgggctatacaggttttcatctcaagtcacttaagtgaaatccataaggaaagatgttcatgctttacctaccatagggctcactcacctcttttcttaaatacaaaacaaaaagcacctgccagttttaagggactgaaaaggtgttttatgatggctgaaaatacatctgagaataataatatagttatacctagactggtgatacatcattacagtatctgcggggaaaagtagagggtggaagtctgtatgtggggtcagtcttaacaaggaaagctgacatgaatgctctagccctgcagtaccagagggcacctggattaatgttctgggccctaattcagcgtcctgtctctcagacacttggcactgatttgctcatctcagagctgaagtcttaaggactaagaggagagaggaacacatcattttctctgccagaggaggtacttaaactgggaaaggaggaggagaccttaacaaatcaagccttggcaaggaaatctgtcatgaatcagcaatgccttggaaagcctctttcgctgtattttacaaagctaaacacttgtcgctactgacatttctctattgcttaccttgaggatcagctttaggtagcactatgaatggaatgaatccttttttgtgtgtgcccattttgacattaggtaattaatttacaactagctcaattagagtccagcccatacagtgtgtacatggccttttaaagagcctttgttttgacgctaattgaactggttgtagcagagacagccaaacaatttgcattcatctttggcagaacacaagggctctcccttggtatggacagccccattttttattccttctaccaagtctggcactaaagtgatgtgtgcttattttatttttctaatttaaaaaaactttgaagaggacaaaagccacataggtttattgtagaaaaattggaagacatagataagcaaggaagaaaataaagatcatacattatcttttcttcttaagacggagtctcaatctgtcgcccaggctggagtgcagtagagcaatctcggcttactgccgcctccacctcctggattcaagcgattctcctgctgcagcctcctgagtacgtagctaggattacaggtgtgtgccaccacacgtggctaatttttgtattttttgtagagatggggtttcaacatgttggccaggctggtctcgaactcctgacctcaagtgatccgcgcccccccccccccttggcctcccaaagtgctaggattacaggtgtgagtccccacacctggcctggagcacacattagcttaataccaagagaaaaccatttacaacctagtatttttctttctataccttttctgtatatgagggaatgcatgcacctgtgtatgtaactgttttcatgtgttgtttttacaaaatgggaacacagcatacaaactgttttgtagtatgcttttttttcctacttaataagatggaagtgccttgtcattttataaaatgttgtcctacaacatttttttttgagacggagtctcgttctgtcgcccaggctggagtacagtggcgcgatctcggctcactccaagttccgcctcccaggttcacgccattctcctgcctcagcctcctgagtagctgggactacaggcgcctgccaccacgtccggctaattttttgtatttttagtagagacggggtttcaccgtgttagccaggatggtctcgatctcctgacctcgtgatccacctgcctcggcctcccaaagtgctgggattacaggtgtgagccaccgcgcccggcctgtcctataacattttaaatgtctgcataatagtcaattgtgtggatgtaccaaaacatatttaaccaatctgttattattggacacttgagccctttccaggttttcgatgttataactagccttgtgatatatattcatgctactaaatctttgtgaagtcttaattatttgcaaccaataaatttctagatattgaattacttggacaggggcatgcatgttttaacattttttatgcatactgccaaattgcaacaatttccactttcagtaatgacagctttatgtttattcttgatattcaggagtacagtatagagagtattgactcagaagtggattaaatcctgatcagtgattttgctattgcccctgaaatttacgtcagccttataatcttctgttcccagtatcaggtgaaagaggccagtttatatcatatagtacaatataggtttacttatcttgactaatatgtgttatttagttttgaaaaattgtagaataaaagcaggtagctgctgctgtaagacaaaagtgcctttgtttttcgtaaggcaggattctgaaacagtgttttcactatgaataaggaccaacctaaataaatagatgaaaatcaaagcgatagtagatggttttgctaagtatatgaaaaaaatatttggatcttcttgaggcagtgaaacccaagactggaggagcaagatgaactgtggcatcttgtatcaggggtggccttggagaggctgttatacctcgtgtatgtggtctatcattgactgaacatttgttatgctgctcatgattgtatttgcagcacctgaaagtgcagttggacaaatagatgctcattgttgactgaatgaataaatgaatagaatagatacacaggagagtgagatttcagaaaaagacctttcaggtcatctaagaccctccccctaattttattttactttattttttgagacaggttcttgctctgtcacccagactggaatccagtggtgcattcacaactcactgcagcttcgaactcttaggctgaaatgatcctcctgcttcagcctcccaagtagctgggactacaggtgcatgccaccgtgcctggctaattttatttttttgtagagacaaggtcttgctttgctgcccaggctggtctcaaactcctggcctcaatcagtcctcctgcctcagcctcccaagtgctgggactacaggcgtgagccactgtgcttagcccatccagttttctaattaaagacatagaagttcagaaagatgaagtgacatctttctcaagactaagttaatgatcacagcagaagttgtagttctctgtatcaatgtatttctgagattctcatagtactagaattgtatgtttttcccttgatatggtactttgtatgattaaatttcaaaatcaatagtaaaattttaatttcaaatgcagtataagcacaatttccctaactcctctttttttcctctgtttggaaatagcctcagtttttgttaaaattcaacacagtcttaaacttgcatttcttttttccttactttctttctttctataatattttcacctatcctatttcattcacagtggaggttttaatttacttcaagcagtattgccatctggatgtcaaaagacattgaattgacttcttatctgtagatcccaataaaggtctcacctgcctagaaacaaaagatttagtcaggaattgaggaggagcaaagcaaaggcttcaccagaggcccaggtgctacctatctgcccacttgttctttgattgacagtggggcacagaggtgccttgtgtttctctaggaagtagcttttgcatacagtgtttgtttggaacttttcaatttgctagtgctgaataatgtctgcagtaaaagttggtttagggtaaacccggagaaaggaattaaagagaagttttaacatttctattgtttttcttctgtgactttagcctttcccccttcttagtgaattattatagagttttattaaaatgtaagttctggaaattagacaccatggtatttagaccagcatgggatactgtactcttaggttccataatatttcatagtacatctctttattgtatgttaaatgatagcgaagtataataaaatgcacctagagagtacttatctattttatgtcctgtaacattcagtacttgatgcaaatgtagcagatctcgattcaaacaggagcaaaactggttataactcaagagaaaggggataggctcatcttgatggaaagttccctgttggtggcataagttcagcaaaaccatagaatttgaggctctaagggacctttgtaacatctactccaatcttttattttgcagatggggaaagaattagccactggttcagtgtcactcagcaggttaaagaaagacctgtgggcagaacctagaacttaacgcctgctctgctgtgtcttttcattttctgatcacaattgaagcatgtggtctaccctgtctttaaaagagcataccatttgatgtttgttagcttgaaacctgttgtgcccaagggcacctaaaggcttccgtcttgctcccttttcctggatgcccaggtcattctgtgcctctgagggtgggtttggatatggctgaaatgaaagctgtgttgtggcagtgcttagagaattgtctctgatgataggactcttttaagaaagcagtgaaaaagcagtaaggagactgttacttcataaaacaattggctctggacttggagaagacccaggtggcggatggttacatcccttggcagcagctgtctttgctatatctcttacagtcttagagatctgggagtctttggctcttaattttaacctagattcactgtatgatcttggtcaaacgcctcacctcttgggcctcagttaccttgtagtaaattcaaggggagttaaagtggatgatttctatggcaacttccaggccttgaattattatttttataaaagtttttccacatgatcaagtaaccaaacatgtattgctgacagtccattttattactgttttgattggttttcatgagaatttggaaaatgtctgcagactttactgtgatcaggctgctagcaattatttacagagcacccatcaagtgttcagggctataaaagaaatagtgtctagcttcagggagacagaaagacttcttgatctccccagccggggatggagggcattctcttccactggatttaagctctgtgagtgcaggggctttgtctctcttaagtagtgcacagttcagtaaacattggttgcattaatgaaagaatgaatccagttgtcagtcttgcttatatttactgaagatatcccactgagatttattggtttcttcaacccgtaaatgctgctaacttgaatacatttcccagaaagtattccttaccttccatagaaaaatgcggccaggatgctctgaggctatagggaaaaaccataaatattccactcctttcttgaaattcaatttaatattagcatattgaatgccctgagattacctgccttcaaatattttggtttaacccagcatttttgaaattcatttgacctcagaatattgttcattccactctcccatgacacacttgttaatatcccccagaactttgatttgtaaaataaaaaggttgatatagggagtaataatatggaataaatagaagcagcaacattagttaagaataattaattgaacacaatggagcatatacattaagtgctgttcctagcagctctgtgtgaaactgtggtagacttgtagattttttttcttttaaaaatgactatctatgtctcattacagatacaaggttgggtggtagagagattgaaggaagttgcaagtgacctaatagctaatttacagttacggaagttgaatggtagcattttaacttgtgtcaagggctgccctgtcaggtactgcaggggaataacgatgaaagggagtctgtgtctgctccttctggagctggctgtccagtggaggagacagacatgtaaacagattatagcaataaagtactcaaatgtgtaatgaacagaaataggacacaggaaggaatggtattttcccctggtttagaacagggttgctgttcatacaataagcccaaaccacattaactggaacccctctagatcctccagacaaaattctactcatacatcaagattcaaacaactcggcctcttcatgctttcgctgatccagaattaattgcatcatctatattgcctgcagagccttgcttacacctgtgtcataggccttatcataatctgctttgtatgtgaattacttgagggcaggatagagttgtctttgtccctgtatctctggggcctgcagttacagcatggactgcatattcgctgctttgtttagacttggagcaagttattggactgtgaaagctactcactttaagtaaattcagtaaataaaattatgttttatggaagacagattggacaggtggtggtattattagcattttctctcaatgcttaaatatgatttacatttcaagatttcagttacattttttaaggaattcaacaattctgcatcatgaagtattctttcacacaaatgttccatagtcattagtttttacagaacccttttcttatattctgcatttcatctggaatactataagcacaagttcagtttggcattctgttctccactagtgattgagtttgaagcccaaggtcaggatattgattgatgacatttccctttaaagtatttgtatccatttgcaatttggggacagagtgattcccagtatggtgcaggaaataactaaactggaagtcagcctgactcagttttgtagttaattttctttgtgaccttgggcaagtcacttaaccttccaataactgagggagttggcccagaactagcacagtcttctaatgcagacattccacgattctctagggaggattcacttccatagaggtttaaaagtggatacatttttaggttaaatggctttgttcatttagtttttttctccttaacccattttggagcaataagactgtcatggagtaaaaccaaattacctggaactctcaaaaggctgcagttcttatcctattttttttatttttaagggaagggaaaaaaatggcaacaaacaaatttatatccatgagtcaggacaaatccatcccagttttctaacatacacagtgtacataaacatattcaatgaagcactgcagattcttaaccgaaaatggaatatttggtttgacttaccatcctaaatgtgggaagaactgtactttgatatatactttttgagtatttttagcaaaaattgatataagcagttgtcttggttggcaaggacttgtgtataggaacctggctcccagctcagtgacgagtgtattctgtaactttgaataagtcactgaacctttctagatgtcagtgtcctcagctgttagatttgatactgttctgattactaacagatctgtgattagacatttccatgcatttatttcaggcctcttcctgttctcttccttgagagattaacaaatatacccaccccttccctcacacagtctcaggcaattattgatttgtgagggaaaaggggtattttaaaacactttaaatgatacattcaagaaaattatctcgtattggttatcaattgatatataacaacattaccacaaacttagtgccttaaaataatacacatttattatcccacagtttctgtgagtcaggaggagtctgggcacttcttagttgggtcctttgcaaggctgcaatcaagatgttgtcctgggctggggtctcacttacacgcttgactatggaagcataagctactgagcccactgtgattgttggtggaacttatttccttgcagctggaggactagagggacttaatgtttttgctggctaggggctgccctttgctccttgaggccacccacatatccttgtaatgtgtgcttccctaacatggctgctggccccctcagaagcagcaagggagagaacaaggcagtgctgcagtcttttggaatgtaatcacataatcatgtatacataatcatgtatgtccatcatctttgctctactctggttaaaagcaagtcacaggtccctcccacgctcaaggtgagatgatcacacaagggcattgacaaccaggaggcaagggtcatgggggccgtctgaagcatctgtcagccacaccatatttcaggttttttttttttctgtatcttcctttggatctgtgaataagtatctcacttcatactaaagcctcaataaacactgattgacagaaagtctttgtgctcatttaaaacttctcagctccacagagtatttgtaccatgcccttgttttatggagtccccagatactgatgagggcagggtttgagtttgagggctgttcattcttctgcccgccaaccccccaccccgcccccagcacagaactgccagtgttaggtgctcattaagtgtttgtcaaaggattataactgttgttccaattgcagcagtaagtaaatttgaagaagctccctgatattgagtgaattgtattctccaccccccaaattcgtatgttgaagctctaacctccaatgtgatggtagtcccagctaccagagaggctgaggtgagaagattgcttgaagccctggagatgaggctgcagtgagccttgattgtgccactgcactcaacctgggcaacagagtgagaccctgtctgtaaataaatatgtgtgtacagacatacataaggttcacaattcaatttaaaaaagagaaagtgaccatctacaagccaggaagagagcccccaccagaaccctatcatgctggcaccctgatcttggatttccagcctccagaactgtgagaaaatcaggttcgcctgtttaagtcacccagtctttggtatttcgttatggtggcctgagctaagacaggccctgtgttctctgtgtagcaagaggcaggaagctaagcacaaaggttgccagatagcagggactggctggctgttagtgagccagggccagtggcatttaattgcagtcattcccattctttgctgagctttggtcataactatttgtagaggacccctagactttttttttttcttccaggacaaaagtgatccaaaacatactgtcttcagtttttgagcattggactaccaaacaggaacatttaaggaaaacaaaatgttgctgttgtaaagccttgatggtgggaagttatgtagtgaattctcaatttcttcttcctgcatcttgtcttaaaaaaaaaaaaaaacttttaaagtttttgtttgttcatcattcattcattaataagtcaagatgtagagggctcagtagccttcccctagttttctacatttctgactttggtaaacttcctttacttctgcaatttccctaattgtaatattaacatatatctaaaaagaatacaatggttatgtaaacctcctagcacttaataggcactcaagacaatatgacttaactgtataagaatgactaatgtgctatgtttatttatttggcttcattcattttgccagcaatggtgtagtatatatgtagtatatattaaaaatctcttgagtaagagaggtttggaatgggaaaaggaaccaagaaaatctcaccatctttcttctgcttggcagcaagtcttgaattctgttttatttttcttaagagacggggtcttgctctgtgcccagactggagtgcagtggtgctattatagctcactgcagcctcaaactcctgggctcaagtgatcctcctgcctcagctacctgagtagcggagactactggcacctaccaccacacccagttaattttttttttttttttggtagagatgaggtcttgcagtgttgccctggctggtgtcaaacttctgacctcaagtgatcctcctgccttggcctccaaaaatactgagattacaggcatgagccactgtgcctggcagagtcttgaattcttcaacagggcttttgaatattttaaagccacataaaatttcctttttaaaattgcaatgaaaattgtcaagtaaagtgggtcattttttgacctggtgcttaattgtacttagaagcaaatgcatatctgtaagtaaggggaggactcagaagtgatttaaagggaggattgtaaaagagtttgggaagtccatccctttcattttacaggttaggaggctgagggcattgtgcaatgatgtatagtcaggtagagagaggaaacaggaatcataaatcttaccttttgtacaaagtcaatgttttcagtaattttgttgaaaacaaacattaaacaaatttggacctgtaaaatccattgaactggtggaggtcagcctgacctagcaggacatgtggcatctctgttttgtgatgctgtatctgctttgggagtcccagtgcccaatcccctcagtgttgaaaacttagctcctgagtttaaggtggtttctgtggggttatggggcagggggagagggtttggaggaggggaggagcggaaaaagagacttccagtctggggctcctgctgtgttaccttaggggatttagggcctataaaaaacacatttacatctctgaatggcaacagataaataccaacgagcgttaattgaaaaggaggagacccaatggactagaggtcaggactctacagtgatgactggtggcctgggggtgtcagctgaaacggtctggattttttttttttttttttctccttcttcccctacctccttcctgggcttagaaatgctggaaggaagaaggagggaccattagttgaactaagaggtatgttgtttatactgttgttgtggttgtccctgggtggtctgaaattttggaggagggggtagggaaaggccccctaaaccttttttaaactagtataatacaacctgactgctacctgcagtttcccaattacccaattataacacaaatttgcacatttttttaaaaaagcaggctgctactgtttctccttatacaaggattttagtcactgtacatcttgtgtctttaaataatgtattaggaacattttcaagtctgtaagtgcttttttaatgagagtgtgaagattttaatgggactagattgcttttcatgacatttcagagtgacttaattgtaacaatgttgagaggctgtattttaaagtttgctaagtatgtctgtgtggattatagtcagacacttaaaaggacggatggttggatagtggaatcagatagcttttccttactactttctccaaatattagctctttgcaaatatggttataccaaaccaggcacaggtcaggattctcttaaaccttttaattttcagataggaacagaggctaataacagaccaatgtgggtaattttagagacaatttccttaaaacttagttggactgcaatattggtcctaaggcctctcctctctccttttgtagacccaggaggccaggctgtctttgtgtatacttcctgttagtccctgaactctcttccctgtttgctttaaaaacatagtgaccttgaccgggtgcggtggctcacgcctgtaatcccagcatcttgggagggcgaggcaggcggatcacgagatcaggagatcgagaccatcctggctaacacggtgaaaccccgtctctactaaaaaaatacaaaaaattagccgcgcgtagtggcgggcgcctgtagtcccagctgctcgggaagctgaggcaggagaatggcgtgaacccgggaggcggagcttgcagtgagccgagatggcgccactgcactccagcctgggcgatagagcgagactctgtctcaaacaaaacaaaacaaaaaacaaaaacaaagcatagtgaccttgtgcctcatttttttttcaggtatttgagttagcgtttctaaagcattatgactctccagataacagtttaccgttttaatgattggaatttcagactcaatttttttcttatctccaaaacaagaaggttattcagaggtcttttcctatgcaaacattattaggattctagaacctgtggcagacttctcaaaattagatcaaatggtcagacactttcactatctttttttttttttttaatggtcttgctctgtcacctaggctggagtgcagtgccatgagcattgctcactgtagcatcaacttcccagggttgagtgatcctcccatctcagcctccttcctgagtagctgggactacaggcatgcaccagcacacctagctgatttttaaatttttttctagagatgaggtctcactatattgcctaggctggtcttgaactcctgggctcaaacaatcctcctgcctcagcttcccctaagtgctgggattacaggcgtgagccaccacgcccagtctcctcagtgccactcttaatagaagcttgtattagtttccaaggctgccataacaaagtatcacaaactgagtggcttaaaacaacagaaatagtctcatagttttggaggctaggaaatgtgaaattaaggtgttggcaggaccatgtttcctcttaagcctataggggaatctttctttgcctcttcctagcttctggtagtttattgacagtctttggcattctttggcttgcagctgcataatttcaatatttgcctttgttgtctcttagtgttctccttgtgtctttacatggccatcttctggtaaggacatctgccctaatccaccctaatccagtatgccctcgttttaacattggtgtctgaaagaaccttatttctaaataaggtcacattgtgacatactgagggttagggctttaacgtatatttctgaggggacacaattaaacccataacagagttctactttgaaaagtgcctaggagattctgatgcagcctgcatgggttcccaaagcatgattcctgacctatctgtacataattcatcaagagcactaacaaacttacaagacatatatgtataatggtatataagtatgagtgatatacagaagaaaaataaacccaaaactcatgtactcatcaccctgcttaagaagtaaaacattaccagtacctttaaaggctctggaaagcctggggtgtttgtttaaaacataggttctcctctgaggggttaggtcagggaggtttggagcaacaatgtgtattagaattcagtaactttaaaaaaaaaaaaaactccacgtgcattttaaagttggtctttaaaattttactttggagtgggatgggattttttttttctattagcgaatagaaaacgtgcaagaaaagatgtagtaacttttttcatagtgtagtagaacagtctttggctcctcttctttttgtgaggtttcttgagaaatctcacctgtacttggtataattttccaaattaatttagatctctgacccagagagacttagagtgatgcacagtcatgtagggggaggatgtgtatgtgtgaagggacctgttattgattatacgtcttacattcttgcctttcttgtgggattttgtgaagattaatatctgccagataggtttaagtttgcaaaatgccttgagttccttgggggaaactgttacataaatgtaaataaattatgcagcacctgaatttggttgttcatcattttttatagtgtgttttaattaagaacttagtgctatttaagttggatggctggggagagggtttaatcactccaagatggttaagtaagtaggtaggagcaacatttaggctggaacccatggaggaataaatgaacaagactggagaccagtcattttccatggcatttgctgagcggagctgtggattaatgtctcttcttgtacgtgtgtacatggtgctgttagaaaatcagccagtttttcactacactttgtctcggacctgtagataccttggacctctctggttttcctgagtaagctggaaaccctaacaacagccaaaacaaaacaaaaacggagtttgtcttacagtctaggtacttggggagcaagaggcatccagcaaactgcattggcttttggtacactgtgtttctgtagtccaatgagctgggttccaaactacctccttttgcctgttacatacagctttgtgttccagtggatgatactgttccttaactcttaaagagtggacatacgaaacagttgccaacaacccgtggtccagttgtgcctcctttgtttgctgctttgtcagagtctcactgtatgcttttttttttggcctttggcgctgtgagcagagtcacctcatcctcctttccgtggccaactcaaagacttacaacctttctccctcattcctatgtatctacagaacactcactagttgctaactagtggatacatgtgaattatgttttgatgccatagggctgtctagtggaggatacaaacattaaaaaaaaaagctaaatccagcaaatagctataattagatgagggttatagagaataaccacagactctttcagagcatataaggaggcgaatctaacccagtctcggattctggcaaattgcttctgaagagtgactctcagcaaaatctggaaggatcactgggaagaaattagcaaggaaggaggaagaaaagagaacagtgccttctaagaaatataccatgaagtcatttttttcctattcctttctctgcccttttccttccccacacagtcttatgcagcagcacaattttagccatccaaactgggccagttgttttgttacactgtggatggttggagattgagagctatgggaatgggtaggagttaaaaactgaatataaattaggtgacaagagatggcaaaatcatttattgggatgattaacttattaaattgggctattcccatgctgtttttctaaaattgtgctctgatggccattttggaagcctggtactacccacagactggagtatgtcctaagtaggttaagagcttgggaaagatgcttgctgagggagggccttctttgtactctttctatcaataagaaataataaagagttaaagcatcgttacattttagatatactttctcaaactgctgacatcagaattgccaggagcctgttaaaaaggcactttctgtagccttcctatcccaggccttctgaattagaatcttagcagtaggattcctggccactgtaaagtactctattgaaggcgtggattaccagtgggttattcagaggagaactttcatcattttagccccgtgggtccctgcctgatttcctgccatctctcactaccaggaccagctatgtaatttgtgaggccccttatttaaaaagaaatattaggaatttcgagacagtgatggtagagcattaaaccaagtatggggccctttctggatgtaggtccctctgggattgcacgggttgcaagcccatgaagatgttcttgttcaccattcctgtttgcctttttaaaatgctcctgcagtaatgaactgcttattgctccctgtgcatgatactgttttttgcctttgtcccttgggtctcactatgtggcatgctgtgtttcatctcttttctgtcacctgggcttacctcagtttttgcacatactgcgttagaatcctgtgcaagtcgcccgtgctatgctgtgtgctttgagggcccggatctgctcttcctcatctttatattccctgcccttagctgaggctctgccttggtcttctgttaagtgtgctgaaagggatacttttttaacctgaatcttttcttaaaacctaattaggttataggccattgggaatgcagatttggttcagagtgaggagttggaggctgtgttgccctagtagtgtcgtgaggactgcctgggcgtgactggtctgagacagtgtgaggaacggggtgtgaaacaaacttatgacatctctggcaagtagtgcatactctgctgttgacacctttgatagctgctaccctctgataaccagtgtttttttttctggatctctcattgaactctgagtttctgggaacagcagatttttctgagccacaggttcagatgtgttagcagaacctgaggaaatgtttcttgcaccaggaaggtggccattttactccgtggctaatatttggaactagtcatttctggattgtttgaactagcgtgttctggggaattccccaaagctggacgcacttgttaaatgaggttatggctctgtggggtgagaaatagacccgcctactatacttaaaaggactgactgtgtttctgccttcaggtaaccagaggtagttatgaatttgggtgaaacctcttcatctcatgatagactagcaactagaggttcagagaagttacacagaatattcaaggttgattcagatagtgactgaattgggactagaatccatggtttctattctgtggattttgagtaagatcactaatcaacatgtgaaatcttccttgtgtcattcaattagaatttaagtgtcaaatggatggtaaaatcatttcttagcttatgtagatcataaagattagcaaatcaaggcagaaaaagacccccacacatatttgttgccaggtctgcactaatttctggataaaggttagtatatatttggtctacagggtgtgatttgagtgtaagttttttctttagtttttagattattgttcaaagtccccactgacagaatgcagggagacagccttgattagattaggccagattagattaaatcgaatggttaaggcctttggagcctccagcttgtaggagacaccataatggccttcatagcgtccttaaatcctattaggtaagttaatcttattgaagatttcaggtctgcataaagcagtattgctcttatactctctatggtgggctctgcttgttaaggtgagcaggcattttaactttccgggaataagttggttttattggtttggggcaagttaatctaaataacttgaaagtagacacctgtgcctgatagagaggccattccatgtagcaaaataggctgtctcctggcttcccctttgcttggtggctgttagtacctgtgacagggattttttttctttgccctgatttggggaaagagagtcaggtgagatgtgtaataataatgtacggagacagtagtatggttatgacactgaggcactactagatattgagaataaagcactttggaacttaggagctggaagcattcttagctgtcattttttgagtgtttatagttttattataggtgctagttggctcttgcctgtttctacaggtgcagtgaccatttttctgaagcaaaatattcttgttgtcacaggcttttcctcaatttgtgaatttatggacctgcaaagttttacaaacacatgaattatgtcaaattttgtaatgtcttttgaaaaaaagggggaaaagtgtaagaaatttagaccatgtaggtctgaaagtatgcttactacatcgatagtgggggctggaggaactgtgaaaaaagtaatagtaaatttccttttttagatctttgccaaaggtagttttgttagatataaacaacttcaagacccacaagtgactactacacactggattggccttcagagatactgggattttctttccaagtatctttaaaaatgaggttcgtagtgctttagctaggaggctgagtgcccactattaagatcctgtgagttaattggtttggttcacaaactaactcatattgcagtgtatctggctgttttgtggctgggagaaggttcctgcattgaagggactgaagtgacactctgaccttgggacttccagtgctgttgtggagtggggacttccttcttcatgtgggcttgctggctcttcatttattgtcccacctgggctctgcctgttactcttctcaggccaagaagtgagttaggttccttatttaacttttctaatggggcagctctgcatctgtgtcctgtccccaaagactaaagagaaatttcaggtgtgggccagattatggagcctgaagaacagttttatgattgattaatggttttgatttgcttttaggaagaaaagtgcaactagcccattggatgaagatagtatctctctccagcactcctgtatcaagtgtacagtgttctcttcctgtatagcacttgtattttcaagagctagggtcattgagagaacacttctcactcatgagtttcagagcgtagcagagtacacacacctgaagcaagaaatgtaattttctctaagtgtactaagaattactttaattctctgtatgtgcatgcatgtgcccacataatggtggtgggtttggttttttttttttttcatgctccttgaggagaaataacccgttttttgcttttattgattcacgattacctacttttcagggttacctttgttaggaagcagctgctggaagaatgtgtgctcattttgtacttgtgtcctttacttctatgtcctctctgacctgaggctcaccctgcctgccacctcctctgcatcagcccagctttgttcttctgggcctgttgtttccactctatgaagagacctccttacttctctctgtctctacttagtatccatttctgctgaggcagatccagatgggcagaggttggggagggaatttgaatgaggggaaaaattggatcagttaggggaaatttataaaacttctgtattctgtgctaatagttctcagatgctttggaatcataagacgggatgttggtctggcgacctttgagagctgctcttaaccagccagtggacagctatgcttgctttttcttcctgtcaccatctctgcttttcttgcccaatttgccaggaagagtccaccaattcttcataagcccactttttattctctcttttgaagtcatcttgattcacttcctacacctgcagcccccagtcttgcttgatctagctcctaatcttctgcttccctttgggacagaggagaagctgctctcctcgccatgctttgctgacatctccaaggggaaggagagcacaggccctttcatatcctgccccagaccttcacagggagcagtaataatgcctaaaccttattgagtacttaacatgtgcccagcactgtgacaaacacttcacacagattatctcttaaaatattcaggccagcccagtaaagtttatgtactgtcattgtctgtcttcaatttgcagatgaggaagttgatgctcagggaggttcaataacatgccattatgtacacagctgaaatgagtgatgcaatcaagattcaaactaggcagcccagttccagggctcttgtccaactactcagggaaaggttttcgaggtcactgccaggatagctggacttgtgacggttttcctgtttgagatatctacccttttacatcaacctaagcacttactgtctttatattttcaatgaactaagtggggtgttctgggtggtctttgatgatggcaactgtgtgttttaaagaaccagaaagaaaaatgtttagaggtgggcttctttagctgtagtccctcttgactgtgtggtcaaataatagggctcctgacaaggaaataaggctataagtgctcttgctttgtaaagattagttaattggtagaggttgtgtttctgtggttaatttgtgctcctgtcttagcaatacatgagtatccacaggcagcaagtgtgtcgcccagcagccccataaaacaaggcactcttcagcaccagcatcagttgatgcacctgaataacaatagggaagcttgttgaccatttggcacttcacagcctagtaattagaaactgtaaaacaataatacagacatgaagcaaatcctccagttaatgaaaaaaaaatctacaatcttgcattgtggctgagtgcaaaatcacaaccggccgcttatacagcaaagcaaacacttcaggattttggcagctgttttgtggatataaaaagctctaggctctgtattaatttggggcctgtcatattttttaaaaactgaaaacaattacctgactttctagttttttgttgttgttgttgttgttgtttttaatttactgcagtggttctcaaattatggtccccagtccagaagtgtcagcgtcatctgggaacggttagaattgcagattggtggggcccaccccagacctactgaaccagaaattctggcagtgcggggcacagtaatttgtttttacaagtcctccaggtgattctgatggactttaaagtttgagaaacactgagggtgtgggaagggtaatttgggggaagggaagtggagtcccctcttggccccacccagagatgagcttctctgtctagtggtgggatagttggcttgagatgtgatattgagaatatatgaaggctccctactgggtcaggaagttgggggagtgtctcaggggagggccgtgccttcctggggacctgtttaggagaagggtcctgggcagtagcttgttactagcctttcgggaacaatttcaatgtttcagtcaccctctgggctgttgtactattgcagtcagccctgctaggcccacaagttgtatggggcagaggagaagaggcatggggacagaaaccttatatcccaggcaaagccttagcaatgctgctgatgtcatatgctcatcgttgtcaagaattgaaaattaagatagtgatgaggtggtggcaggacaaatttcttcttttcactgtatgtcccctttctcttctggatctcatttccctgcctccagctatcttggcagatgggattatttaataattttcttggggcctgttggcaaatggcccctctgccccttccccagtgtgtggtgaccacaacagtgacatagcttcatttcacagccattaggaatcttgacgcagctgacccctagatctcctggaaaggcctcttgggaaatataagcttgccaccagagtgaagtgaattctcgagtggtattaccacagaggctcaggttcctgatgctccttggagtgctaggttaacagtctctctgttggggaaaaacttgatacaaatagaagatttgctaattttgctcacatttcaaaattgtttaatttgcttactttttttttctctttcagactattgggttttatctatcattccttttattttacaaaaaagaacatagggcatgttggccagataatgtatcctgttttttgatttaatcacccaacatagcatgggaataaaaagctgaatgagatgtagccttgctcctccctgacattgaagagactggcttctgggagaggaaaatgaccaagaaaagaaccacccagatcttgggttcagtttattctctctgtattttcaagtggcagaacttgcttgaatatgtgaatttgatgttggatcacaagcccaacatgtggcttctgtgggcatatgtagttattttggattttattttattttaaagggtctgtgtcctgttggcttttaggaggtgatagttgctgattctcctttcatgtgacattcagggctcatggagaagtcaaaggctcacactggtgttcaccttcctggacttcaggaaagatagtccttttgccagatgaatgggaggatctaagtctgttagatttccatgagtcgtgcagcctttctggatcgggacaggaagactgacccactgtccttcccaggctgcctgccgttcatcttgctttaattaaatacacagctgatgatgtcagcttggctcccggctccttcagctttcccctcagaacaaaacatccgggcagacagttgtgacaattaagtctcaagacccaagcttagtttgttctgaggtagttaagataaatctgcctaagcatctccaaatgcagataaaacctagtgctgattagaggtgaccctctaataaacctgatttgattaggcagaaccagcgaggtgcaggcaaatatttgagactctggccaagctgatattccattgacctttcacttaggggaaaaaacctgtttgatttttttcctatcccagagtacttgaaaattattacctatggcagctaaagcactagggcgaaataaacaggtgagacctgtggacttgcccttaagagtcgcagtcagctaccacctgggttgtgcttgcttcctggcagatcagtggagaatggattttgccggaggtcctggcctggaatgataattaaaaaggatgtttcagaacacacccaggtgcgttctgataaagcctgagcagatgtgggtggtgaaggattttttttttaaagtcaaactttgtttataaaggtaacttctaacaatttattatagaaaagtcaaactagaattgcattagtttgtttatatcaagacctcattagaaattaaggagaaatttccttaattgctccatctctggctcctgtaacagtgggcatacttctcttcttagcatttatcacattgttctgtaattgttggtttaccttcccttttgtcttaaaaagcagggaaattgtataattattcttgatgttgctcaaatgcttggcacctgggccaggtacagggattggcaaagtttggtccacaggccaaaccaggccactacctgtttttatgcggtcatgagctaagaacagtttttgcctttttaaatgattgaaaacaaatcaaaggatatatatttcatgccacgtgaaaattatgtggaatttgaatttcagtgttcataaataaagttttattggaatacagccatgctcattcatttacgttattgcctttggcatcattttgcactacaacagcagaattgagtagttgcagcagaaaccatatggcctgaatagcctaaaatatttgctatctggcacttcacagaagtagtttgttgatccctttcctattatatagcaggcatatagtgtaaatgcttattgtttgaattatttcaaatataaatctgagtttacaaatagagttattctgatcctaaaagtgttcagtgaaagttagatgaatgactgaccaatctatttctcttgttattcatttgtaaccttaggtttaagttttagaggtagtggttcgtttattagagctagacaattatatactatttctcttctgagaaactttataaagagttaatccttattacttttctaggttctgaacctactatatgggatgcagagacaccaagaggcacagagaggttaaactgactaagacacacagtaaagaaatggcatgactcttcatgtcttcatctctttctttgtttgctaaagccattctttgtgatgaaagagaagtcaaatctggagatattcatgagcaaactactgtctgatactatataatgcattatttcttatagacatcagtatctttgtaggctctttggttcattaccagggaaattcatttaaaaaaataataaatatgtggtttaaaaagtaaatactgcagagaatgatagcaattaccaaatgtaaacaatgtggcctttgagaaccactatgaaattgtttagtgaattaaattattatgcttttgctattcacatatccacttccattgactgttaaggaatatgcttcaaggaggacagatgagatataggtaaagtttatttttaagatacttaggtaaaacaaaataaaccagcaactggcagatgtttggtgaccttgaaatctggcttttgttttgagacagtgtctttaaaatgaccagtgccacaaatgtaaacaggggagttggagggcattggagtattcaggaagaaagtgagaaatcagtaatttgtagaacatgactaactggaactattgtttggtctgctggggtttgagggagtagaggaatttgtgaagaaggaaagaaggttaggagatgcatagagcagagaaacaagggtctaagctttcctaggaatctcaggtcagacccttgttaaattttgtccgtatattcattgtttgctgtggaatcttttaggagagtgtaatttttttttctgtttttctcttattaaataatttaaagggatgacattcagggctttgggaagcaattttttttttttttttcaaaacgccgctatacctactaattggatatccatcaggggatggatacttacaacagctctgcatgatagggataatattcctattttatggatgggaaagctgaggcttagttgtttttttttttttttttttttgagatggcatcttgctgtggctgaggcttagtttaattggctttcccgaagttttacagttagcagccagagccaagtttcaaacccaaatctagctgactccaggggccttctgttgtttctactatcccacttcctcagtggttgcatcccagagatttcatcgtttggtgcataaatccagcctaaagccatacttcaccattttgtgtgaataaatctcttcctcattttatgactcagctacctgctttctctttctaacctgttattttgtacatctgatttgttagcttcccatgttcccttagcttccctgcccttagttgttaacccttttgatcaatatctagttgattttgctacttaataacagactttagagggacttcagaggataaaaactagaacctccaccctactgaaaaattacatttggtttgccgttggtagtatgtgccccatccttctgccctggcactccaggggaatcaaaaaggaagagctgagaaacagcattccaggcttagaggctccacattctttgggtttgttggaagacttcttggcagcattgaaagatgcctgtgttttcatactgattttccatcctgggccacctgctttctcccttcctgctgttttccttttgtacctatgtggttggtgcttctggggctttttatagcagctttcatcatttatactactgagttttgcaggcgcttttcttttcaatttttgatgtttgacagtatagacttttatttatttatttttaatatgttcacttctgaacctttttagacttcatggtgacagcctccaggagaggaaaaacaaaacaagggaaattctaggaagaggcagaaggtagttactattgatttctctggatgcagatcctaactgttggcaaatttaaaacttacttattttgagtggaggtggttctgtgttagtgagaagttgatctggaaaagatgctgatttggacatggctgttgtaaaactaatgatgaagcaaaacaaaagaaggaatagtgcattttggccaggcatggtggcctgtaatcccagcactttgggaggctgaggtgggcagatcacgaggtcaggagatcaagaccttcctggctaacacagtgaaaacccgtctctactaaaaatacaaaaagaagttagctgggtgtggtggcgggcacctatagtcccagctacttgggaggcttaggcagggaatggcatgaacccgggaggcggagcttgcggtgagctgagatcgcgccactgcacttcagcctgggcgacagaggaatagtgcgttttcactttttaaccttagttgcacagggtatgttgaaagctactgttggcttcaccatgtcattgggaagtgggaacgctgacaatcaaagcagctaaacaagaagcaactcaggaattatgacattggcggcaagtcttttgcccctcttcagaggtaacactactagatctggagagagttctgtacattcagggaatcttcctgatctctaaaaaatttgagaggactagagaggagtaaagactggaacctggatagattgatttgtgagggacaaagattcagagaagacattttcttgaaggtgatgaacctgctttaccaaaatgttgtaaaaattctaaagaaaagttaattggatcaagttgacaataaatgttagaagggaaaaatcttaaagggtaaaatttgaaagtagaaagtttgtcctgtccacagtgtttgccatttcatagaccaaggtggttgggggaggtggggcaaaattactgtagtttccagtgatcattgccttctctcggtcctataaatgcaggcactatttagcactgaaaccatctggtgttggtggttgtttcttatgtcgtatgacctgcctctataaatacattgtgtataagcttaactgggacagtaattggtgtgatccttttctttttctgatctctaaggtctgaggcccatgaccaagggaaagagaagtgctttttaaaaaaacggacacttttgttgttttggtctcatggtttcactgaggtagtgttccacagtgtaagacaggttaggattgtatgttccagaattatgaacaagagtatccttgggaatgataaaaaccatgctgcagtgttgcatgtgtatttgtgtgttccatgtggaagaccttctgggctgtgtctgtctttgctatttatttatcacctgaaatggtgctgctcaaccactctgtgacagtgttattttaacttgaaatagcatgagggttaggagaaaatacctcatgaatgtgaagggggattctcctgggcgtatgtaattgcaatgatttgaaatgctttcacaggtttgtaggagagggtaatttttcttctttatttgctccttttatcttgttctaaagccagtattacctcctctcccaccgcccatgtatacttcttattcccttctccttccccctccctttctcccactctccatgtaaagaaactctttcctaataagaatcataggtattcagagctttttttttttttttaattaacagttgatttgactttttagtactgtgtaggagatgggaaaagtcagggccatttgatagtaattgcttcctggaagagccgaccaacttattataagggtgaggagtgtttggaggcattattttctggttccaggtgtgttttgagtattgctggtggtgctcagcactcttgacatttggggctggattactgcatgttgcaggagtatcttgtgtattgtaggatgtttagcagcatccctggactctacacaccagataccagtagcacccctcaagtgtgacaaccaaaaatgtctccataggttgccaagtgagggacaggatcactctggttgagaatttctgccttagaaagaggaaaatggattccctggaagcagaggttagccattaaccttatagggctggagccttcatttaaatgctttggtatattgaaagcaccactcaagtatcagtggtgagggcacatttagcttgttgaaattcctgtgtaattcataaatatcatattagctcttggcttcaatttcctaacactagaaatgtagatttttccccttattttcaaaatgaggaggattgtagtaaaatatagtaatctctgaggtcgctcccaacccttacattttatgattttagttataacagacatcttatggaattacacaatataagagttgaaaatgtatttgtgatcatttagccagccctcttctgttagttctatcccgtgtgatttccacaaatagatcagaccagaagaaaatagttgctttttacaagtggatgttattaaatgctcatatttagaatatttatcagaacagacttatattacagtgtttacttttctaactgattgagattcaggtgacttaactgcctaagcttcaactgtctgttgtttggaattaggcttttaaaagttggtctttatattaatattcctatgcctaagctggtactcttattgtcaaatagctttatgctctgttacattaatgagggaaactttgactttccagagtgccttggctgatatattggtgttaaattggtaagctttctatcccaactgctttatttatgctttaaacataaatgaaagcagagaatttttttttttggcctgagaggtagttaagagggaaatctaataccttttatgggtttatatgcttcatatgtgatgtgcccaaccagaaataataagatacaccccagatgtgaaggtaccagctaatataattatgctggagatcattttcaccttttgagggctgaattacattgaattcatttcttcaactctaacaggatttggtatagttacttaaatttgaattgggagctgagatgaagtcccaacacttgtgcttttactggaaggattgggttgtgtataccttttgtatttctgaagcttgataaactataaagccttgagtattcaggttcatggcaaggtttagatggatggggaggtatactctagtagaatctaacagcttagtatgctttctgtgggctcttgcctggaaacccaatctgaaggtatagtgatcagacacaatgctattcttaagccttcttggaaataacaggtgtcttagcctgtggtaaaaaggtaattttgcatgtattaaatattcaaccaagggcatgatctgtgcttattttggcaaacaaatagatcccaaaatgaatcaaacaaattgtaatgcagaacaaatttaaatacttgaggatttgttttagacatttaaactcatattttatcctctgtgtcttcatagtaccctcagaaagaaaagaatctttggaaatgtcagtgaaagggcagtataatctcacactgcagttgtggttccggactcagtctgtgtgcctgtctttcctttcactcctagccacgtgacaacacaaagagggtacttaaagtgtttatttcaccctggaagatttttatagagagcactttttaatgaagcacagcacatggcatcattatcatttctaacacagagaactcattttcaattttgctatcaaagaaaaatgacaaatagagaatgcaagaaaaaccagatggactaactgtattaggagcttagtatgcatattttgtgtcacatattagcattcattaagtcaaaagggaaaaaaatgagttttgcctacatgcattaaaccaataaggctggcaaagttccaagctagctcttgtgaattaattgttttataactgttttaattaaaattgttcagtatatgattaacctaaaagttttaatttccacaaaactgttgaacaaatgagacattaatattttacgttaaccatggcaatattgctgtggttttcagagctctgcttgttcaagcaaagcatggcaagtggtaggtggaaagtaccctgtgtctcatgccactactaagaaaacctgcaaatcagaagcaaattctatacacaagcatttatgtaggcatcgccccaaaccccctgttcagacagtctagttagagctgggcacctgtcataaattgtcaggttgaagaggttaacgatataacatggcaagaatacatttattgtctttttcttccacctggcttcatagtagtgttggtgtaccgtgtgagatccttagattagaaggggttggccagtagggactatgaaatgattgttgttaaattctaggggtttaatttaggatataggtacaaatgttagttctggaatcaaagggaagaaagagaagatttggatgacgcatcacctttacttgaggttctttaggttggcatcaggctaactttggtaaaaccacatcccattttgcaaatggtaaaacagggttggtaaaatttcactgtgtatagctgtggctcctgaaatacacagatttgcatttctgtcactcctccctctccccactttccacatgtacccccatcctaatgtacttcactttgttaaaagatggggatgtctttcctctctcctcccctaagcctttcactttgctctgtggatttgggtcatggtgctgtataaattcaaggtaatgatggtatttgaaccccatagaaggatattttaagagataagattaatactgctcagcataaatgatgataaaactcaggctgtcctaaatgtctaggtagtgatgcattttttaaggcactagactgagcttaccttttaggttgtatgacacttgatataagctgtccttacaggtttaaagctgtaggagtctggaatgcaaaactgaaccacagaagtatattggccttgcacttacatagtcaggatcatacggcattgtgatctatccagatttccagctgcagtcctgatgtggtctcttcattactttgtccagctgtttcttcccagacggtgctctgtgttagccttcccttctgtataatcattctcttccctaaatttttctgtttaacttgttaagcaccagattctgaataaattattcatataatcagtatttttgaagtagttaataatcagagtataataataaattttatgattgtacaggttgccatatttgccagaaatcagctttacacaagtgatttttgagataaatgctttattgggcatgttgctatctgttcatttcttcaggctctcttgatttctattattgtgtgaagttaggccattagaaatgcgcatacctggaccatattatttaggctcttcagagaactgccatcacggagttagagtgctatgtccttggtaaatggaaagtaagagccctcaatttaataatacagtattttatagtcaaataatacatctggcttttgtaaaaccttaaaagtaatctggtatcttaatgtttcattatacatatgcatatatgtgtgtgtatactcacatgcatatatacagacatacatatgtgtacatatatttacacatatacgtacacacagtcatacacatataaaaagcttctctaagaatttggagcgaggaaaaaatgtctgtcttctgaccaacatgtatacattcttctaactctcatgtgtttgtttagtgaatgaatgaatactatgtaattaggtaagagaactattgccttaccctggaaattcgaatcgtaattcagtaaacaattttaggtacccatcctaagtacttgttgatcaaatactattactcttttgcttggtgagtattatttttcatctacttttaacaggttcttctttggttaaaaactgacttctaaaataaaacaaacagaaaacctacttacttctaagccgtgatatgtctgtattggaaaataggcactggcattgcaccatgttccccatgataaggaaacaataagaggaatcatgcgtatggttcctgtcctgtaaagtctaatgggtggctcacacctgtaatcccaacactttgagaggtgaaggcaggaggattgcttgagctcaggagttccagaccagcctaggcaacatagcaagactcccatcttgacaaaaaataaaaaattacctgggtgtggtggtgtacacctatagtcatagctagtcgggaggctgaggtgggaggatcgcttgagcccagcatattgaggctgcagtgagtcatgatcatgcccctgcactccagcctgggcgagagagtgagactctatccccaaaaacaaaacaaaacaaaatacagtacatgtctggcaagaaggagaagtacctagctcagtccattttctactgaaaatgggtaatatataaagaaaaggaatttatttcttacagttgttggaggctgagaaatccaaggttgaggggccacatctggtgatggccttctcactggtggggactctacaaagtcctgaggtggcacagggcatcatgtgcaagggggctgaacatctagttcagatctctcttctgataaagccgctatccctactcccacaataacccattaatccaccagggcagagcccccatgacccagtcacctcttaaagactgtatctctccatgttgctacattgaggattaagtttcaatgtgagttttggagcagatgaacattcaaaccatagcagtgccaaaatcaagcttttgttttgttgtgtttttttttttttttttttttgagatggagtcttgctctgtcgcccaggctggagtgcagtgagatgttgtcttggctcattgcagcctatgcctcctgggttcaaacgattctcctgcctcagcctcctgcgtagttgggattacaggtgcacgccaccacacctggctcatttttgtatttttagtagagatggggtttcgccatattggccaggctggtctcaaactcctgatctcaggtgatctgcctgccttggcctcccaaagtgctaggattacaggtgtgagccactgcacccagcccaaaatcaagattttgacagtggggctgtaatagtagtttggaatatacttcatttattctagttcttttctctattttattacctttctgaatgtgctctctgctcccctggggcccattcccaatccagtagcggcaattaccattgggataaacctcctacctctgaggcccacagttttcctgaccatctctctacagcctcacttccacctctacctctccataaaacaatgtgtatacttctgttcatcagctaaatcactatacctatcttacttgtttttctgatgcaacaagcagccttccaaaaataccaccaagtctaataatccttttgctgtttagtacatcttttgtttgaggcttactgtcacatgacagatgatgacaggcaacaaatgactgtttaaatggtcaacagatgtgcccatccaggtgactctcctaatagttgacacacagtgggtggagggattgggttgttccagatattccctgttgttgggctagcttgctcttggtgattatagtttgacttattttgcttttattcagtttttgtggttctgttttgctacttggttttgatacatgtaggtagtgtgggttccattttggtatgtgaaatttcatatcatgaagaaagttatgattataatgtagcgttagtaattcccagtggtcattcccaaaaaatattttctgagaatgccaggtgtatataaaagttatttttgaaagtacacatgtagtgtgccacaccctctatcaaaacaggcccacattactgaaagaaggagggaaactacccatccactattactttacagtacttaaaatatgcagacaaatacattttagcacgtggtgatctttgtgaggatatcctgtcaatcaagagagtaaatatcttttctctttcccatgaacctagcaaccaatttgcttatagttccttcaaagctgttgttaagattattttgtggctggttatgtcacttggctagaaaaatggtactggaattaagtcagctttagccctatgctgcccatctttcttaacttatggtcagccatatgtttagaccagatgaggtaggaggtatgattggatacaagtacattcctggaaaagataaccaaaatcatgttctactaaaagtgaattactgtgtttttttccttcacataagaacagcatcttcatacctatggcaagaacctgtcatttttttttctgatcacatatgtaaaaatcatttgttggtagtagcaattaacataaaagtcaggttagtgatgtggttggggtgagggagatttgaccattgagagacacacaagggggcttttgaggtactgtaatgttctctttattaaccatacctgtggttgcaatggtgttcattttataattcttctgaaaaacagacatgttttctacattctgctgtatgtgtaatatattttgctatatacgtatgttttactggagaagaatttcaaaaatacctaaatagcacaaagtagaaaatgttatcagtaatcctaacactaagaaataatcgcaatttttttggacatgtatcttcccagtgttttggggacaaataaaaataataatgtatatctactcccatgagttaagattttaagaatgcatacatgtatgtatgtatgtgtatgtacaatatatatgtgtgtgtatatatatataagtatatacaaacctgactttttgatttattatattgtaatattttgacatgaggtttcaggattctatagagttaattttaatagccatatagagtaccattgtttggctatatcatattatttgcccaatcctgtattctctaacatttgcttgtttctaatatttatgtgttataaataacatgtatttatcttgtaggtatttaaaatttaaataggctaaatgggacccttctttatgtagtatgtagatatttcataaaaggtacattttgttgggaaagataactctggcttcaaatgctttttgaaagatgatttttttcccctcaaagaaaattgaaaacaatttcactttttttttccttttatgaagcatgtgtgtgtcatttgttgtaagaaggatatggccctgacatcttcatactcgattgttctctgtgaagttattttatttattcacttattgaactcatttattgaacaccatttgtatgccaggtgctttgttccagatctgaggatatagagatggagacctggtttctgctttcacagcctggcgacataatggatagcagggtttgggatgttgtctgtccatagactcttgagtttatggatccaaatgtttttgcttagattactttgctgtgatttttattattagacaggtgatttaggagcttatgtaccagagaggctgttgctttcctccctccccagcccttccacccccagactgtatgttcttctttaaggttgagtcttggaattcagaacttggtgagcaagacctgactagaacagaaatggaaatgaccttttcatgcacagcatgagcatgacagagaatgggctgtgtgttaactcctctctgatattgctgaggtcctttccagccctaaaattctgtgatttttctgatacttgggcctttgaagatcctaatacccaatcctttctcaaacattaaatttgtagcagaggggaaaaattaaattcctcctttttgagacaccagctgaactttgcagtataaatagactcaagagtgaaagaaaggagaaaagtgcattcacccatcccaggaaatcagatggggattgagagtgtgtctgttcatcttctgtaaacaaaaccattagtaacatggttgttttttacttgatccctcaaaaaaaaaaaaaaaaaaaaaaaaaaaaaaaaaaaagcagctgggtaccgtggcacgtgctgtgtaatcccagcactttgagaggctgaggctggaggatggcttgaacccaggagttggttaccaatctgggtaacataatcagaccctatctctacaaaaagattaaaaaattagccaagtgtggctttccaactacttgggaagctgaagtgggaggatcgcctgagcctgggaactcaaggctgcagtgagctatgattgtactagcactgtactccagcctgggtgactgatcgagaccctgtctcaaaaaaaaagcatcgttttagggtttctatttgaatagacatttctgtggcttgagtttcgagttaggaatgttttggcatagaaaaacctgttggcccagaaacatctggcatcattcacaatcaggccaaagtaaaggaaaactaattttttaggtagaatgttggcacctggaagaatggaggctgtaagttcttttgctggcaaagtataaaaagaaatgtttagtggacaggtgtgtgagttaaactctagagtataactaagcagtgtggctgcccattttttacttgatttgcttgtgcttctaccaccttcttaatgtgtccctggaatgcctacatgtaaaaggattctgatggagaagaaacttctagaccttaagtgactgtcctggttccagcactcatttagttgcataaccttgggcaaatctctcaagaaatctgttccgtcttctgtagaatggggtaataaacacttactcagcctgtttcacaacattgttggaaagattaagaaagcatatatgaaagtatgtactataaggtgatacttaggtattataaaaaaagtgaacagggatcagcacaaaatgttttggctgctgctgctgctggtgtgtgtgtgtgtgtgtgtgtgtgtgtgtgtgtgtgtctgtgtgtgtgtgttttgtgtctctgtgcctttgtctgtgtttctctaccaccttagatttggcagccctagtatctaagtgtgaaagtttgggatggatctcagggtttttttggtaatgatgactgactggtatggctattgaataaaatattgaagatgctattggtcctttaggacaattagttttgtctctctcctttaaggtcatttggatgaagcagcagtttgtgtagaggatactagtttttaagatatttttgtcctattttattttattttattttattttattttcactgttattccacaaaaatctttgagctggcttacaaaaatgtgtacaatgcaacagaattaaaataagtagaaaaggaattggggcactgggaaatgggtagggaaaatacaataaagccatgttaaggcttctgggcagaaacatgcaaggcagggtctgaggcagtaggttgagggggggtcccatattcagcttcccagagagtagaacaaagaggggaacgtaacttttctttttcttttttttttttggaaatggagtttcattcttgttgcttaggctgaagtgcagtggcacgatctcagctcactgcaacctccgcctcccaggttcaagcaattctcctgcctcagcctcctgagtagctgagatcacaggcatgcaccaccatgcctggctaattttgtatttttagtagagacggggtttctccatgttggtcagtccgatctcgaactcccgacctcaggtgatccacccgcctcagcctcccaaagtgttgggattatagatgtgagccactgtgccctgctggaactaacttttcttgagaaactttgtcaatggagaagatgtgtccatgaactctatcttggatatacttatcaatacacacaacggtgatttgtgaacagttgcttttataccgtcaatgcaaattaataacactgagacaaagcatgatttcaggaaagagtaactataaggggtcaagatcatgtgtctcacctagatagctcaaaggactggcttgagccaaggacaatttttagaacatgtcgaggagaggataagctacctgtcctcaggcagtctaccacaaatactctttatctcagctgggagctgacatctctccctgaaaggtttccagtgatattgtggcacaatttgttggccagaatcctagagacccagggatggagatgccagtgctgtcttgagagttcagtgtcttccctgttggcatcttctctttcttggttctggcatatctggttcaaggattagacacatgaattgatttagttctttgctggagagggcagcaaaatgccagttgtgatttttgggcttggctatgttgggaaccactgggaatttgtggactgccaataactcattttgtactagcttttgggtgaccattcagtggctgttatttcaattcatagttcagagtgactgtatttagacccatcatgtttctagagttttttcctagattcaaatcatggtaaatgctttcattagataatttagcttatgccctttttcctacttttatgtttccctgttgttactagccctagatacttaaaaaaattttttttggaaaggactgtgtgtttttagatatggggattgtattctgtgctttagtggggcacagaaggagactgtctggttaaggcaagagattgtggtgctaaaaaaggaaatttggcaggcctgttcctggtacttttagtaagtaaagaaagagaatgacaggctggctggggattgtattaaagggagccctgatcctcatatgaccttattccctgaacctagaaagatggtctgcctatgtggcagttattctatggcgctaaagacagttttgttctgctttctgccatgtatatttaggggcctaacggagagatagaaacctgttaaggaataatcatggatgttcaggcctattgcttccttcacttatccagaagccagcctcaccaatgtccatgggcaagtttgtgttcacacaagttgcttgtaacaagagggaagattctcattaagaagttggccctaaaatcaggatagaatcaggctatatttgtgtttctgtcaatagtctgaattccttattggtagaaaggtcttataattatggggtaactttgccaactaatagtactggggtttgatgtgggttacttacatcagaagtcacatcaactttttgacattagtttctattccaccatgtgctccagggaaaaggagattgatgtggactattaagccaaaaatgagaatctgttattgaaacccagaagtctgaaataagggtttagtgattgttttgtttagacacaaacttttcttcatagatgctttaacttcctaagtgagtttatatatttttctaaatatgtaatcttttaaaaatattgcaaatatttaatttatgtatttgccatttaacaggtaaaacagcaccaggaagtcttgctcctgttttgcaaaggcacatttagagagtgacagaggtttcccactgtgtctgggacaagcctcccagtgtgtctgggacaagcctgaaaagagtgccattttgtctccctgaccatttcactgattctgtacttgttgtttatgaaacttcattatgtaacagacaaaaaagcaatttcatgagcaattcctggaataggcaagtggacaaaaatttctcaggtaccttctctggaggctgtttgtcttccattctggctgcctctcttgagaactggagtggcatagtggttaagaccaggggctctggagactgcctggatctgggtgctggtctgactcttgagctgtgggaccttaacttctctgtgcttactgtccttacctgtgagatggagatgattggagtctccaccatgtcaatgtatcaacacttctaaattatttagagcagtgcctgagacattgtaaacacttaatatatgttggttgttattgtaattttaataataatagctattaaattattattctatggctgtcatgcctgagagttcatcacaggggcatgggtgggtgggtagggaataagggctgagaatctaatcagttatttttaatttattgggcaaaaatgaatcaaataaccgtggcaggcataatgaaattgaggtattcagtgtgtggtgaggatgaactgttttatcacagttcctctggtgtggcctgtgtgctttgattgcaggtcagatggctagggaaaagagtagtcaagctgaatgctctgtggtgaggctgtgagagggacaagaaacgtgggtcaggacagaaggcgtactgcaggaacagattccgaagtgtgtgcacagcatcctataatttgggctcctgtgtattttctttagttggttgcatttgttaatatgttagtctggtgtctttaaccctgtgactgacagttgacaatggtgtagctctttaaaagaggtgaaactggtctgaccacagtttacccttgatagtgctttcactttggcaacaagacagagggagaaagtccctgcttctctgctctgggaatcttaccaaatcaataaggagtctctggtagcactaacctcttttaaatagcctaagtgtgagatcctgacctttttttctgtatgtggcctacttccttgatgagaagctggcttttatattagaacttttttagacgtacatgaaacttgaatcttgctatttgtttccattgttgcttttaaaaaataattttacaaatttattctaataatatactaacgtattttgtctccaggactagtgaaactttttaagatttttaacagattcatctagacacctaaatctctctaggacttgatccttctccacccagcagaatactgtactgtgctgtgatcatttctcagggtggttttggctgagggtttttttttttttttttttttgagatggagtcttgctctgtatcccaggctggagtgcagtggtgtggtctcatctctgcaacctctgcctcccgggttcaagacattcacctgccttagcctcccaagaaactgggattacaggtgtgcgccaccacacctggctaatttttgtatttttagtggagacggggtttctctatgctggccaggttggtctcgaactcctgacctcaggtggtcctcctgtcttggcctcccacagtgctgggattacaggtgtgagccactgtgtccggccttggctgaggtttgactctttgcacccacagtcccatgatgtgtgtacttgtatgtatatatattcacatctgaggactgacatcatttcgcagaccgggaaactaagtgtgaggagtacattttaaaataatttttacattatatattggcagatcatccatgtgcttgtagaaggtattatattggtaagctgcaggtagacaggaagactgaaagagaaggtagaacctgcttggatcccagtctgtgcatacctaaggagttgagttggcaattcctgaaccaaaggttctggtgttcagaaatatctccagttattcagaaggatggcatgacattctaaaaataagaaattatttgtagtcacatcagtgtgtaatataccttacagaatattagaagggagatgaagcatttggggattcaaaggaactagttgtagacccttaggtatggccctgagactacctagggtggcttttgtagcaatctaaacctgtatcctgggatgttagcatctctgaacaaaccttttctctcccctccattgagatcactttctttaaagtctttatgcatttagagagttgctgaggcaaggccatgtcctggtttgctctttttaaaatgcagatgtttctagaaatgactataaactgagtcctgagccacctcttgtaacttttcaggtcttggtctgggggaagataaagaaatggaggtcttatgcttcacaatttggtttaagtcaactatggcaaggtatcttgacttaaataagtgtgacttaagtaagtctgacaatttaaatattagaatggtaagacatttttgtgcctctatagccatatgtccatcttggggaggaaaaactgaaaataaacgatgattacttttcagtattctgtggaaatcttacttctctttttagttaatttttcagtggataggctccctacctgccagccctaaattcttatttattcctgaaactctggtttttttcttttttcttttttttttttaaagtattctgaaactgttttctgaccatgcttcatatattgaagtagatttttttcacagaagggtaaaggaagtgcattatgtttcatatgtagatgcttttcaagaacacacagcttctcatcattcattttaacagtggacaattttggtgcctgtttatggagattccttgggaattatcagctgatagaaaatttctgaagagagatagaaaatctaatctatttggatgtcttgttaaatggagctttttgagtataagggtttctgaagaaatataggctgtcagagctgatagagtttagagagtctctgtgtaccattctttataaataaagacagccaaaagcccagagaagtgaggtgcttgatgttaagatttagttagtggccccctactggtctctgagctgcccatcactctaccttgactaatagtgataactgatgtttctggcaacaaatccaaggtacaagttttccagggtcttcaaaggaaagctacattatattaaagttcatgctgaatatcttttattgtgttctgatagtttgaaaattggttatttttgtactgttgtaaaactatagtgcttaactggaaaccccagcattaacccagcctttgccagcgtttcccttctataggatgagaaagttgttgaagagtgaggaaaaaagatggtatcttgtccttaacaaaaggtctacgtggatgaaaggagaaactgacacttattgttagggaaatggtaatgcttacatgatgatctaatctgggtttgagtttcgtttttgaagtcaccagtttttattttggtgtttttcagatattcttatagccttcctggggagatttattttttggagacatcgctcacattgtttactcctctaggttaaatgtactaggccatctgttgttaattttgtagttgtattaaattccatcctttggctggattttaagcaccaaaagcaaacttagacagaagcaggagcatttgcaaattacatagctttgagcctaaatggtggtttttataagtgcagttttcaaatgggctgagattctattttgagttttgggatcagtaatttaaacacagggacctctacgagttctctggaaaagcccattttgagaccctgaacagttgttatgccaaagcaagctcttggggtaaggttggcagtgatgctgctgataaattacttttaagatgcttggggctgaaggacaatgattttgtaatagtgttttaagttctcaggctgacctatgaaatctggaagtgctcatctgaaaggccagtattctttctgacaggcacaggaaaaactcgtcccctgcttgatcctcatgcaagcatttcttggaggaagccaggcctgtgggtcttgggggccagaacagagacactgagagcaacactactggcattttgaatttctgctgaggctgcaaaaacatttcaagggaaatctgaagttatcccttcactgtctacagcctcttgaattgacttctgggtgttacagatgggaccagcgtgtgtaaaagcagaatttatattctatttggatatcagaatcaagtttctctttttaaaataattttatggtaagtcgtggtttctctgatatgatttctgttgtgagcggaacaaaaatcatggcgaaatggtgttattacttaaccaaattgcctcgtgtacagacaggctgaactggtgctttgcctagagttggcctggagttttcagaaactcaattgtggcctttataaggctgtgcctggggttgtatttccaatctctctcaacttttgttcttgtggaagggaggaagtagagctgtgacagatatattgccagatagcacacaatagcacacaaaacgagaaagacacggcgtgagccattcatggagacagatttacgctctgtgctgccctcaaaccatagatccatctatttcagagaaacaacttgcccactgtattatatttcagacagggacatggcttagaagagagatgctgactccttctgtttagcttttgccgataatgctgcacgttttgctgtagaattacttttgtggggatgggaaagtatgtttggcaaaggaaggcctgtctctagattggaagtggaagaagggagatatcaggagagtaattggccatgctgtcgccatagtgaagtatatgtgtatatttttgctgggttttgtttccagccaactatattatcaggtgttggattttttaaacttacttcacaataagaaaaacaaagctagagagattgtgactggccaaggccagaatgtttggcattcgtagtttctctttagttctctctgtaggaccatttcctggagttacagaagaattgaccagtgtgtcagtgtctttcatgtacattaatgggcgatagtattggtagtggttaatataatagcatgggttctggaaccagtctgccaggatttacattcaggctcaacaatgccttagctacatgcctcagttatcttacctataaaatggggattccaggtcttaccttataaggcagctctgagaattgtttagttaatattgaggcagttataactaagtgttcagtaaacttagctattgcattttaaaatttgtgttgattttatggaaataaatgatgatgtgtgatacctggtagattgttcggcagacatttcaaatgtaaaaaaataactctgtctgcattgaaatctttctagattgatagttttaaataatgaaaaaaatacttctgggaatgatctacatttggaagaaatcaggaaagagaagactgtgtgtacttttgcatttctatgttttgggcttgtaagatatgtgattgtatatttcatgtcagtaataatttattttggggagtagaagcaaatgtcagttacatacatcatctatggaatagatttttagttttatttattttaactggatgaaatggttgagtgttgccttacttggttgaatttagacatttgagaaaatttttttttaacttttgtgacacacaaggacctttgaatgaaatcagtccccttttcttcctttaaaaaaacttataagaattaccatttcttgactaaacagttgttttcttttaacattatatacttgtctctacatagatactacattttttagttagatgtgttttggaagagcattgactttttttcctgttacattggaaaaatttaatggcacgtgtatgttattcttatcatgaagtgggtttaggcatgctgccttatactaaatagaaatcctatagtagttgtttttcagaagtaatccattgattcaagtcattcattgattcatttatgaatacttaagtatggttacataggtagggattgtcagaattggcttttgagcattttgtttagcagttataatccaggtggcaaatatactgtctgattcaattacttgcatgaaatcactttaaacagctacttaagatgagttgtccctaggcctgtctttatctacttattgtgcatgtgtgctagcatacacgcattatcattgttgttttttattgtgttaaaaaaatattacaaagtgtaccatcttaaccattttaaagtgtagatacttcagtagtgttaagtatagtcatttcattgtgaaacagagctccagaaatttttcatcttgtgaatatgaaactctataccccttaaacaacaactcccctcccttgttccctccagcccctggtaagcaccattctcatttctctttctatgaatctgagtattttattttattttttattttttgagacgggctctctgtgttgctcaggctggagtgcagtggtatggtttcggctcactgcagcatccatcccccaggttcaagtgattctcctgcctcaccctcctgagtagctgggattacgggctcgcgccaccatacccagctaatttttgtatttttagtagagacagggtttcaccatattggccaggctggccttgaactcctgacctcaagtaatccgccagcctcagcctcccaaagtgctgggattacaggcatgaaccaccacacccagctgaatttgagtattttagatacctcatctaaatggaattacatagtatttgtctttttgtgactgacttatttcacttagcacaatgtcttcaaagttcatgtaccatatgacagaattttctttcttaagactgaatactgttccattgaatgtatataccacatttgtttatctccttatcctgtgatggacatttgagttgttttcacctcttggctattgtgaattagtgcttctatgaacacgagtgtgcaaatttctcttcaagatcctgctatcacttcttctgcatatgtacctggaagtgtgggattgctggatcatatggcagttttatttttaatttttgaggaacctctgtactgctttctataggagtcataccattttgcagtgtcaccaacagtgcacatgttccccagtcttttaaacagccccttccagactgacagagtggctacatacagaacagggcagctttgaagattagggtggcctgttccaagcttcttcagactcctcgggactggctaattatttttgttaaggtcatactgctggaccagggcctataggttggcactgacttacgcatagaatgttggcctgggtgttgatagacttaggctgcaattgctatgagtgatcttaggcaagttacctccactctgttccctgccattgtcatctgtagatgaggtggttatgcttctctctatttcttaatttgttccaaaatcttattgtttgttgtagaatccaggcatctaaaaaatatactgtgtgtagcttcgtgtaattatttgatagactggatttctttttgcaccagatagttcggtttttttgttaaatgtctcctttttcttttcttactctttaactgccccaaatactaagtgacgaggatggagaccttggcaattgagtgctatcagtgagtctgaatgcctgggttcaaatcctccatttactagatgtgtgaccttggagaatgtaacaaactgttgtttcacagtttctccatctgtgaaatggaaataataatacgtttgtgagacttaggtgagttaatgcctgtaaagtgctttgcatgtgtctagcccatagtaagcactcattaaactcttaattatcatataatatgctaattatgatggtggtaaatgagtgaggtcatcttccattttggtcatactccacatttgggtagctttagactttctgaagatactatttcctgtaatgtttctttgtaggtggggaggatatacctattacacagttagaaaaactgaacagtagagattatgctttatatggctgggattaaaacttcagtgtcgtgtttagagcctagtacttcctggcctggcatgttgtcctacacttaatgactgtggggcctgagtgggttctaatgttagaatctggtaagaactcttcctgacctctttgcccatttataaacagccttccagggtgacctgagtaagatcattttctagctgtgtaatcctggtggtatgaaaacactggatgtctatagttttttagaactgtgacttagtactaatactagcctcttcaatactcatactcttaaggcttaatatttgtctctttattgatttacatatttgaaacctagacagtcttttcaaaggtgagtagatattttatatgtctgccttctggtcggtagcagcagttgtgcagttactcagctgttggcagttctgttacttaatacagaggcagagagcgaaagacttattcagaaacaaaacctctgcttgaaaagttctcaaggccagccatggtggttcggcctgcagtcccaagctggtgtggcctgcagtcccagcactttgggaggctgaggtgggaggatcacttgatcccaagagtttgaggctgtagtgagccattgatatggctccgttgtctggagaaacacccagggtctctggtctcgtgctgagaaaatcagcaacatagatacacatggagtggtttaaggagcggaaagtttaataggcaagaaagaagaaaacagctccaccgtacagagggaagagggctcagaacggaaaacccccattgctggggggaatgccgtaggttatattgggaggctggatgaggcggtatctgatttgtatagggcccaggggattggtttgaccaggcttgtcattcacatagcccatgaaaaactggccctcctatcctagtcttttaatatgcaaacgcagctacctggctggttgccatgatgtcctgcccacatagtctctacctggctggtcgccatgatgtcctgcacacgtggcaacaaaaagtggcaggaaccgccatactgggtggacctggcttttagttgcctgcatttgcatatcaatgcttgcaggtctggtttttcagtctgctttctgttagaaaagaaatgttttgggggctgctttttcagtaaaagaaaaagcctcaccgaggactcttttaccctctctatctgcttaaaataattcttaataactcctgtaataccatgattgtgccactgcactccagcctgtgtgacagagcaaaaactatgaccctgtgtctaaaaaacccccaaaaacccaaaaccaaaaaacgagactgggcgcaatggctcacacctgtaatcccagcactttgggaggctgaggcgggtggatcacttgaggccaggagttcaagatcagcctggcctgttacatagtgaaaccctgtctctactaaaaaaaaaaccaaaaaacaaaaattggtctggcatggtagtacacgcctataatcccagccacttgggaggctgaggtaggagaatcacttgaacctgggaggtggaggttgcagtgagccgagattgtgccactgcacttcagcctgggcagtagagttaatgagactccgtgtcaaaaaacaaaaaacaaaacaaatgttctcaagtcatgttcaagagataatggcggacataatggaacctccctaaatctgattttctccagctataaaatgaagggcccagatcaggggatgcttaagggctttgcaagttctaagactcagccatcttgagattggaaacagccctgtaggttcttagggcatgatgaagacctttgaggagaagtattttaacagctttgtgtcttggggaggaagagtcatggggaggtgattaggtgggcattaaaggagcaactggagaaaggagagactaggaggctgttttgataatccacatgtgaggtagactgccccttcctgagtgcctgaggggcacttgcaccttgggacagggtcaaggttttctctgagatagcagctcccacaggcctaggagccttctttcatgagcttgctgccctggttcatgagggagggattgatggatctctgccccgttctgtttttttgctagcactgtcttcacaccctgttgccgtttatgttttttgatgaatgattaattagaaaaataatcatttgtaaattgtgagtgaaccagacatttggccctgactgtagggaaatggcgcctctgagccgggtgtagcttgcagccagtacatcagagctccagtattcccagaccagtgatgaatttacatgaagttccttttcagcatgttaatgactgttacagctgagtaactagcgaaaaataatagcaaatgggaagagtaaatatttaatgcttttatatcttttagcttactgtggaatatgtattttgatttaggaaggacatgagagtcttagagacattagagacaatgttagtgtgtctgagcctcattccttgtttccttttctttctttgcacttaattaaattaaaaggataaagtgagttgttgtgagatggattttactaggggagtggtttttctgtaagttttaggtcacaagatgcgtctttcctggcagttaaaatctgtatgttcagactacctcattgattacgtgcctggtgtgtacagggactcatattgtttctaaaattcagctttcatcattttactctcctgcttaaaaactttagtgactccacaccgcttctgggctgaaagatatactcagtagcctggcttttaagggagggcctctgtgctgtgagtccagcctcttttcaggctctctccctaaggcagctccatgtggctacattgctcaagccacagtggttgactccctgttcctgtaacttgctggaggcttcctcacctttgcacctctgctcagatcattttggggcatgaaatgatcttgtctttttctctatctaaagcctgcttttcctccaaggctcagttctagacgtttctgtgactactctgactggataggagcctgttcattttggaatatagagaaaattgaaagtaggtcacagttctctattccttccagtttgccacctctctaccacagacaattaataatgaaccctacttttccccacttcctgtttggccaccatctagtcttagacaaactaagctatttgtccaggtaaacaagtagttgtggactacagaaatttctgaagattagaattgaagttagtagggaaacaggcctcaaggatagtgccatattttctgagagcagatgattttcagacaaaaggttttaccaacagcattcatataaagtactgctttagtctgagtttgcaatggtagaagtagagtatctaaagaaaggatccatgccctttttttttttttttttaaatagagacaatgtctcactatgttgctcaggctggtctggaattcctgagctcaagtgatcctcctaaagtgctagaattacaggcatgagccaccacacatggccaatccatgcctttttactctgttgtagagactgtcttggagtgttgagttcagacccagataaaacaataatctttagaggaaatgaccaagatgaccagaggtaggtctgaaaacatgaaggccgtgtgggtaagagagaacaagggagtccatgccttctgttttcaaatatttaggaggctactgtcaggaaggagggatattagacttcatgtatggaaccatggagtgagaacaaagattgctgggtgtaggttataccaaagataaattttatgccaatataagaaataattttctcatagtgctgtgataaaatgaatttccccaggagatagtttcccaagtaggaagggatatgaacaacaggagctgatatttgaatcgtgaatatacgtggccttatagtaaaaggaccacagatactcgaatgtcagacctttaggaacaagtcattttctactgtaggattttggagggttcataatagaaagtaacacatctccttgtgtctaaaaataggaataaatcctaatatgaaccaaaaaatatattaggtacagttttctgagttgatattgaaatgatgaaaaagaaagagatctgggactgggggttcttaacacactgggtttagggacctcaagaatattgtttaagaatgacgagagatttgcaatttccaaggagtcataagcagtttcaaaaagttgaatgtttttgaggaacttaaaattctgttgttttcaaaatactatagaaaagtaatattacaaaattgtcttgacataagtaatttgggtatgctgtataaaggcttctaagaattaagaaacatggcccgggttgcaaattttaatgcatgactacctttttttctatagaatatagcttttgtcagattctcagcagtggctctgatccagaaaacattaagaaccactggtcatgagtggtgattttcagcttttttggtcttaacccacttaggtgggacagaagctccttatctcacctataccatccagcatcaagataagcacacgttaatatgaaccatatacatattttgttttataaaagtatcccataagctttaaaaatgtaattttgtcatacttaccttggtatagtagattgtaagttatttagagactataaagtcacagatgaatgtttacaagtactctttttggagttgggcttattctatctatgtcttctttagcagtggggatttggattattcttaaccataacacatacaagtctcattattggaaaattacaggacagaaacaaatgctgtaaatatgcaccactgcgcatcatgagattaaacagacaattttcaaaaagtcaaatttctaatgataaaattaaagtaagtaatttatatttaaaaagcaggaatagcagcaatgcaaactgtgattgacttaagaccacagtgaggttacagtgataataaatcattcttctggagaattgtgagaattttctaactgttggtgtgtgtaagtgcaaggtaggcactttgcataattgtatagtagctgacattcttgatatgccagtttcaagtcctttatatactttgctaacttgctgatattaatttattaatacaggtttttaggactcccctctcttatctaaggtaactagcttattaaagctcatattaaagaaaacaagtatctgtggaaatgttcttgtgggtaccagtgattctagagccttacgttaagaaacactagtctaatggatcaatgtataggtaaatgatattagacattttgagtaggattaagatccaggagactatctgaataatgacctttctctctctttctttttaaaatatggtcatcctaacgcgtatgataacccagatactctttctttttaaatacccttttatttaccaaccctcttaaacctggccctgaagttaagatcaacagctatgtgtgaataatttttttccttctcctttgctttgcttttcctatcaaattgaaataccctgccactttcttccctctctgaaaacacaaaagaggattaagccatataatggactatttatgtgtcaaattaaacgttttactctgaggctgtttctgagttatgcgagcagtaaaaatatgtattaagctgccaagccttttaaaaaatgcatgttatttagctgatagcctgtaacagtctgatggacccataatggtgttttgagtaaatacgcatttgaacaatttatgaaacttatgtttacatgtgtattaaacagcctgggtagggagtgaccaaaagttattaccagttgacagctgttgtctggtgaccaatttgaaatgaattggtggattcccttcagtgcggagtaaacaggtttcccagtcaggggagcatgctgaataattatcagtgtgtggggcctcagccctggaggcctgtgtgttggttgaatgaggtgctggaataaaatgtctcaactctacagtgaagttgcaccttagattcacatttatgatctagtttattttgtacttggaaatttataattatgttcacagagtacaggctgtgcataacaatatattctgcccttgggaagagggttcatgtttgtttatttcctttttttcttttttaactgacatataatcgtacatatttatggggtacatagtgatgttcaatacatacaatgtatagtgatcagatcagggtaattagcattccatcatctcaaacatttatcatttctttttgttgggtgcatttagtattttccttctagctatttgacaatacgtaatatattattgttaactatagtcatcttccagtgctatagaacactataatagaacttactcctatttagctgtagttttgtatcctttaacagagctctccctatcttccccacacccccttgtttatttctttgacattatccatctagggaaatgatcttgaaatttttatgatgtgtccatatcaacaatacatattttatatttgttcacttcaaaattatatgcatatttacatgtgtaaattttattccaaaattaggagtttaaaggattgagataaaaattaattacatatagataatttgattttctttttgtacctgaatgaatcctctttggcactgtctgggatgtgcagattttgccttggagattaaggcgagtgtcttgaaacctttgtgtaatgaaaagggcattgtggattatagtcattcataaacctgggcaaatcattcagctaccttgaggtctagtttcctcatttgtagaatatggatccctgcctggggggtttcataaagactactgatagtaaatgtcaggtgtctaccttgaccacaaaatcacttcctcagagaggctttccctgacctcttttctccatgatagctcctcttttcttcctgatcactctctaactccttaccttttaattaattaattaattaatttttttttttttttttttttttttgagacggagtctctctctgtcgcctaggctggagtgcagtggcgcgatcttggcttaatgcaacttccacctcctgggttcaagcgattcttctgcctcagctttccgagtagctgggactacaggtgcgtgccaccatgcccagctaatttttgtagagacagggtttcaccgtattggccaggctggtcttgaactcctgacctcgtgatctgcctgccttggcctcctgaagtgctgggattacaggcgtgagccaccgcacccggccttttatttatttatttatttatttatttatttatttatttatttatttatttatttgagacagagtctctctctgtcggccaggctggagtgtagtggcatgatcttgactcactgcaacctctatctcccaggctcaagtaattctcctgcctcagcctcccgagtagctaggattacaggcatgtgccaccatgcccggcttaattttgtatttttttttttttttcagtagagatggggtttcaccatgtcggtcggccaggctggtcttgaactcctgacctcaggtaatctgcctgccttggcctcccaaagtgctgggattataggcgtgagccactgcgcccggccaactccttacttctatttaaaacaactttttaccatctgaatgaatattatttaagtttctactggattgtaagctttgtaaggggagatatttttaaaattttacttttttggtctgttactgctgtatccataactcctagaatagcatgtgcatggcacatagtaggtactcagtaaatattagtcatgatttgaatatttcataacttagtagttgactaataaatagaggctgttactgttttcatggagtatcctacatataatatagttggtgttctaggatagaagacataattctctatgtatgaattgctctcactgtcacaggatccttagggtgtcacttttccagctggaaacctctgtggcctatggtgcctttgcccaagttttgctccggcctgctgggcttgttccacccactcagctgggcaggctgtgctcaggttttgctgccggcctgaatcccatgcctgccaagtgtgagcaggcgcagagcggcaaggggtgtgtgagcaagtgcagggtccggccactggcacagccaggcatgctggctgtggggtgggcagctccatatgaggctgtggctggaccaggtgtactgcaagcagcttccactgtgggcactggggaatgcggtggcacctggaagcttggagactccaggaaccacagaaccccaaacagggtgtcacagtcctggcttgtagagccactaggtttgggcttcctgaagggctgcaactcttctctctttctcgtcacctgcaatgtggctattgggggttgtgttacacccctttcagtcccgcaattcagcgggtgctgagttttgtcctgcatccaggaagaatgagatacgtggacaaccagagggtgagcaaggcggagaggggcttcatttaagtgacagaagagctcttaggagatcagaagtgggtagctcccttccacagcaggtcatcctgacgagtttccagctgtcagcagagaggagacccatagtgggtaagtgctttccatagtcaggttgtcctgacaagttgaggagacccaaagtgggtatctccttcctgcagctggtagtcctgacatctgcctgagtctacctgagtccgagggtttttatgggctcggaagggaggaagtatgtgctgattggtccatgggtggccatgagtgggcctggagaaagcaccgtaagttcttattccaagccacggactccagctggaactggcagcctggcccctaggcttcaggccatccctggcttgaagttggggtttcacaggggacctacccctttccgcccaggaacctgtctgcctcccaccgtcaacaagctgtccattgtgtctaggctgtttgtgcagagaggggtgtctgcagacccatgccaagctaccctcagcacccacccccatcctccacttccctcctgcacctgtttgcagccaaagtccagagggggccgaggtggcagagggctggtgtgtcaacatcacctgagctactgtacacctgactgggtcgcggcagtgcccagtctcagccacaactttgctctgcaccagagcaggtgccgggagtggggagaggccagggagtgggagcatgtacttccaagcctatgggagttgggcccccgagaacacagggatgcctgggtccagagccacagctgggcagctgcagctgtgcccaggagtgcagggctcccaccctgctaactcggtatggggtggggctcctgtcttttcctggctgtgcctcccctgctgcagcatgggccgctgctgccatcatcagtgggacccaaggcaggaagtgttttttcctgtagggaggatagatttttttttgtctcttacaggtagcatctggcaggcatgtagaagttagacatgaagcctccacccatggatctgagccaagtagactgacctgtgtaagcttcagatgcctcagtcttggtctccttagctccctgtttttgtcaactgtgccatccagctgagcaccttagagcttgaagctgagagcttcagcggggccagtgcctacaagggctgtgtgtatatgctttagaggtgggagaattgtgctgccagtgggcgtttggcccactaaggagaacacctgtgacctctgcaatcttccctacccctggcattccaagtgccattccaagtctgtagagataatagaacaaacgtaattttttgtgtggttggcaacgaagactggaggagaataaccacacctttggaagacttcggtggtcctttgaaatgaggagtttttatagaaacacttatcattttaaagacctaccatttttaaggtcactcttctgctagggctgtgaaatacagacatatgaaatgttttccagtgttgctctggtacttacgtgtgtgatgattttattggagaaatggatgaatatgaggttggagagtctttacatgtatgaactatcaaatatacagttcagtagcctgaaaacattaacaaatagcttttatttattgtatccttatgtctttcaatttggttcttatctgttgtctcttcagttgatgcaaatttgtgctcaacttttcctgaggggaaatggagagatactttcttggattagcttatgatcttgaacttgactattttaaagagtcatggtatataccaatctggattgtgtttaggatggggcttgggggatggtttctttgttctcttttggcccacgtcttctaacaacccatttgtttagggggttttatgctgcttagagtgagctgagaatgtgctcaagcacataattttagcctgtttttcaggtttacatgaaaaatgtaacaggcttctgaaacccctctaggttccagctttcaagaggctggtcaggaatgcactgaccgagagacttccctcaaaattaatttataaacacgctagaactttcctcaccttaattttgagaaaaagatctctctcatggcattttcaagtgttatggtagatggaaataatgaggaaactgtggcaccttgaacagagtgagaggtttagagttgtatagaccttagtacaaattttgactctgtcattaattacctgttctgtcatgagtgagttacttaacattccctgagcctcagtttcagcatctgtacagtgaggattctatttatttcatactgttgtggagacttgagcaacagagtgtgaaaacatctgtcagcgcctggtgtattttggacattctgtaaatcttagcagcccatttccccattctgggggtaaagccacaggacttttttggcaaatagttgagatacttggtgccaaaaggaaatttaactcatgccatgacaagtttttttgtataaggatgggattctggaaacatgataattttttctcttggccatatggattagcaaaggctttagaaaactacaaaaaagactaatttgttgcctctggatgtgtgtgttattttgggctgttaatatacttgactgcttgtttcaaggactggaaccttttcttttacctttaagattcctgcattttcatgtgctcattcagctgggatttgtgtttcatagaactggtagtattggaggtagaggagatactgtgatatcatatctctctctctgtctgtctctctctctctctcccactgaagaagagaagacaaaatttagagaatttgagacttgctcaaagttgtgtagctagttagcgataaagctggaattgcaccagatttgatttccatgacattgctttagcctggtggttctcaaagcatggttattggaccagcagcatcccttgggaatttgttagatatgcaaattcatgagatccccattcccttatcagaaattttaatacgctgtgtagggtgattctaatgcctgctaaaacttgggaaccactactgtggtctttacactattgggcagggagatgggagactacaggtagatttgctgaatttcatgggcaacactaggttttcattttaccttattgttctgccatttagatgtctcctcttaaaacatttttacttgcagtgatggcttccttagactcgtgtgtgattgttgctggggcagttaggtggaactaataggtgttgcttgttgattccctgctaccaagtactagttttgaaatttgagtattcattaaaaacaaatagggatttctgtgtctcactcctggaaattctgactcagtgggggtaaggattaggaatgtttaatttttgaaagccctgcaggtaattttttttctactttttaaaaattataatttttattttctttactgttcttttaagacatcctgttatagcatctgcaggtgattttgatgcccagccatgtttggggaaaaaagtttgggttctgagtgaaaatagaaaacgtaatgacatggaaaggaagtcaggggataagaaaagctctatggccagccatggtggctcacacctgtaatcccagcactttgggaggctgagatgggcagatggcttgggctcacgagtttgagaccagcctaggcaacatggcaaaaccatgttcctattcaggaacaaagaatagatcacaaattaaactctgtgggttttcataagtggaaagttggctttcgttgttctgtatttgggtgcttagtggacaggagttatctaaaagaagtaattatagttgtaatgcggaccctcaaagttgaaagtagattgaaatccattattttacaaggtggccttactatttatagtttgactgtaggtatggcagtgagagataaaattactttttctagctttgcaaaacgccaaacgtctttgaaattaagagtaaaaggggtttaaaatatgtactgctttataaagcaggaaaaccccactggaacattttgggtgtttacagaaatgggtattccatgggagagaacgtggtaacctatgttttgtcatcatttgtttaatcactgaaaatatattaacaggccaggcatggtagctcatgcctgtaatcccagcgctttggcaggctgaggtgggaggattgcttgagcccaggagtttgagatcagcttgggaaacacagtgagactccatttctacaaaaaaagaaaaaagaaaaaaaagtcacatgtggtggcacacccctgtggtcccagctactttggaggctaaggtgggaggatagctcgagccccagagatcaaggccgccgtgaactgtgatcgcaccactgcactccaggctgagcaacagatcaagactcttgtataaaaaagaaaaaaaatttttttaaaaatataaatatagattaacaaagtaacagggaatataatattttcaggttggtcatatagaggaaatactatattgtgttattcagcttaataaaatataaaacaaaaaaattattaactgtttgaaaaattgtagtcagatatttgattaggggtaggtcctgatttggatgaatttgaatcacattcgactaaatattgtgctttttaatactcactttaaaaacaaaattaattgggcaaatgttcatatccattttaaaaaactatcctcttaaaactagattgatagtagacattaataggcttgatgttgtttataatattttgctatattttaagagcatgcttttgtatattttctgttttagtgaagcattttaaaaatgcccccctcccacaactgcaggaataaatctaacagattttgaccaaaattactctaattttgaatttcttgaaactgggtatggaaactagacattaaaaaaaatctttatttttaagcacggtttcttggtcagtagcttctgtattacgggagaacacaagaaggggccttcttgacactcaagaaatgctctttttccatctacaaataggaagacaccctttgtggtatttttgttttgtgggccctgaatgaaaacgtattatgatcagttttaaaaattgctgcccctttaatatctgaatatattcgtggctagtgaagcacatgcatctgtcagatcatgggtgagaattcacttttctttttgcgatttctccagccacaaggacaaatttagttttgcagagcagtttgacacctctagaagcctgcggttagcctcggtgcacctctagcagctgcataggctcaagaggacctctgttcttccctttttggtttggttaccttacccctcctcagggaaaggccaagagactcagcacttcctccccaagtgagtttccttagtaacgtcagccttctctaatgctggccaagggtgtctttgctgggctgttttccctccaaaatagactcactggggtatagaattttttttttacgtgaagggtatagaattattttcagaatagcagcagggtaattaggctcattgttgacatgtcattgaagtctccatgtgacaaaattgctcctccctctttgagcactctgaatactcttaccctcttatctcgatctgctctttagaaataccagcagataatctgggagaaggccaccatagccatgcacagagtggggagaatgaggagatctttgctgaatgtcttttagttgtttgagttggagataaatgcagaatgacctccattttgccctaagaacctgaccttcttgtcactttgtgtaacattaattttctaatgtgttctggtcaatttgtaaaaagattttttttctagtgtctcagctgttggtttgacttttgtattttcattggtaaaatatgtatgtctttgctgtgagcagagagaaacagattaataaaaaccactgaaccagcattgcatatgtaattaattaacaccaccaggaaagctggttcatggttgtgtgtaaacttatttccaaacatctaaaaaacgtttagagttatcttattcagttgtctcacttctaagggataggttaggaagctgtaacgtatgtgtatgcacagaaactgttggacaatgattctcaaactttacttttcattaaaatcgtctggagggcttattaaaatgtagattgctagacctcatccatagtttctgattcagtatgcctgggtggggccttaaaatttgcatttctcatgtggccccaggcattgctgatgctactagtccaaggaccttactctgagaatcagttttaggatgtagatcttatgttcctctttgccaagggcaaatgaactgaattgtataggcttccttttcttttacaagaagcattgcctcttctaagtagacatccaccaaatatttatgtactgtatccatggtgccatgcactgagctaggtgcactggggataaataaaatgatctctgccttggggaactcacagttgagagaggattaaattaagaaacccaccaatcgtgattcaatatgagaagtgctgtggtgatgtcaggggtaggctttctagatttgctatgaggtgcagtctgagctttttctcagactgtcttagctttatacctacagaaataagtgaaagaaaatgaatcttctgcagcttaggattttgttagtgctcagatcagtttcctctcgtccttgactttgggcatcccaagctctgtattcagacactcctgaactggcattgtgagctctccaccccagcttttgtggaagagtccttcctccatttttaaattacaatttcagacactgtccactgtggcagcaggatttgtaacaagaccaagttaagtgatcttggctgaactgatttatgagacagcttcaaaaattcatgaggtaccatgggaactttctgtagtggatcagcatgccgcttttccttcacttcttcaagtagatcagacattttgtgataacacggcagtttatagtggagccttctagattatggctctgctgattaagacactaagacagacctgaagacaaagagaagggagaacaggatgttacttttagaaactcctgttatcctaagcttgagcagggactttgggtaaaatacatctatgtataactcaatttatacatagaactctctagggcaagtttttctccagtggtgatctgatatggagtgtcttggccattaataatggtcccataattttaagcacaataaaatgttaggtgtgtatatgcgaaaaattgagtgacatagtagttgtctctcctctctttgtgaaaaccggtagacaggaacgaaggatgtggccaaaaccagtgacaggttatggtgctttccctattttattgattgctcatttctagtctctaaccttatttgctacttattgatctagtagaaaagcaaataattttccctagatagtattttgttgagctgggctttgatgacttgtctaccaaagggtttttaaaaagtacttacctgctgagtggcagcctgtctaccatttaatgttattatctgtgagcctgggggttccttcttagtaggatcactgatgtcataggctgcctctttattctgcctactttcctgcaagataccacacatgcccgtggtctgctttaatggcctcacagtgcacacagccttagacttaacacaagaaacatatgagtgatcccattggagataatgtgttgccgagtcaatttgggtcagcatctgccaacatgtcaaattttcacactaggttgtattttgagatttttattcatgcttttgggttcaaatttactcacaaataagttttgaacttttaagtgctaaaactgctgagttcttgactatctgcacttggggaggggaaggttaaagataaggggtgggtatgtatgggaaggaaacagtagcacagatcatctaacataggaggtaagatagatttcccaatgtcatatataactttgactatatattttttcctatgtttacattctcctgtttatgattatactcttttggttcatattaaattggtgtttatctcctaggaatatatatggcgaggtgtgtcataggaagcaatagaaaaagaatttggagactggtcacttataattcttgaataatataactatgtagagttaaaagcaaagattgatcctgtcattcatgggattgatgggcatttttgctggtatcttattattgttcatttctgagtaggtaatatattaatatgatcccaaaagcaaaattgtattaagaagtatatagaggaatgtctcactctcatccctggacctatgtgccccattcttcaggcttttataactactttattagtctctattacatcttttgtaatttcttaaatagtgtgtgtactctcctatttgtgtatgctctcgctttttctgccctttgttataccatatttagcatactataagcactgttctgcatcttgctgttttgtagttaccaatatatcttggagatcattccatctcactacagagagagcttccgtattcctttttatagctgcttaatatttcattgtatagctgtaccataatttacttaacctgtctgacactttggttatttacaatcttttgctcttacaagtgatgctgcagtgataatgttttttttttttttttttttttcccgagacagaatctcactcttgcccaggctggggtgcagtggcacaatctcggctcactgcaacctctgcctctcaggttcaagcaattcttctgcctcagcctcctgaatagctggaattacaggtgcccgccgccacacctggctaatttttgtatatttagtaaagacggggtttcgccatgttgtccaggcttgtctcagactcctgacctcaagtgatctgcccgcctcggcctcccaaagtgctgggattacaggcatacagtgaataatcttgatcatatggcatttcatcctgggtgtgtgttcagttgtaggataaattcccagaagtgaaattgttacagtgaatgtgcatttgtaattttgatagtcactgctaaatccctctgtagaggtcgtactaatttatattcccatctgtttaagagtagagatttccccgcagtcttgtcaacagggtggtggtgttaaacttttgaatttttgccaatctgataggagaaaattggtatctcaaagtggtttcaatttgcatttcttattatgagtaatgttgagcattatttactatgtccaagatctgatagtatttccttttgtgtcatcaacagtctggttatatttctttcctgttttttctatttgattattgctatttttttttaatttttaaaataagctattttggaatacttatagacttaccaaaaagttgcaaagattacggggattttttttttcttttcttatgccctcattagctcgttaattgggttagatggtttgaggaaggacaggtctcctggaattctgtggcttgtcataggtttgtcagcccaaataaggatgcacatccaattcacgactcctggctgcctctggggattttccatatggagtgacagacttgggaaattctgctgagcttctgactagcctccattatgaggcatataattcagagcccatcttccattattcttcttttactagtatcaattattaactagaaaggttattgaagtgaaaaccttgcctcaagtttgtatttcttgagatttacttccaataataaatgtggttttcaagtgactgaatctttcatagaccaagtttcgagcacattaaatatttggtggttttgcgtcctctctgcctcacatgctaattgagaggatgagtagctataatttttctggagcttcaggctgtcattctgtcctgttaattggttcttggagtaaggagctaaaatgtggaggcagaaatgctttcccagatagaaacatgccttgaagctttgtgtcctgtaagggtccacatagcctggaagttaagaatactggctctggaataaaaccttgtggattcagattcctgctttgccactgctagatgtatcacctcggacaagttacctaacctctttgtacctcactctctccctgtttataaaatagggattagaacagtacctgcctcatctagtagttgtgaagattaaatgtgatgagacatgtaaagtgcttggtacaggcctagaacattgtaagtgctcaataaatactggccgaaaagtcgtacagggcagtggtttcagaggccatgcaataaaatagtgggttatgttgcatttgacttttgttgattaacctttcttcttcctctattctttaccttgtgaggcacttaacctactaactgaaatgccattcattcagccagtatttgagtgctcagcaagtgccagactctaaacaagatgatgtgtaagatgctgcaaggagccctcgtgccttgcagcctgagcacaagtgcctataaacgcaaggctggttgtcgtcattgccatccccagtatactttgagaatacaaaagaatgtgaggtcactctcctttgactggggtgacgaggacatgcattgtgaaagggggaactgttagaactgggagccattcgtaagtgaaataaggataagagggatattatcagcattgatgctaattagcatttctgtagcattttgcagtttgggaaacattttatgtattttattttatctcagtctcataaaagagcttgaggtattattatctccagtttacgactgaagagatggggagtcaaataggttatctgattctcccaatgccatacagctccttggtggtggagttggggtttgagtccaggtctcctgactctgaatctccacgtgcttccctctggtctcttgagtgaaataacccgtactagcaagaaagagaagagtatgtcggcaaaagagaaacctggaatagttgccaattgtccctaggttcagatcacatacttctagggcatcagagctagaaggaacatgagatcagtgcatcctctttatttgactaatgaaaacattgatgtgcttgtgagggacttcgagaggtcaatgtggtgctggaagcagctcaatggagagggtagacagttccccttggatgctcatgtgtggtcttctggggattgattagttgctggtaaggaaggagctcattttggggaaagtaggtacatagattcatagagggaaaacctttattcagaagcaggcagtttttctgcaatatcttcctgggaaacacaaataaaagggctgtagtttagtattcagatgtggttctggttgtgcaaggataaggagaaaaggcagaggcagggtgagaaggaaggaaaatgaatgactgatttgaaaggtcagtgagaagtctgtgaaaggtacatacttagggtctgtagggcagtcatttgaaatccaggatacttagtatatatataggaggacttcgtagtagttctctgactggaagaggactgggctgccttgtgtgtgtgagctttcatcatgggggcagtggttactacatgctatttctaagaattgcacttgtggggtgatttctactttgggtaggaggttattctaggtagagctagtgtggatcagcaacatcagcaccacctgggatcttgttagaaatgcagatttggggactcctaccctagacttactgaatcagaatctccagtgggtgcagttcaagaatgtgtattttaacaagatctccaagtcattggtctgcatgttcaatgtttggaagcattgctctagtgcagaggctctccaagatcctcctttgggttctcggcttatgtgattaatgtgccattcaccaaacatttattgaatttcacttatgtaggcacagcacaaagccaactctcacatggatcctgcttgcattctagttgaggagacaggattgtttacaagtaactattaggttggtgcaaaataattgaagtttttgccattactttcaatggcaatttcagtggcaaaaaccatggttacttttgtaccaacagtataaaaacagtgttaaaggctagtacaggaggcacagagaatgcctgtgaaagtggagggtggacgttttcataggtgtgtgcgggagcaggtggcatgcatggtagggggaatcattacttctgtgcaggactcctgagtaattttaatctgtggtttgctgctgtgcaaacccagaggcctgtctacaacttgtttaacctcccccagcccttgactgggtttactttattggcctgataagtagtataaaaattggcagagctattaagatgactcatggaaggatatcctcagcatctccttttggatctcctcacacctgcactgcttcttcttaaatgcctgaatatccaccactttgtaaaagaaaaaaattgatttgtcactgaatttccatgcctcagcctgagagaaatgtaaatgttgtactggcctttagtactctgccttcaagcctagatttagagctgatcattatacttttagagtaggctaggtatgaaaatagcagcaggttgaagagtcagaggaagctgtttgctctcatctgctggtttggtcagggtggaagtacgaatattaatacagtccacttaaacaataaaatagctcccagggaagaggaactataaacttcagtaaatatcagagatgttaaatgctaaaaataaaagctctctgcagttgtttggctctttaaagagattgtttattggtcaagagtgctagtctgtttggtcatgttttgctagctttttaaaatgcatgtatgtaaatgaattagaatataagttaattaagcagggcagtgtttctagaatgtgaaaatagtaacctggctagttaatttaattaagtccttggtaattttcttttagaaacaagtttcatcttgggaggtcacaacgtcctggctgctgtgcttctgagctttaccttgactccatcctctcctctctgtcatccttttctctggctctgtcacttgcatttgccccctgacttgtcaccctgacttcatttcctctctcccagctgtttacagtgctatcacagtggtctttcagaaatcccaaactctgctgttgaactgggttctaaaaaccttcagagacttcatgttgtccataggatacactgttttctgaactccttagtgtgccatattaggctctctacagtctggctctaaaatacaattttttttttttttgagacggagtctcactctgtcgcccaggctggagtgcggtggtgcgatctctgctcactgcaagctccgcctcccaagttcacaccattctcctgcctcagcctcccgagtagctgggattacaggcgcctgccaccacgcccggctaatttttttgtatttttagtagagacgggatttcatcgtgctaaccaggatggtcttgatcttctgacctcgtgatctgcccatctcggcctcccaaagtacaggcatgagccacggcacccggcctctaaaataccattatagcctaattttcaggcttactttttcttgtggtccaggccacaggactatctgctattctcaatacaaataaaatataaccagtagccaccctgcagtagtagggacaattcaggtgcctcgacaagcattgtctgattacactattcaatacaggatcaaagagttttgtcatttgcccaaggtcatgtaccttgtgttagagctgagattcatattcagtattttgatattctgactcagtttcctgctttcatgtctctgtgctttccttgtatgttttctttctttttttctttttgaggcagggtcttgttctgtcacccaggctagagtgcagtggcacaatcacaactcactgcagcctcaacctcccaggctcaagtgatcctctcacctcagcctccccagtagctgggactacaggtgcacaccaccatgcccggctaatttttgtactttttgtagagacggggtttcaccgtgttgcccatgctagtctcaaactcgtcagctcaagctctctgcctgcctcggcctcccacagtgttgggattacaggcgtgagccattgtgcctggcctccttatgtcttctatgcctagactgtctcctaccctttttctttgcagacttggaaatgtataggtgttaggtattcctaacaatgtgcgtgcataggtcatcgggcctatctcaatttagcctgatagtgtaaatactagtactactactacctagtgctagtactaagagctgatcccagatcttaatttttcttcatttctcctccaaataataggcggtttataagtattatggaatgaatgcatggatggatgaaaggatgactggatagatggatggtcagtcccagtggttgggtccgtttgtgatttgaccaagttcaaggctgtagaattgctatgtggaaagaatgcatattatttcagctatatcaaatagcacctagggacggcctgactgacagggaacaaattgtcagccctcatttggatccaagtggaaattaatctgaagaatttggaatgggcctattcgtgggaaattgcttatttttataagagtttattttctgatttgtggctatattcgttggctagggccactgtaacaaagaccaggtgacttaaacaatagaaatgtattttctctcagctctggaggctagaaggctgagatcaaggtgttgagaggtttggtttcttctgaggccaatctctttgtcttgcagatggctaccttgctgtgtccttacatggtcttccctctaggtgcacatatccgtgttcagatttcctcttcctttaaagacagccgccatactggattagagcccaccataaagacctcattttaattaattacctctttaaagaccttctctccaaatacggtttcattctgaggtactgggggttaggacttcaacctacaaattttgaggatacctcattcacctctacccaacccatcccctctgccttttcctcttgttgtctttcttctggcagttttgtttcactcaagggcagtcaggaagagaagtaaagatagaggaaaaggaaatttattttgggtgcagttcaggaggtgtagctggggttggggatgggcagtggctgaagctattggtggaaatgagattttgatattgcctatagattagtattgtcctggaacattctgtgctggtttcctggacagccgatagctggctgtgtgtgttggagggcccagggaatatctgttctgttagtaagtgagggggaaattgataatcctgcagccggcctggagaagtaaggactctatctttgtctgtcagctcttcctcccagaagtagctcagagacttgctgagcacacctagggtagaggccaggatagttgagttttggacgctctgccttggctaacaccttgcctggcatctagcagatgcttatgaaatgtttgtcaaattgaattacttaatttacttgactcaaatattttgttcttctccaaaccttttatgaggagttttttctccacctttgtttgttaattcccaaacttctctccagttctcagttgtggcttatgtcttttctttcctttctctttgtaattatcaggtaatttattaaatggagacaagcttaactagacattaaataattgcaggtgtgcagctgaactgagccgctgtcctttaactaggaaatcacagctgcttgtgttgtattgtgtgatgagattacacttcacctcatttggttacacgatatcttgcttattgtaaggtaaaagaatgttgaagcttctgctctaagcagtacacaaaggctggtatgttcccaggaaaccaacgtaaaaagtacttggaggtcaggtctggagcctttgcaacctctgatgcttctcttttcttggaatttttcatttcctttgcctttttctgtatagagaacacctgaattactccttaacttgagacctgtttcacattttaaaattttcttttggtcaccttaactgtaaaagcaagatttttctgtttccttctaagagattagcagtgggtccattggttagctctttttttgctttcattatcagacctcatctgcatactttttatacaaatttgccccattggtaagaattgtagcttttatgaatgttaattttagtcataggttaaattgtgatgtcaccagtctgttttctttggctagtttcatagtttgtgactattgctagaggtagacactagttatatagcaagtacctagcttattacagaactcagagtatgctgctaataaaggattgcttgattgcttgaagggtatgcaggtgtaagaaatattcatctttcaattggtgtcaaaatttttatttaaaaaaaaagtcatgctgccacttcccagctttgtaactttgggcatgccactgaaatatcttaatcattagatttatcatctaggtagttgtgagggttaaagaaattcaacaaatatttgaatgaactatcttttgtgcctttctggatgctagggatatatttgtgaacaaagcagaataaattcctatccttgcgggattaacatatatgaatctggttttgactgtcaactggatggagtccaattggtgggagaacatgatacctaccatttatgaaaaactctttaaactgaaatatgtgcctaataacactaactttctttattagggacattttaaccccatttgggctttgcagagtaggtcttagagaaagcccttctccatacttgttcgttcagtcgtgtatcatgtacagccatccattttatggttttggctgttgtaaataaaatggctagagcctgtgcatctggagttgtggtgactcttagtcttgggatgcgtgcctcttcctctcggtcgttgctttataggctgtctctgaggttccagaaggggctcagagaatgagctccaactgacatgtttgagcctttgagtctcttcatgaaagctcagtttgttcaagtaaaatctgaatggctcagagaggacactgtggtgtttagcttaccaagcccagtgtgatatcactggtttgttaatatctacagaaacacacacaggaaaaatattctagagcatcatattgctcacctcctctaaattcttttttcatggatgatcgaaagaaaaacctttttgagtctctctcttcttttttgtgaatgactaatagaaagaagacgacactggtaactttcagaagcattgtgatagcattctgatggtgggattatgatgttcagacatgggagggtattagcaaccaaacatcatttcctttaggggactggaggtagtggtcatctgtgagtctagagctgtcttcgagggaagtgagcagtggctcttccaaggacacagagatgtcaggcacctctctcatgcatgcaagtgctacatattatgtccacagtatctggagtatttaaaccaggaataacacgtagtctttattattggaagaaataaattaggtcagagttagtatgccatcgtgtgatgccagtttgtattctttattttctgtacttgcttctagagagggagtaaatactatgagataatgaagaaagacatgtttttgtgacttttctgatttaggacactttatgttgtggaggttttttgaaggatttggaatttggttgcttattgagaacctcttgagaaaatcagattatctctgatacacaaccagtcctacattgagttttttccatttattgctgtagagacatgaacatttatttttattgaagctgagagaggggtgttacatggttgtttatcagctctgccaaaagtagctcagacatccctgatgactcagctgatgcccttgctgcctgattgggtgcttgtgtactaagtacttgtttccttgttgagggctaggaatatgtcacaaagccccattgctgtggggattgttgcagtgagcagacttagcggaactgcacaaggctggctagaggccaggtttagactaccttggaagaattggcttaagggcagaggagaggtttagaaaactcctttcttcctctttggtggcattaatctttgcgaaaccaggctcagactccttttgcacctttcccaggaatggggtagcatagatcttcttcctatgtgaatcacagaaagggactttgtgtgggtgctgtgtgttcattgtaaaccactggtgctgctatctaggtggagttaaagttgataccagcagagtaagttagcctgagcaggaggatggagttctgcagtacagccggaaattttcacttcatagtgtttctactgtaacttctcaccctgtgttgaaaaaggcacacctggccattcgcatagtttggatacgttttaacccataagagtgctgtccttaaagatgatgaaaagagacattttagctccttggaaataagcacatttctgaaaccacccgtctgagtgcacacttgtgcagataaacaggtacttttgtttatgctctgactcaagtggaaagggcaaaataagagattttccttctcctgagtcttttcactgtgaggattttgtcctttaaataaaataaaccggaactgtaacctttattatgggaggagtgtggaggagttaggaatgaggcaaaatgccctccctgtttctcagataactcttgctaccgtctgagcagtgtttatttaacagatttaatgcattgcctcaatagcatcacacgaaacatgtcaccccccctttttagtttcttcccttcaaaaattttcttaaaaatgccagaaccttaccaagtcacttaaataaatcagtccaagtatgaaatgatctctgaagtgacttaacacaaatgattctgactttactacttgggagactcttttttgatggccagccctctaaattgtaggaagatcattttctagctccctattgtcaaaaaacaaagcaaaatcaaattaaataagtcccttaattcccataagtaattttaaaattatctcttgtatatactttacttgtgtgcagcttgcaactgaatatcattgtgagagctatagtttgtcagggtttagatcttaattagctcatgagattgcatccttttgaagctgtataccacaggttgttggctagttttccaaaagcaattaaaatgcccactgttataattaagcctgttactagttgtatgttctagttataaaatatatttggcaattaaggaaactgagattgaggcttttggcttggctctttgagatgcagtagactggcttccaccttgatctgttaggatgactggtgcggatgcctggatgatgggacatgtcttagtccttgagtacctatctttatgagtaagagcaaccacaggtttttacaagaaagctaaagttagagaatgtgactcgtgtcctcacatatgccgattatgtcctacttggtatacaggagtcaaaacctaaacttctaagttgcagtctcttagctgagaagtcctttttaaagaagcattcccttatctttaagaagatggctcgactctgactgtgaacatttaatctgttaaactaacacctccattgcgctgtttaaatttctgtctggttgttgaaaagaaggtgtgggagaaatgttgcaggtacatgtggttaatgtctgtttctgaactgtatttcatttaggagttgttaagctgtgtgcccaccatctcagagacagatttgtctgaactggcctgtggaggaagatctcattgtcagggctggtctcaatggcagatacagttctcagtggtgtgctttgcgtgtcgtgtcttttattcttcctttcctcctgctcacccttaggaatgtttcctttttgtgccttaacaccagaacggtatggtggctgagaccatgggacaaatgcgtcacttagtgggcagatagaaatcagtatttaaagtatgattgaggtttttgtgtttattttgaaattcatttagtacacagggaagaaaacagcacttggcttatgtggttctatcccattgctttgcctgtttgtgcccccgtgcaattaacatgaaaatgatagtttaagaatgagctcattaacatttagaactgggtaggaacagggcttcataggatgttaaaatcagagaaaaagagaaaagagcaggtgctttgtaaatactatgtggttttgagaaatagtagaaagttgggtcttattttaaatttccttttttccagagtccctttaaagttgtgattaatgatatacattattttctttattgggcaaaatattagaattattagagatacatttttcttgggaaaaccactgtggttctctggacatttctatgttaactgtgtcatatattagtatagaataaattcacaggcttgtgggtctgaggacatttgcttgtttcctttaaatcaatttatacaagcacttcctatgcttccttcctaacaaattttccataatttatttctggcctcgtaaaaatagagggaaaataaccaatcaaattattagctcgattccttacatgagttcttcaatttttcctaggtaccaaacaaaataaaaccagtctttgtaacaaagattattggttctgaggaaatgactatccacaaagtgtacatttgtgtgtaatatgtggtatgcattatgtgtggtattttacagttaaaatacaacataattaccataaaataatgtatatgaaatgagttgtaacaataagataagattgacttttaaaaataaacaaccaagaataaacacagcagaattcctaatcagccttactcataggtcaaatttagctttgatgtcctttcctccataagccatatttaggcatcaattcagtataatactccttctttgtgctcccatatcgcacttcatccttccctcatcatggcacttactgtgctgtgttgcttgtttggctaattccttcatttggctataaactattaggatatgagcagacatggtgcctttttcactttgtcctctgaattctttttttaaaaattgaagtaaaattgacatgtaataaaccttggatatttagtatacaatgtgttaagttttagcttagtgttgtccatgaaaccatctcacagtgaggatcatgaacacatttcccaaagtttcttcacgctcctttggaatacttacttctacttctcttctttccttgtcttgagacaaccattgacctggtttctatcattgtagattaattgacacttccaacaattacgtgtaaatgaatctcatatagtatgtactgttttcttttccttggcttctttcacttagcataattaagattcatctatgttgtagtgtatattgataatttcctttttattgctgagtagtattccattgtatggatacaccaaagtttgtttatctatttttaaattgctgagcatttgagtaataccagctttttgcagttataaataaagctgctatgaatactagaatacaagtcttcgtatgggtatctacttttgtttctcttgggtgattatgtagggtggaatggctgggtaaatgggcaggtgtatgtttaactttacatgaaactgccacagttttctcaagtgttagtaccattttacattcccactagcagtgtatgacagttctagttccttcacatttgtgccaacacttgatatagttgatattggtaagattttagccattctaataggcatgtagtaaaatctcgttgtggtttacattttcctttccctactgactagatgttgagcatcttttcatgcttttgctgtccatatatcttcttttgaaaaccatctgttcaaatcttttgcccatgaaaaaaaccttagttgtttgttttcttattgagtttcaagagcttttgtttgtttttattgacacatgattatatgtatttacaggggacagtgtgatgtttcaatatatgtgtacattatgtaaaaattaaatcagggtatttagcatatctaccacctcatacatttatcgtttctttgtgacaacattgaaaattctctgattttgaatactacaatatacaacccatctttggtatcaaattttgaaatatacaatccaatatcattaactatagttaccctatagtgcaagagaacaccagaaattattcctcctatctgtaatcttgtacctgttgaccaatctctcttatgttcccctgctttcccttcccagcctcagtaactactattctgctttcaagagtttttttttttttttttgagagggagtgtcgctcttcttgcccaggctggagtgcagtggtgcaatctcagttcactgaaatctctgcctcccaggttaaagagatcctcctgtctcagcctcctgactagctgggattacaggtatgtgccaccatgcctggctcattattgtatttttagtagagatggggtttcatcacgttgtgtaagctggtctcgaactcctgacctcaggtgatccacatgcctcgccctccgaaagtgctgggattacaagtgtgaaccactgtgcccggccttaagagttctttacgtgttcttaattgaggtgttttattaaatgtatgatttgcagataatattcttccagcctgtggtttgtattttcattgacttaacggtgtcttttgaataatagaggttttaaattttgatgaagtcccaataccagtttgttcttttatggagtatgcttttggtctcataactaagaaatctttgccaatttagggttacaaagtttcttctagaagttttgtcatgttaagttttacatttaggtctatgattcattttgaattaatttttgtatatggattgaattttttttttttgagatggggttttgctctgttaccaagtctggagtgtgcagtggtatgatcacagctcactgcagccttgacctcctgggttcaagtgatcctcccacatcatcccctcaagctgtagctgggactacaggcatgcaccaacacacccagctaattgtgcatgtgtgtgtatatgtgtgtgtgtgtgtgtgtgtgtgtgtgtgtgtgtgtgtgtagagaccaagtctccctatgttgcctgggctggtctcaaactcctaggctcaatcgatcctcctgcctcagcctcccgaagtattgagattacaggtatgagccactacacccagtgtaaattttttttccatataggtatctaattatgtcagcatcatttgttgaaaagactgtccttttccattgaattgcctttctgcctttgtcaaaaattagttgtctatatatgtgtgatctatgtaaaaattccttattctgttccattggtcagtgtgtctgtcccttcccaaataccccacagttttgattactgaagctttatattaaatcctaaaattgaacagtgtgagactttcaactttgctgtttttcatccttcttttaactcttctactggttcctttacctttccatagaaattttagaatcagcttttctgtatccacaaaaatgtccttctgggatcctgattgaaattaaattaaatttgtataccagtttggggagaattgtttattgtgttgagtcttctaattcacagtcattctccatttattttggtctttctgtaaattttttagcagtattcttgtagtcagtattcagcatactttatatatatatatattatgtttactctttttatgtaactttaattcaaaaggtacagagactctcccttagtgctgttcttaagacatgtttatatgacatctttccattagtatctttggtcgtgttcctgcagtatcctcagttgtgctcaccactgcttaactcacctttgcagccaagtttcattttgagtcaaatctaccagaggaggtcatttaccacctgagaaatccctcacttagttttaacagaaataaataactttaaaacaattgatacagctccttctttggcttgtataattttcttcaggcataagtaaaaaaaaaaaaaaaaaaaggaaaaagtgatttcaaacatgttcagagtaactgtaatccagctgtggttgaaagaagaattttgagtggttaaagagctgactgaccatgttggtggctcttgaaacactatcagcttttcttaaccagaaggcaatcaaggacatacttgaggtcgggaacagatatttcataggccactggagtgctgcagtggaaggattccctccagatccttggttcacagacagggaaggtgaagcctgaggagacttggttacttggtttccttggaggatcatatgctcagtgagctcttcctgaaaaccagccctgttcccatcagaaactgcagagacatagtacttcccattcagcaggttacatggagtcagcgtaggcagtcaaaatggagagatgaaggattggtgttgggtaatgagagcaagggatggtcatagaactcagagatgataatgtgaccaacaggatcattattcaaatttcccaagaggcacaaatgtagatgatgattgctttcataagctagtggagttaatttctgtcagacactattctaagtgattttgtatatgaactcatttaattttctcaacaaccttgtaaggtataggtaccgtaattatttcattttgtgaatgagcagaaattaagcacagaggtgccagagatcttttctcataggtgatgaaggtaggagaggaacccaggcagtctggctatagagcacagagtcttaaccactacactgtctggctgatggcaaagagcatgtctattaagaaagcctatggggaaatggtcgccaaatccttctctaattcttggggaccctgagtttcagggttttttttggttttagaaataagggaaactcctgtcaaatgataagattgacatttttcatttttgaagttctaaatgtaaagctctttgaaatgtataggttttcagatactctgtgtgtctgtgtgtgtgtgtttgtgtgtgtgtgtctgtgtgtgtgtgtgtgtataagttcagctcctttaaaagccccatctctgtcacaatcacatttttttttcacaccgcattccaccctactaatactcagagcttagattagggaggtgactaggatactgttaattaaaactatatgacctgattagacaaattaagagaaattttcgatagggaaaagaagcaggacaaggactgaacttctgagagatagtgaaaaatcaaggtgtttttcttattctcagtcacttcacattttacttctgacactagatgtgtggtggattttccccacacaccaagcagttctccagaagacatcaattaattagctgaacttattcaatttaattttgaccctatataccaggcattctgatactgtctacctggagatagtatcagatctcacaatctcagggctcagtcccacacaactgcccccgacttcagacaccaattgcaagttccaggtgatgtgtacttctgaccaaccagctattaatcggggttctcatgaccccctcctcaggtttgattaatttgctggagtgactcagagaacccgggggggaaaaatttgcttatgtttgcccacttattattaagaatattacaaaggatacagatatgaacagccaaatggaagagatgcgtagggcaagataggagagaaggggagtgagtggacttctatgccttccgtggacttgtcacccttctggaaactgcacgtgtttagctcttgcgaagctcatttaaaccctgtccttttgggtttttatggaaaatttattacataggcaggatcgattacatccttagccattagtgactgattcaacttttagcctcctctcttatttgttttaaacgtttgtttccaaagtttttttctcccctttgaggaggacagattcaggcttacatcaaaatggaattaaatgtgcctttgatttggaatggggcaacaagagccgcctgcatggctgtgtatatttatttatatggggtcaggtaaaagcacttttaaaataagcaagtattagagatcagaggttatggagcagctgctggctctggctgacaaagcattcctggtggcatttgccactagctctctgggtgtgggcattagagagtgtgagagttggcctgatggcctttgtgtttgtggccctgtgtggaaactttatagcatttcagccgttctaatctgtgcaggcacagagccacagctgaccataactcttaggggaaatgaggacagaaaagttgaacagcactgtgtgctgtgtagagtatggagaccagaatgaagggtgcagaatgaaaggaaaaaaaattttttttgaagtatcctgcttcagggtttctattgtttgggaaactattcctatagaaatgacatttgtgctttgtgaagggggtggaggtagattttctggagtgtaattttctggagtgtttccttattgaagggggaaaacaaatgattggaaaggctcttcctctgtttctctcatgcatccctacacccccaatatatgcagtgtccttgtttttgttaaatacagaagctatacagagggcagttagagttcatccaccgttttactcattggatgggattattaagagataagaccatttattgcttagcatgagaatcttactgtcccggccagcaaaggaggccaaagatttcatctgaactttacctcttcaattcaagccaccaaagatttattgggagtctactatgtaccaggcataacatatggcatataaaggctaattttaacaattatattgccgtttatgttgttggtttggatagaaaccctgtcttccactaatccttacttttcctataatacaaagattatcattgatgaaacatattacagattattattttaagctatttagcaaatattagacattttcttagagaatgtttgagcatatcagaaattgtggtggatatgttagtttcctatttgctgcaataataaattaccacaaacatagtgacttaaaaacaacacaaacttttatcttacatttttgtaggctagaagtccaacatggatctcattgggctaaaatcgaggtgtcagggggctgtgttcctcgtggaggctctgggacaaattctatgacctcatctttttccagcatctagaggcttccctgaactcctaggtgtatggctcttcccttcatcttcaaagccagcaacagcagattgagcccttcttaaaatgccatctctttgtttctcttttccatagttacatcttcctcttccacttttaagaacccttgattacattgggcccaccctgacaatccaggataatccccttattttaagatctgctggttagcatccttaattccatctccaaccttaattcccctttgctatgtgtagtaacatattcacaggttccaggaattaaatggacatggacatctttggggagccattatttctacctgttacagtagggtggactttccccaaactttgctctttccccactcaaatgaaattgtatagtgccctctattaattctttgcaaaataaattgttacctatgaatgtgtcttgtgcgagtggtgggtggtttatcactgcttaaagcctcactcttcttcattgtgacaaaaccccagccacttagttttgtacaatcccagtgttcaaggaagctagagatcctcttagccagcccgcccgcaggggttttgcacacacattgttacatctcttcaaaatggctgtcccacctttgcttacatgaaatggcctgccttggcaaataaacctctttgaacagttctgtttttgttagatagttcctgctttaatttaggggaaaatatttctctttgtgggtttgtagaacctattggttcttgttttactctctggggtcatattgaataaatctaatttcttctttcacacttgaagcccttgagattttttttaaagacagttctcatatcccccaagtatcagacttaaaaatctcaatttcttcaactgggtctcacataaaactgtcttgagacttctctccatcctgttccttctcctgagtatgatacaacatgaagaaggggaggctgaaggaagatttaataggaggctttaaatgctggggggaattgtcatacagaaaaagctggtaaggtctttacatttaccatggaaacaagaaatcacaggctcatattgtggctaaggagatttaattagcaggaaacctgtcttaaccttatggatttggtgtcaggaaacctgtcttaaccttgtggatcatgcaatggactgcctgctatgggaagttgagggatcttttgccttagtgtaagacaagtcttcaagctcagaattcgtatattttgtgtaagagacgttgcttttagttaaatgttttgcttaaagtattcttgtcattgcttgtcatctatgcctgatgcctgaatttccctcttgtgttggttcattggatgtaaggcatcatcatgactgctgttaatcatagggggaaggaatatggttcagggctttatgaaggaagggaaacagtggcatagcacaggataattaatagcaagtggagtgacagtttgattccctggtagggaccctggcattgttgaaggaaaaaaaaatcactttattctttcatagagagaggcagctgtaattctggttggatggaatccaattaaaaggaactgacatgcaaattgatgatgagacagtgtgagcatagaagtagtccaagaagagttttgtaagaaatggcagagaagagtgtaagtaatttggcatggtaatgtgtgtaagaaaatggaaagctgatgggttggctacctgaacaattatgtctggaatctcagccagcagagaacaggagactggttggtttggtagagttgttaacaaaactttctggtgttttgagttttggtctacattttaggaattatagcctttcataatagaatgaatataaatcaacccttgagggttataggctttcaaattggtggtggttaaatataatattctcaagattctatgatgggagtcccagcctggctcttggaaagaagatctcattgtacaggtgtacttcacctgacctaatgatgtgttctcaaagatttgtgtgagaattggctcctaaatttaggatgaaataggagagcttgccatttctagtaatgctattatgaatcattttctaatgtaaaaaatccttttataaccacagtcatgcccaatttatcttttaagtaaattcataagtccacatattagatttgtttaaaccaaaggtatttttctttgaaatgaaataattgtaggggcacataacagttaagctttagagtaacagaggaaaaattgggtaagattttataagtcagtatattgctttttagggaggaaattctgcctaagaagtcagacagcttctgctgttattacgggaaaaggagaaggctgcccaacgtatttcagggagatttactaggatctcttgggaactgcagtagaaatcactacgaaatattttgaggatagaggaaacaggacaacagcgtttactaggttttattctgaagaaagccaaagaaggtggaatggagttcatcttgagaaagcggtagaagattgagaagctaagaaaagacttacacagcagcaaaaagaagaagagactggagtagtgggcagagttttcagttagcaagagagcaccatccaattgttatgctggtcagcagcaaggaacattaatgaaggagatgaagaatgaccagggtcagtttttgttcatccaggtttgagcagggtgttgcttatgatgctccatgcagttttgcctcccacaatctctctctgatctttgcctcctgatctgctcaagtactgcagcagcaatgcattctctactgaaggctgtcacgtttacttttcactgtgcctagaatgctcttaccctcaagcctccctccttcacttgattcaggttgctgctagaagctcccttatcagagagacctttagtgaccattctgtctgaaggaggcagacactcttcccttattccgcttttcttcatagcactcattatcacctcacacatggttgtttaatgtttccccaattttctctgctagaagtaagttctttgagagttcagcttcagtttcttttgcccatcagtgtattcccagtacctaatttatataaaaatttgtggaatggatttttagggtatctcttgcctatcacagtgagaagagctgagaatgaagaatacaggactcagtccttgtcctgtgttatgcaatgtattacatagttatagtaagtataacagcctgagcacagagtgctgtgagctttgagaaataagctagagatggtcatcacagaactggatcttgaatgataaagaggagttttgttctgtggtggagacaaggaatgatcttctaggctatcaaagcagggtgagtgaagttggagagatgtagaaatgagttttgtgtttggatgtcattgagtgattttgatttggctgctagagcacaggtacatgggaaagcatgacaaaggggcctgagaggtagggttggggaggacatgtgaaacatatgttgagatctgattggtaaagttattgataggcgtttggaccttgtcttttgggaagcagggaagtagcaatatccaaaagagagtgcttaaggatggattggaagagggaagattatagaggggatagagagcaaagcaggatgtgactttcccagccttgaaatgcatgagaaagtttgggatcctcacaatgaagggcaaaaaaaaaaaaaataaaaagcaattctgtttatggatgtatagcaatatattgtgtataggtggtggctattagaagactagtagttcttggaactgttcctttttttctcacaatagtagttaagctgtgtcattgggatacaaagggaaggagaaggctatttccattcttagaatagaaaaattggaaaatgccttggcaaatggaggtattcttattctacattttttttttttttttgagaccaagtctcgctttgtcacccaggctggagtgtagtggagccatgtgagctcactgcaacctccgccttctgggctcaaacgctaccacacccagctaatttttttatttttgttttttaagagctggaaatttgctatgttgcccaggctggtcttgaactcctgggctcgagtgatccgcctgccttgtccccgcaaagtgctgggattacaggtgtgcaccactgtgcctggccataccttacaggttaagcagctatgtggccttgtgcatttcatttaactgtgtttcatttgtcctttcatggagatagactttgttgatatcctttcatcgttgatgtgcagaacaaagtatgctgcttgggaaattataaacatactttcatttgaaatattgggtaatatcaggagtcctttgctttaatagaagtagatctggaattgcttttttttttttcttggaatatggtaacaccaaagcatctgagctactcacacccatttccagaggaaaacatgatcatttccaggagatggcctgcagttttaaagctttttgctgcttgttttctacatgtcaaaacacatcccatttcagcagttggtgagcgctaccatagaactgttcagaagcaagagggaggattgagtcatgttgtacgtgcagctgcatattaacctgcaggtcatagcagtccctgatccaaaggactgtctgacactttatccccgttcttactgccttcatcattcacagcagccagtgtaggactctcccactttagccttgatcatttggagtagcagaatcgtggtcttgtgtatatatagagtgttatataggccatgtgattctcggagacctttttaggaagtttgagcaaccttacatattggaattctttcctctttttgagaaggaggaaagaaatgtatgttttataaggattgctttgaaatagatccattttgcagggtttaactcaagcaaagaacagactagcttaatggttaatattaagttactggagtttgaatgcctaggtcccaattcaagcttcaccattattagctatatgaccattagccagttttctcatttgttagatgatgataattacaggaagatactgtatcttcccacagagtggtccagaggaatgaatgagtaaatacatgtaaatcacttagactaaggactggtattatggattctctgactgttagctgttttattcctgattttctcatagccactggcatttctaagaccttgcaagaaccactggtcaacttttctgcctgctatgtttaactagtagaagtcagaaagtgacttggtggcagagtgctagaaatgattcattgggtggactattgagcttcacaccccagtccactggcatcatgtaagaaacaactcattacactctaacggtagtttagtgaaatggatgagtagtcttagtctgcctcctcaggctgcaacagaaagtcaagccaagcagccaggaatgtctgggaatcacctggagagaggacagacatctgcagcacagtggaaggtgatagatgagtgggacccaggaataaactacagaagcagtgtggattgtgttgattctagcaagcaggagggggtctccatggtatttctgagtataagccaaggaaatgtgttaatgtggggggaaaaaaatcaccgaactgggagagagtcagactacctcgggtgtgacctttgccctgtcaccaacatattgtatgtcacatccccatggggcgagtcacattttctttctaactctgtttctttgtctgtaaaatgattaaatgatttcttgactctttcttttctagattctttttaacgatttcattagcttttaataactatgtgaggaaaggagagcaacctgctatagaccttggcctgtgtgagtctttaattttgttttttgttatttcaaagaagttcttgttcaaaagaccatgagacatttcatcattggactttttagggagttgtctctttaatctctcatatttccttttttccctacaaatgatatccacagtactgctgttgtcttgtgctctctggatcagcacttttccagagaaatgaaaacactgcacttttaacggcacagaaagcaaaattactgtagcatcaggattcaaggttacagaattggttaactttctggtttgttttgctgagctgaatgaaaaagatttgatcgaatgttactgcttagggataaatattaataaccacaaactctcttagtgatcattgtccccccttttgcagaaaatttcaaattatggtctaggacttagattgtgattgtcagctgaatatgggcgtgaaaaatgtggaataaccagataaaggacccttaattggttgtagaggaacaactttttggggatccatgtccagagagggaattggttctggattattgatttgtatcattactttgattaagtgtctagcagttgctgtagacctttataacattatataatagaaatggtattagaaaaaagtcatcaaaggtaggatttttttaaagatataagaaccgaagtttttaatcttcagtccttcatagagaagaatttattaggtttgagagttctcagtaccaagtaaattctaactgcagacttaaaacatatgaatacactcacatatagtcaccccatcctctggcctggttttgttctctattatagttgactttgctttaggggaaaggagggagagtattggtattaatttatttgaaaaattagcaggagtatatcaaacacttactgtatgccaggacttaccatgataaataagaggtggacccctgtccttatggagcccacttgaatcaaaaagtaaacatatgagcatgcaaatagatggctgtaagaatgtgatgggcatgccattttttctagcaggttgcctaccacatagtctatatgtgttagagatacacattaggtacacagaagagggtccatttgtggcatagagagagattagaggaatcttcatgaaggaagtgacatgatgatgatgttttgaatgacaggaaggagtatgcaaaaaaaggcagggttgacattccagacagaaagactagtatggaccaagacatgtggacatggaaatggtttgctccttttggggtcctgaaggtaataagtgcaatgaggctggagaactgggtttgtcttaaggggctatgggaaatgagggtcagagtgtaggctcttatgaaggctgtctggtcagacttgaggggaaggtatgctggtaaattgcactgagaatagttcctagctgtcccatatttcagcatctcctgaaatagatgtgtactgtgatgtacaagttccaggatacaatcagttcatgagtatccagttaatgtacctgcaggatttgggcagcaatatatgtagggtgttgtgtgaaaatattggatatgaacaattacaatcttggcttgcacaagaaatcattgtgatgcaggagggaagggtagaaaagttagattattttttttcccctctaatgcagtgcctctcaactttgttacaaattagaattacctggggatcttttttttaggatattgtttacatgcagtgaaatgcacagatcttaagtgtacacatcaatgaattttggcaaatatacatacccatgtagcacacttacccatcaagttatagaccatagtcagaacctgaaaaagttttttagtttccggtttgaatcaattcctgcccacccctcccatatgtaaccactgttctgattcgtgttaacatagtttagttttgcctgttcttgaatttcatgtgaatggaattatacaagtatgtgctctattgtgtttgccttcttctgttaacataatgtttttgagattgttctatattgttacatgtcagttttttttaattgctgaatagtaccctgttgtacagatataccacaatttgtttaatcattttcctgttggtagacatttaaattgtttcagatttttggctattatgaataaagctgtaatgatcagtcttgtacaagttttttttttttttggcagacataggtcatgatttttttttaacgtaagtgcctaattgtggaattttgttataggtatgtcagtgtatgtttaactttataagaaactgccaaacagttttccaaagtggttgtaccattttacattccctcctgcattgtatgagagttcttgttgttccatactgtcaaacatttggtatgataagtctttttaattctagccattctaatgggcataatatggtatttcagtatggttttaatttacatttctctgatgatttatgatgttgagcactgttttcttttgtgaagtgtgtggtcaagttttttttgaccattttcaatttggttatctttatgttattgatttatagggctctttatatactttggatacaagtcccttgccagatatacataatgtgagtacttctttcagtctgttacttgcctttttagttcctaatgacatctttggataagcagaattttttaattttgatgaagtatagtttatcttatttttccattatatattttgtgtcttttgtatcctcactaagaaatcttttcttaccctaggttatagaaatattcatctttgttttcttctagaagctttatttatcttttggtgtatgttccatcacaaatttttgagtgtgatatgaggtaagggtagaggttcattttctccatatgtttatctagtcgttccagcactatttgttgaaagaccttactttctccattgaatgtccctggcacctccgttgaaaatcagttgcttgagggccaggtgcagtagctcacacctgtaatcccagcactttggggggatgaggcgggtggatcacgaggtcaggagttcaagaccagcctggccaatatggtgaaaccccgtctctactaaaaatacaaaaagtagccaggtatggtggtgggcacctgtaatcccagctacatgggaggccgaggcaggagaatagcttgaacctgggaggcggaggttgcagtgagctgagatcgcgccactgcactccagcctgggagacagagtgagactccacctcaaaaataaaaataaaaaaaataaaaaatcagttgcttgtttatgtctatttctgtttaggtctatttctggactctgtgttctgcttcactgatttatttgtctgtcatcccagtatcacactgtcttgtttatctagctttatagtaagtcttgaaatgcagtagtgtgaatcctcccactttgttttcttttcaaggttgtttttactattgtaggcccttttcttttttatataaggtttagaatcaaattgtccagttcttaaaaagaaaggtagctagggtactttaccttacaaaatcccttgatacccagaccatacttcatcccagttaaatcagaatcatttagaaatgaacagaatctcgttcattccctagattcttctgagtgcagccaaaattgagaacctatgtactaatgggattttagtgtggtacactaaagaagatactgtcatggattgctgggatggaagccattccagtggaatgtatgcataggagctgatgtgggcccctacacgaaagaaattgttgatgtttatggaaccaggagagctgaatgaggaagagaaggagcaggagtgagaagccctgtggtcaaggtagtagagttccctctccctggggcacatggagccccattgctgaggcgctgccttgtgtggctcctattcctgattattcagggtattcccaccctaaacctgctgcagtgcagccaacaaaccaccaacttgaaatctagggaatactcttagtagagcgtgtaaatgtactattttaaagaatagctttcccctggattagggaaatgcttgtgaaatctgcatagtgatgaacagggtaggcacattctagaagtgcctgtgtgggttttttgctttttgagttttttctgtctttttaatgtaatgtctttagacaaacattgagtcatccattcttcccaagggtaggtagttcagtcagaagtgatgttttcccaaaaggctttaaagaaaaacgggacaaaaagttacgctcaagtaatatgttctttgggagcactcaaagtatgcaggctggtaggttgcttgcttgtggcttttttttttttttttttaatttaaacacacattttcctctttgaaaagagaggttggaactagtcagctgagtccctctttctgaaatacacgttccctaaacagctgtagagaattaatttcagtcaaagatagcagagctttaatctcagctttctgctcagtgttatggaaaatcctttctagaaaatagccagtgtctacctgctatgggatgttaaaaaattcaaacgaacattggattttttagtgttttcctagtagaaacagcatggaaaatcctttagtgagctagattttacagtgcacacagaaagcaagtatctatgatacatttataattttgtgtgtgtcacatgttggttgtactattttcttattcctaatagaattgaaatataccatgtccaattccaaaccttattttttttgtgtgtgaagggttgaagcattttagacaagaaagagctttgatactagcaactttaaactcatttataggatatatatacatatataatacatacatatgtatgctctttcaaggcagaggaagaaggtaggcagagtatgagaggagagttgcttttctttctcaacttatgattgtatttaacacatactcgcatgcacacacacattcttttaatagcattttttttttgtagtgagagaaaacttatctttaagaagtctctaatctattatgggattaagagttttaaatgtcccccaacacccccccccccatttttatacttttatttctacgatttatatgtcacgtgaacatcactttttggtggtgtgattatatcggaatacttttgtattttgcttaacattaaaaaagccatttcttacattgctatatcatgatagtaatttaatggcagcataatagtacctcaaattgtgccatactttatattcttctgttgtaagttttctattttgtgctgttaaacctcaaagaacttatttgtgcatagaatccctcttaatttcttcagtacatcctctgtgtagaatagtcacaaggtgcattttgttttttccttatctgtgtacagtttacactgtatatgatcctcagtgatatagggtgtatttaccttaagaatgatcattatttacatttctagggataaaaagctactggatttctttcataactgtattatttaaaaagttgttcttcccctttatttttgtgcacaaatttgagccacatttatgtttgtcttttaatgggttatgggttcaaatttttttcttaactggtatgtttttttttgttgttgttgttttaatttttttttttttttttttttttttagaaactaggtcttcctaagtaagttgtctggtttggtctcgaactcctaggctcaaagtgatactcccacctcagccgcctgtgtagctgggagtccaggtgtgtgccactgcacttggcaatatgtaactctttgtgatatttgtcatgagtattttttccaagttttttctttttttattttagtgccattgtgcctggcaatatgtaaccctttgtaatatttgtcgtaccttttccaagtttgttcttttttattttagtttttcattacaaagcagtttatgaagttttttatattttcttctgttgccttaagatgaacaaacttgtcatcccttctgagatctaacatcaattctgtccccacctgccccccaatatttcctgtggtttaattaaaagcaatttttaaaatccatctgagtttctgtcgatacatatgccctctccttacctgctgtgctatgaggaaaggtgggctaaatcaggagctcgtgttattcatatcttgggagaggaatagaaacagccagtactccaatctcagcttcctgtaatgtctacaagtcagtgtttgctcatctataaagctgggatgagaataacaaatgtacagagaatttttttaatgcacttaagccttctcttaagcactgttaagaacttcagttgaaagtgtttaaaataccaaatagctgtaacctttgattgttaatatgtgtgcaccatcatttcttggatttttctcaatagctagagaccacatgggatctttggtgttttccaaaatgaaccaccatgctattacctgcagacattaagggtctgattatacaaagaaactgagagttgaggatgtccatcagaaatacactgtttcaaagtcagatctgagtacttggtgaagactttggggactacttaatagtaatgattactagaaaaataaacactggcaatatagatagtggttaaaaaacatgggctttgggctgggcatagttgctcatgcctgtaatcctggcactttgggaggccaaggtgggaggatcacttgaacccgtttgagaccagcctgggcaacatgccgaaaccctgtctgtataaaaaatacaaaaattagccaggtgtggtggtatgcaccttaagttctagctatctggggaactgaggtagaaggatcgcttgagcctgggaggtcgaggctgcagtgagccatgatcatgacactgcactctagcctggaagacatagcccaaccctgtctcaaaaacaaaacaaaacaaataaacaaaaaacgtgggctttgacagagagacttgtttaacttaattaaacaagtgccacttaagtgatttggggtgagtaattttagctctctaaactcagtttcctccactgtaaaatggggataatattgatgagtggtttaattaagaaaatgtatgtgaaatattgagcatggtgcctgacccatagcaaatgctaagtaagtagtagctgttattacttttattaacaagtaacatttgtataacatttatgacctacagagccctttcacatgctgtttcttatttgtgaactgagtgttttatacagaatgggtttttaaatgttccataggctttttattcatggcttcaagaggttgttccctttttgggacctgtacagcttgtgtatactcagttggcatttgtcacgtatcttcatgccagtgtctttgtatctgaattctaaaactgcgtgaacacaaaggttatgtcttttgtcttattcatctgggttgtcactggaacagagtcaggagacattcctatttattatgtgcgtaatcgtaggcaagtcaatctctggcttgccaaagctgtcctttcctcatctgtaaaatgggtaacaagtttcttgtgaagattacgttaaataatgcattaggaagcactttgtatagaaaattacaaatagttttttgttttttgttttttttttccgccatgcctcactagcctagtatcacagtagatgctgtaaggttggaggttgttaggaaggctatagagccaagtcttaactttagtgtcacaatacctttgttaaacaatgaaattcagtctttgggggctagttgtcatgctgggtgctgtgccaggctaattaatactttggtaccttgcctttaaagtacttactgctgctgtctccctccctcccctttggtattcattatttatagtataaaacatttgctgcttgctgttgtaaaggtgggggatggggtgtagttacacataggtgctcagagcaggttcaatgatttaaccctacatgaggaagtaaacttaatctacataaaatatggatttgggggtgtgtgatctctgtggtcagtctggaggagtgtgcgtgaggtgtgtcagccactaagcaaacaatggagtgctggctctgtggactcttggctgagtcagcattgtttcccatggaatttctttttctcttagcccacaggtgtatttatgtgtcctggtatttcttcgtttttattttcccccaatttgatttcataaatgatagtgcaaagtgttggctatggttaatttcagtaaataaggcccaaatatgaggtatctgtttctctcttgagtaaaaaataaagtcatgttatggggaataaaagcaaaagcatttaataaaaaaatccctttgttcattttagaaaatggtacctttgttaattccttaagagacaatttattatattctgacactatctttgaatagtcaaagaaggcatgatgtctcaatttaaatttcttcttcctggcacagcttttattctgcaaggtttgtgcttttaggaagagggtattgtttctcataggagagtagagtgcctagtggacagaaaaaggtaaagattgtcatttccttgaacatagattggtgtttaatttctacttaagggtgtcttttgagaagaacagagcccactctgtttagcagcttgctttttgctaatcatgtggtgcatggtgtgttttcatctagtccgttccattaagtcttatttatgctttggggatatggataattggctacggctcaggtgaggtgcataggtgatgtgtcatttctctcctgaggggatagagatgacaggcttcttttagataatcactgtcagtggctgggacccaggaacctttggtattcacctgtttagtcagtggggggcaaatttgatgcaagagcagagagggaactgtttttaaactatgtatatagtcactatgtgattaactctttggtggccctttaagtacaggataaatttgcattagaacttagtgtctcagagtcttcgattacatgaagtctgaaaaagtgatgaccaattgtcaatattttggacatattccatgagtgccccctcagaccattggtagagataggtttgcaggtggtgaccctggtgaaatcctcctctgagaagggagtgttcaagggcatacgttggcatcatttaagtagcagaagagagcaccccattgagatggtttaaaaatgagatgctaactttcaaagttttttaaattttattttttacaatgcctgtgatgctactacattgtataaacagtatgtagtgttaaggatgtgcctcgcatgtaagccaccactagcatccttagtgtgggggtactgttccttttctacccaaatccctgcaagatgttctgagattttggtgccaaggagtctcccaacattcaacattgttaaaacacacttccttatcttctttgaggttttttaatagcaaatcccaagccactcacctttttctcatagtattaatgttctaagagtggctatacattatgttaaagtcagcgtagttctccacgggaaggctgttttttaaatgagacttattcaacctctttttagctggtgtttcattaccaccgaggatttataatgcaatagctctgaggcaaagctggtaagaatgccagcttcgctaatatttagagtcataaaattctggatattggacaagctcttaattactctgaatccgtctttgtcttaataaaagttggattgtacccactaaaacaagatggctgtgtttgcattaatctccaaatgtaggttaatacctttttaaaagctgtctcctagacaagagacttgaaaattaatttcccattttcagcttaaaacgaagagctcttccacgtgtggagattgaagggctgccatttttctgatgctgtagattcaagtgccaataataactctttgttcctctttagtttttttttttttttttaatgtcttaggtaaagaagtctttcttttctggtgcttggggacttgtattttttaaaaatctgcttcaaagtaaatagatgaaatttcattttctcagtggagtttggatcactgggattgagggggatgaggaagggctagatagatagtatgaaacctattggattcatactatggctgcagaagtctgggctttacacattaggttgctaccaagctggatattttgaaatatatatatgtatatgcctgtaatgttttagcatttgcttgttgggttttttttttccccataatggtaggttcttaactgactttttcaaatgcaaggtaaaactttcttttccttttcttgtctccagagtactgatgtgtaaccacttagtaccactaatgccaggattcatttctgtgctacagatggtcagtgagattataaaagctctgaaaaggtttttatataatttgaggtcttctcagttgagagtttgtgtctgacatattaattccttcccatccaccccctgccccattctcaatgtaaaccatatgggacatgtattaaaaaacaaatttcagacattttctggagattttaattcagtagttctggaataggttgcaggaatctgactcttaacgatcaagcacatttgatattcagacaactctattgcatcctccagaagctccaggattctgtatataatttgtaggatatacttgcctcttctatgtcaagtctcttacccagtctgattatgtgagatgtcttaaacagagcgttttttcataaacctttatgtaggataatactactcctaaaacactttattacatagtttttggattggtaatggcaaaagaatgagaaagcacctgaggaggcaccattgtgagtgatgaaactggggtatcagacctggttatgaaaggagatgataacccttgtactgttttcagacagttgcagagttatcctatgaaggaggaaccataattctggtggccctgcagagcagaccggggactgatgaatggatgctgtgggggctgaacataaagagaacaggtttaacagaagggaccaacatcctttgagagatactactttttaccttctaattatttaacccatgaaactattattttctcccaaagacacctgtttttagactatcagttaataaaaagaatggggctacttaggtggaagctggctgaggggcacaaacagattaagccccttttctccccagagctagcaagcagtacccttagccagaagccttgggctccatagaagtggccacaaacacaactagagtatggtgagttctgttcagtggaggtggccgcacagccccctgacaaggagtcttgtgagctccgtaagggctggcccttatctgatttgctgctgtagacagccagtgcaggggactagcacagagggcagagcttagtgaaatgtctgtcaatgaaagctgtggaggacatttgtatctcacattcagtgctgaatgagatttaaaagtcctttctaacataaaaagtctgtgatctctgcttccaagattaattcttaggtctcagtatggatggcccaaggatataagctttgtgtctgcagggactttgtttcctatagtgctggatttccagtacgtagactagcacctgacattagtgggcactcagtgaatatttgttgaatacatgcatttgttgaaaaaagtgaaaattgtttaaagtggtactttgtgaacctttttttctcttttttctgtcatcctggagacttctcatttaacccccagtctgtctcgtgatccatgccccatccttccttcatgcctcacaccacctccttctcaatctatacttggcaaagaggaataaagacgctaaggatattgtggtaaaccaaagtcatctcagaaacacagtgaaattccctaggcatctgaattgggaaacctattggctgatttgctttgacttgggtatttcctgtgattttcagccgggatgtgctcctgtgctcagaagtgaggatctgttgtaggtttatggcctagattaattgggatattttgtgaagtctctgaagtgttatcacttcatctttatccttgcctgctattcctcatgaaaagcatttgaattattttagagaagatataaatttgcttgtgttatccagtgtcagcttaaagctgattagcattttgcatcacctttgcaactcataaatcatccacttaccctctcagtaagcaggctgtaagtcagcatggaagcacctgctgcagcttcttgtcctgtgatttagaggacactccagattctctgcagacccttctgtggtgttattctctggtaaggcttcacctatatgggaaatgagtaaagacttttggtgacttttttttccctagggagttcttaagggttaccctggacgagagacttctcagaaatatagtctttaataaacctggtccaggcacaggtttggttcatttggcatatttgttgttttaaaaattttggaggtacttttcaacatttaaagtccaggacatttcacatttaaaaaaatccagatttagggttattccgggaaaatcagaacacctggcagtgtcaggccatgctgcatgcctggcttcatttgttattgagagcaggagtgctctaggaaaggggtacagattttccattttgctgtagactctacccctctcagtttttccatgggagtcaactttactcaaagtcctgcactgtagatgcttgaattggtgacatccttctatgttgtgcgagtgtatagattgttttttttgtttcttttttgagtaatatcaaccatttaactcaattgaataataacaagaggctaacatttatcaaatgctattaatgtaccaagtactgtgctaagtgcttgtaatatgtttgtttatatattctttacaattatcctaattgtatagatgaggaagaaattgaggcaaagagaggttagataacttgctcaaggccacctagctagtaaaagtcgggcagagtcactgtggtgtcctcagaagcaagtccctgcttgggctagcatttttgcctagtccgggttatctccagaacctggtctgctcctcattcccatatcccattaggaacagtgggcatcagttgcaaaagtagatgacagtaacacactccctaagtccccagtctgctcctgggaggagcagcctgccttgttcatggcagtcatagccacagggggatgtttgaaagacagccccttatacagtgtctattgattttcttcaccctcttgttttgctcatccatcctgttgttctaggatgcttatttgtcatgcataaaagccttgttacagtgaacccaaacaagtcattgacatttaaaattaaattgcaacaggtattgtcaatagctaaactgctcattgacagtgcattgctaattgcattgagagaacatcctaactgggtatattctgccaaatcaaatcggaaacattggctgtctaccagcaaattcattttgacttgcacagagtttggggatccacagatccctcaccaatctcaaaatactgtgtttatggaaacgctaattattatttttttttttgctgaggttctttgcagagaaggggaattctgatcatcttcactgactgctaagccaggagtcagaaactgtgcctttggaagggagagaactacagatttggggtggagtaaagttcaatgcaagggggtcatttggggaggtgggccatcaggttctttatctgtaaatctaagccatatccttggatccattttttttttccttctctcctttttcatccccttctctctcttctataggtacatgggagggggacaagggtggagacacttaatttttattaagcactgttcgtggtattttatgtgaattaatttgtttacttcccacaatgaccctggggagcagatatgctatcaggtaaaaaaactaaggcacagagagggtaaaactcttcgaaagagtcttgtggttagtcagcttctgtgagagtgagagtgggctgccctgaggccatctgttccctctccccagctgatatttttgtgctctcagggtaaacatttaagcctgtgagttaaactcagccttggactagctgagttcctctggaggccttgcaagtagcagtttggttggcagggcaattaagtatgctaggtgcactgtgctgaaccccaggagggagggaaggaatggaatctagtctttgcttgcgttatacatgcttattggtttgtggcaggcgtgattgatgccagaatcaaaatgacttaaagcagcttcccttgagaagcactactctaacggttttttttcctctttgttgccctaggtcccttgtgaataggatttagctctgattcagctgctgctgttcttttggtaatcagtgtggaggaaggagatgagggctgctattaatggcttcttattttgcattctcctaatcagatatcctgcagttattagtgtgaatgcaagatgttcggtggtgtccctgggtggttttcttaggtgtactggactgttagctttctaagatggaatgttttattaggttctggcctagggggttggttagatgggtggaggttgttaaaaagcactaaagaaaaggaataggatataaaaccaatcttcagggggtgggaataacaacccaccaccttcacttccctcccctcctgccctgaaaaccttatcttgctaatacccttcagatattaaaagtgaaataacagagctatttactaggcagctaaatgcaaattctctcccccattagttttaattaggatgaaatcatacatttaaataaccacttctattactaataactgaacttctgattcactctgaacccaggcaaatgcctcttctggtatgaatggcccacctctgagtcattccgcacctgcatattgacacagccaggctcctgatgtgggtacacacatctgggatttaagggcatgactggcatgttgaatcttgggtataaagctttctgcactataccctggggacaaacaggatagctcaactggagaataaagagcttgcaagctcaaaagaaaacaacaaccaaaaatacctcaaccaaattctgctcttgcttctatcctactgtttctttaggtgtttaaagggctgtagttttaaaaatctcccacccacctcatctttttaagtaaatgtcacaacagtactatgtcaatacagttgaaaataagtatttgagttgaaagaattggctctttgaggctttaactatcagatttgtgctaattctttactgtttccttgacatagtatatgcagtctgtgctaagagagtatggatgttgtcgtcggtgtatagaatggtggctgttgtaaacttctgtatgttggggaaggattgaacctgctgtctggagaattagaaaccagcagcttgacttaaatccctcagtgtcacaaccagctaatgaaggagaggactgctaaactcccagtggtctttgtggctacgaggacttactcaagtttgagactatctttagtgggccaatgacgtaggaacacaatcagcagaggacatgtagtttacagcagcctgtaatgtgccagagacatgactagctgcctctttggccctggggaagtgtgtctggccctgcttgcatcctctgtgagtgggaattgtgccagacaccagctagacatgaccagctgcttcttcgatgttctgtggacatgattggctgtagcttttgatcaggacagtgttcctaatgaagtgtgaccagcgtcatttagacaggaaagaatgacagctgatgtgcaagaatttttcttgattggcagcatttggaactagtaaccagagaaggtaggtggggggaggagaagccagctctgattgacaagagcttatctttatttaatctacttctgaggcactgaagttgaaatcttaggcaagtgaaagaaaggaagacacaattgtgaaacataattaaagattcttgacaaaaacatacttaaatcagaaatgtcttttttttttcttttttgagatggaggtttgctcttgttgcccaggctggagtgcaatggtgtgatcttggctcactgcaacctccacctcccgggttcaaggaattctcctgcctcagcctcccaaggagctgggattacaggcgcctgccaccatgcctggctaatttttttgtatttttaatagagacggactttcaccatgttaggctggtctcaaacccctgaccttaggtaatctgcccgcctcggcctcccaaggtgctgggattataggcatgagccactgcgcccggccagaaatgtctttcaataggagagcaatgcagagtttaggtgtgaggttatcactgctccttcggctatgagaaagagcttttgcccagggattgttaatttttaggcaaaatttaaagtggcgatgggcttggatagttctagcaataaaaaaagttctgcttctagttaccatcttgttgactttccaacctacttggaaagatttcctttggagaggccaaaaacaagtgctgtgtatggagtgtggcctgtggtggtaatttctcatcaactcttgatccactgaggatttaaatcttaagtcttcatgtgctttgagaaaagatgacaagcggaaatagtatgtttgtttcctaaggacacacatgtgatttctgagagctgattgtatgcaatgtggtggtattcttttgcaaataggcttgggaacttggcatcctggattcgaatctgggcaccaccattttccagctcattccttcttattcaactccaccccacctcgaaccccgatttggttttaaagattcacatactattgttttagtaattacccttgaaataaagtcacatatacttttaagtctaaagttaatccaggacaggtgcggtggctcacacccataatcccagtactttgggaggccaagttgggcggattgcttgagcccaggagttcgagaccagcctgggcaatgtggcgaaaccctgcctctactaaaaataaaaaaattagctgggtgtggtggcatgcacctgtattcctagctacttgggaggctgaggcaggaggatggattgagcctggaaggcagaggttgcagtgagccatgatggcaccactgtactccagcctgagcagcagagcaaaaccctgtcttaaaaaaaaaaaaaaatccatagcctaaccaccttggataatacaagtgactaccctatatctgatcatactgccaccccaacctaaatccagtatttgttttgccttttttttttttgagacagggcctccctctgtcactcaggttgaagttcagtggtgcgatattggctcactgcagcctcaacttcacaggcttaagtgatcctccccacttagcctcctaagtattaggcatgaagcaccacgcttggctaatttaaaaaatttctatttttgtagagacagggtctccctatgttgcccaggctggtgttgaattcctgggctaaagtgatcctttccacctcagcctctgaaagtgctgggattataggcataagccactggtgcccagcctattttacctttttttttttttttttttgaggggggagggcagatggtcttttagatttacctatgtatttgacaatttgtttgttcatatttctttcttgtgtctcagaccttccttcaggtttgacttttctttagaatttccttgagcgagtgcctattggtagtaaatgctcttttttgtttatcatagatgtctttcttttgcccttcatctcaaaaggtagttagctggatacacagttctagggggaaagattttcttctctttgagtcttgtaggtttgttgtgaagattacctgggttcatatctaaagcccttagcactatgcttggcatgtttgctctgtaaataacagtggctgttacattctcagaaaaatactggaacagttggaggcaatgcaggcttggttgggatgtccatactttgactaactttttacattattttcttaaaactttgatttcattgagattggggtgggagtacatttaagcatcaaaactaactttgaagatagatttgattgaactgtgagttctatcactcgctagttgtatatacctttggtagattatcttacctgtcctaagaatcagtttcttcatctatacagtgatcattgtaatacttcctatttctctgagttgctgggaaggttgcatgagaacacatttaaagctcttctccaagcctcacatagtaggtggctagttgtggtaattatttgttgcctgtaaaccacttttatgacttttatgtagagatgttaccaacttgtcttttttattgttgttgttctagctattctgtttttatttgctcttccccagatccacagaaaagatggggtatctcctgcacaattaactttctactctactgatggggaaggccttctgcagagttggtggctcttgcttggaggcaacactttgatgcttgtctttaggtgggaaagtagctttccaggcccagtactttgctacttgtaagactctcacttacctgaaaattgtttgctctggtttttcttgtgactttgggcaagttacctaacctctcagtgcctcagtttcctcatctgtaatatgggaataataatagttccttcctcacagggttgttgtaaagactagatgggttgacacacatgaagacctgagagcatgcatgacacagaggatgtgcttagtactttagcgttcatcagtgttgtcagtagccagggcttccttctgtaccatattgttgactttcagaataaaaaatacattgtttgctatgactttgtcccagggcgtgtgtattaagcttccacatataatttatatcacttattccttaataacattgtcatgggttagatgggacatgtatttttttcaactttattttttacatacaataaagtgcatcgatttttaagtgtacagttttatgactttgagctacagtcaccactgctatcaagatataggatatttctgtcaccgtaaaaattcccttatctctttcccagtcagtctgtcattcttacatttggccccaggcaaccactgatctgcttcctgtcattatagagttttcttatttagagttttatataaatggaattacattttacacactctcttatgtctggcctattcactcagcataattattttaaattttatctacctacctgcatagtacctatattttgagataggatcttgctctgtcacccaagctggagtacagtagaacgatcatagctcactataacttggaactcctgggctcaagcaacttctcccatctcagcctcctgagtagctgggactgtaggcatgtgccaccttgctaggctaattaacatttttttttttggtagagactgggtgtagctgtgtttctcaggctggttttgaactcctagtgttaattgaggcctcagcctctcaaagtactgggattataggcatgaaccaccacgcctggccagcgtaattattctgaggttcattcatgttggcatgtatcaggaggctggtcatttttcttgctctgtggtattccactgttgaatgtactacagtgtgtttagccgttctgctggcgatggcttttgggttgtttccaatttggggctgctataagtgagctgctatgaacatttatgtacaaatctttgtgcagctatgttttcatctattttgagtaaatatctaggagtagaacttctgcatcttaaggaatatgtatttttaacccccttttactgatcaggaggaacttagagggttggaactgaccaaggtctcacagccagaaaggtgtcaagcatggaccaacatttgatactccttttctgtttcctcttcaggagtcattctattagaccagtgatttcacacttttagagcaccaagactctttttaaaataaaatactgtaggtccaggtgtgatggctcatgcctgtaatcttagcactttgggaggctgaggtaggagtattgcttgagctcaggacttggataccagtctggactacaaatcaagactccccacactacaaaaaaaaaaaaaaaaattagccgatgtggtggcatatgcctgtagtccctgttatctggggatgctgaggatcacttgagcccaggaggtgaaggctgcagtgagctataatcacaccgctgcactccagcctaggtgacagagtgagaccttatctctaaaaaataaaagataaaatattgcttagaatttctataaacaagctacacaaaagcactgtaaacaggctccttagaaagttcagtcacttttttgctgttatcctgttgtgcacccaagtgcttctcaaggaatgtcttttttgcaaagtgctgcagtccatttggctgcttcttgagaggagagtcgtggaccccctgaggcctagttcttaaacatctcttcttagtccccattgcattagttgtttcagaacaggtcattgagcatttcgcctttgcattttggtggttcagagagtaagaaactctttctccggctgaccaaaaaaccacctctccctacgcctcgtgtatagattgggctgtacaactggtgagaatagtaacatcaccatccctgttgctataaatcactgctggtgatatagctccttgatccaaagggtacttcgggggatgtagggccagataggtacattcaaactcagactatttacctttgtcacctggtaatatttacagatggagcagatgccagtatgttccattgccctattctggagtagtgattctcattttatgttatcagagcctagcttatgaaatttgaaatgcacttttgcctcctttgcactgttaccactgcatcagagcattttaatcagcttgctttcgttgaagtgtacaatttttcttctcattacgtctgcaagctctcaagtttacagacatgatctccttggctagactaatattacttggccattcttgcatgcaaatttaaaatttaatatcttgctgcaggtctgttgagttttatgcaaattccaatatagattatattttggagctgtaaattagaaattacatttgggggaagtaatatttgtgtgggtttaaaaaaagtaatcttgcagtttgtatggtacatggcatttcttctgaagaaacgggattttgagtattctgtgtgggtttagtagatgtcttgccaattgtgttactgataatgaaaatacaaaaacaatgccagtatgtacattaaatttttttccttaggagacaaagtctcactcttttgcccaggctgaaatgcaggagcacgatcatagctcactgcagccttgagctcctgggctcaagtgatcctcctgcctcaacttcttgagtggctgaaactacaggcgtgcctcgctaattaaaagaatttttttttttttaatttagagacacggtctccctatgttaccaaggctgatcttgaaatcctggcctcaagcaatcctcctgccctagcctcccaaagtactgggattatagggcatgaatcactgtgcctggcctacatcaacattttttatgacatttggctgctttttctaagttatttgggattaactgtgttctctcatttattaattcattgagtatatggttatggatgcttgataggctctcctcttggctttgatgatacagcaacaaacaaaacaggctctgtgctcatgaaacttaccttctacttgggagaaacagacttcaagcaaataaacaccaagtaaatatttggtatctctgatggtgatacattctgtggagggaaataattcagggtgtaggaataaaggtgtgctgagatggaggtgctagtcatcaggaaagacctctctaaggttacctttatgcaaagacttgaagagggaatggaatgagctgcgcaactcttcttaggagaacattagtctgggtggagacactgcaaggtacaagtgtcctaagtgggtgctcttgccgtgtttgaggagtagcaaggacgtcagcctgactagagcagagagggaggtagaaatagggcagaggaggggtagcagatgatggagaggtgtcacaggtcatataggaccttgtaggtactataaggactttggcctgtgctctgaatgaggtggggcactgtgggcgagggctgtattaggtaagaagactctgaccattgtgttgagaatggagtttgtggggggaaactcagatctttggatgatgggcatgggacaccatcatcagccattgcaggtgtggaccttggatgctgcctgcctaaggctggtgaccaaaaagaaggtagagttggatacaagagcctggcattgttggcatttttgtgtttgagtgtcggaaagatcgtggcagaagcctaagtatctgtgttgcttgggcctagcatctgtgttttcacaaatcccccaggtgatttgatgcctctttaaaacacagaatgttgggccctacccaaagggtttctgattcaggaggtttagggcagggcccaagaatttgcattatttacaaatgtcaaggcgatgccagccagtgctgctggtcagggaccacgctttgagaaccactgctctggtgaatgggtattgctgtgttgttatctgcaaagttacctttgtgtacttctgctttacaaaataggatgtagcttgaactctgagtcaaactgccatttactgtggtatgaccttggatatggcatatacagtgattcctcacacatggtgttaataagttcttagtaaatgctggctatttgaatatggtatgtaggtataaaatgatgtggtggaggtaaaatatgaataatttgctgaatataagctctggactgtggacattataaacaagatcttgttttgttttcagcatgacatgaaaggttcattagctttgttttacacatagggaagtggcttattcatgatcacgcaactagaagtagcaacggtagatttcaaattcagttctttctggcttcaaagcctgagatttgccaccaccgcatgagctgcttggagtactggattggctctcccacagtttttgtcattgtgtgtgtgtatgtgtgtgtgtgtatatgtatgtgtgtgacagacagagagaaggagaggggtgtgtgtgtgtgtgtgtgtgtgtgtgtgtgtatgagagagagagagaaagtgtgccagaaattatttgcgtacgttttaaaatctctgttaggccattttttaaatctgtaaaatgggcatgaagcatgcagagttcatagggtttctttgctgagtagaatatgggatggcttagcattgtattttttttccttttctaattaaaaaaatttcaaagccaaatcgaatctagatagaataaatttatggattttttctttagggttccttattagaatggattcttcctaatatgaaacttgagttattgaattttgtgtggagaggatgcttctcattagggtctcagtttgggaagaagagattatgttccctttaaaaacagcttactgtgtttgcaattttagatttcttatctcaggaagttcacatactgttaggataaaactttcctagataaggcatctgtacaaaggaatgaagtatatgggaaactgcgtgtgtggggagaccatatctttaatttttgaaagggctagggtagcctggtggtttggaaaaattaaaagtattgcataaaagtcaaatgtaatagcaattattgttagtgttgtaaacttccacttatccacaaatcagatgggtggcagtctctttatcttaagttctggttataaaattgaaaaagccattgattaacaaatagctgtcacaaagctggaactttcatagtaacagtttctggtgaagcttcccttgatccctgactcaatcagctaggtagagataaaagagaaattttgtattctgaagatgtacagacaattataaggaactctggttgactgcagggggaagagacacaatagctattaaaataaaagtatgacagttgggctaaacaggcagcctcaaacatcctaggagtccctgagggcaacactgtatgtagtgactcaggttcttagaggaaagtgggtcatcaacaagaagcatacaggcttgtttttggtatctttataagaatagagggaaataatgagtgtgtcagagagctcttgtcaagtttagtttcaataaaacaatttgcttaggggtaagtttatttgggaaaataaatcactgataacagcataaatactgtgttcctcagtgatgagattagatgagtagggaggtagtggggtgaggtagaaggagcatggacttggacacagatacttgattagaagcagaatcaccttagatatctctgcgccccagcttctctgtctataaattgggaataatacctgaagaggtcattgtcaggattgaatgagatgatgtaagcagtgcaccttgcccagggcttaataaatagtgatgagactggtagatttctctgtgagggggcttcaggatatacctcccttatacagacttctattcctttgagtccaccgccccccacaacatctttatgaactgtaatgtatctcatactgtacaagtcacccatttaaagtgtacacttcagtggcttttagatttacagagttgtgcaaccactaccacagtcagttttagaaaatgttcatctcctcgaaaagaaatctgtaccctttagttatcattactttattccctcatcctcttcctcatcagatgttgtaggcaccacctttcttcccttccttcccttatcttcttttcagctgtggactgtgctgatttgcctgttgctggatcatgtgattgaaattctttgaatttttctgtaaatagccaatttagctttttcccttccagagtatttgtttctttgggtgtggaagcagctgctgcagccagtgcaagggctcaccattttgcgctttgcggctgttcatatggcaactttattcaaaaccgctcctgcactgcttaagttatttgttttatacaaaaacagttctcgctggcttgcggcttctctgctgccatgttgacaaatgttgcttctagtgaaatacacaaaaataaataacagcaagggagaggggagcacagagctaagtgaattcattttgcctcttgagtgccattctcatttgttttaaaaaccaccctggcacagacagaaaaggagaaggcagagaaccgcaggaaaagaaaaggccacatttgattctttgaattgggctgtaggggctggctgaacagacaacttgagaagtatctggaatgtaggccctggggatgaggaaaagtttacaaggaatctgaataacctgcagatattcatattgcaacagcccccatttacatagtcttcagagttcatttggtatgttctcttgttttctcgttctgttgatgacgagactcaaatttaagcactgctggtgtagtagtacatgaccatggttggtttctgtcagtgtggtaggttgtgtattaggaactggaaaaaggcaaaagcgtaagggtgtgtgggttctcaagtttcgatttgaaggtctgacccacatgagaaggtggagggaatgctgacaaatattgattgcctttctgagccaagtatttccacaaatactatgttattagtattattattatattaagatatattagtattatactattatattagtatatattagtattattagtagtattatattagtatattagtattattatttgtatataacaaatactatgttagtagtagtagtagtagtagtagtagtagcagtagtagtagtagttttcagagagagggtctcccaggctggagtgcagtggtgagatcataactcactgtagcctcaaactcttgggcttaagtgatcctcctcacttagcctcccaagtagctagacccacaggcatgagccaccatactcagctaatttttagattttttgtaaagatctgggccttacaaagtgctgggtttataggcatgagccaccaggcctgacttcagaaacattgtttcattggttagcatgacaaaggttggtggtcttagcttcatttcacagactagggaggacagagttttgaggaattgtggtacttacttgccaaaggtcttactgaaattaggggagtggaatgaaatggaaaccccgtgcttccagacctagaacttgttccttttctatattagtagtaagccatcagaggtatggaagaagaaaaggagaagggcattggaaaataaggagggataacagcaagcagtagaggccaaaaacattttgtttagaaaaattgtacatcttctttgaaggtttttgttcattaaaaatcaccaggaaaacgaaagtgacttgcaagtccacaagaaactttgttttgggtgtgtgagttaagaatgatcacctgaccaattattattgactagaaaaacatttccctgagcctttcataaattatcttaatgtgcatattgttgaggcagtgtctgataaataacagcctaattggccacccagggtctgagaggtttgcttagccacaactagcctttcattctgggtctggcagattgatttctttccatttgttgcatgattttcaatgctatttatgacctaaatattctgttcaaaatattttttttttggtctattgctaatagtagatgcctctagggagaagaggagagaagcaagagtgaggtgacagggacttacttttccttatattctccttggtactttttgaattttgttccgtgtactattccatatgatggaaaggaggtaagtgtatttaggcaggtggaaggtaagaagggtagatgaaaggatgaattattgacctgaacttcaggcctttattcatcagtggtttagcctgtgggattgtttctcagcatataaacttcttcagttatgtagacatataatagttacttgttcgatttattgcatctgcaaaggtatggccaggtgtcatcatgaggaagtatagtagtatagtgtttaggcttaaaagattctgaaacctagacttcctgggttgtaatcctttctctaccacttagtggctgaacgtgaccttggatcttactttatctagcatttttgtgtctcggatagcttgtagttaaaatagtagttataacaaaacttgtggaattggaaggattacatatattacttaatccacatgaagttcttataatagtgcccaatacacagtactcactaaaagttaaatttttttttgatgactattatcacagatggtgatttgcctcatccatctctctgtcccttaatgtggtccaaaatccaccccccgccccacacccggccttaatgcccagacagtgcccctgtactgactaaggagcctttcttttgagttcactggtctggcactggctcctagaagtgctgttttccagtgacagcaggatatttggaccactgggagagtcagtgggctggggtgggcccttgctctctgcagaggtgttctttctcccagtgggaggaaacaccacttgtcagaacacagctttggcttgcccaggttcctgttgtgcagatggggcctagagtctctctgggccccttgtcatggatccaagccaaggctgtcgcttgctgagccaggaataatataggaattagtctttttcttctttatactaagcactaatcaatctacagttaactctgtatctaatttctgaaccagatgccgtgaataactgcccctgaatgtgtttttgccaataaaaggataagtttaaggcttttaatcaatgccgcttgcactcagtatttaaggtcagaatcttgtgtgcgacttattttgatcaggataattgttgggttaaaaaatgaacggtttttgaaattgtgacactcgcggttgactcgtgggtgaattaatctttgagaggatggaaaattgtcgagttcataagagttctcttgctctctagttgtctttcaggtcacttatggaaaaatatgacttttaggaggaaggcattctttttcaatgggaaaggagataagagactaatagaaatttctaaggagtcagtgatggaggctcaggggaaattggaaatgaagctgggtgttttggatctgcggtgagctgagggactggaacagcagctgtgtatgttctaggtaatattaacttgttgtaattttatgtctccagcatacctttttcaaaggaactcatgtttcctgaccaacgactgtgtactgtctagaatgaagcatagtgtttagaaacatctggggtttagatattggcttcactgaatggcctagggcaagtcactgagcctctgtgccctcagtttttataattataaaatgggatggtaatagctacctcgcagttggaaaacttaaatgtgatcatgtatgtgagaatgtgaagtgcagtgcctggcacacaagaggtgctgaaaggagcatctccttttacttctttgtggagtttgtttggctggtctgctggtctgtcatacatttgtctggtgtgcctctagatacacgtaatgtggaaatttccctaccttgtaacagtgagttggaaattgttcctgttgatctgtttttttttttcttttgtgcttagggaaaggcatgagaaaaatgagtcaggatgccctccatttctggagaagcttggtggtaattctgttccccagtggctcacaagcctgggcagttcagagaatatgagaattggtagatcatggagaactaggctctgcccctttggctatgcgggagttacttagtcttcctgaagtttcctgtccatgaaaaggggatgtgtgagggtgcaatatgggtaatgtttgtgaacaacctttgttagtgtcaggaaagtccaaaactatgtggtgtggtattttcatcatcttgagttgacaacagtgcttatccaaaagtcaattttggtattttgtcaaatgttaaaggctcaggaaataacttccaactcaaggaagatttgtatccactctggagctggaggagcttatattaagaatgtaagatacttgggctcccaggatttctggaagagctggcagtctccctgaggttcaggttctcagaccagcaggccatgcatgggggcttgtgattaagctggtgccgaacattgctgaattatataggtctttctgtgctacaggttggttttctgctgttcacatgtagtctaacagtggcctgttttcctttgcctcaactgtgacatcccctcgaagtgacctttatgaaggcagagcttggatctgccttgcttcttgctgcctactgtgtggttttgtgcagagtgctcctttccctcctctggtgtcttcacaggtgactcaactggaagaggaggttaaagaaggtcgggttaccaagcacctctcttcatgcctcagccaatccaggccccaacactgtgtgggaagaggtgttcatctgttgagaaggggtggggacaacatatgttacatacagaggctccaaggtggttttgatgagcatagagtatagtgggagaaggagcaaaggatggtttgggaggtaggaagtaaaagtttcagctagagctgactgtcaaaggccttttctgtctttagacttttactctgtaagatacagggatttgtatgtgaggcttttgactttaactctgttggaatagggatttgttgcaggctgttaagtagggaggatggtatgagagatgcattttcaggggtttcatttgctcatggcatggtagaagatgaagggtggatggtgagtagagtagaaataggaacacagaagactgctgcagtatttcagatggggattgtgtggggcctatttaggtcatctccagtgcaggtgcccaggagaagttacagtagatactgttgtacttgtaaaggaaaatgacattcgagttcctgttttgtgccaggaactttaagtaatctgcatatcttagctcatctcattctcaaaacagcaacaagcggaaggtgttatttctcaccgtttttcaaataaagaaacttaggtttagagcataagtaatttgtttgccatccctggacagctcctaaattgcagggttgaggttaatacctgattacatccaactccaagtcctttctgttcgcattacaccacactgtggccctcaggacacagcctcatgtagtgattttgcattagcaaataactttgtaaggactagtctgttaatagtgatctctttcaacattcccatgagatgagggagcacaattaattgttcagctgagggattagagatataaggaggttaagtgacttgacgaggtcacccatcaagtggtttggggcggacaggcagaggtgagtgaggcttggagctggccattttgagacagtggccttatcgagaacaagaattttccagcctcattttataaatccaggcttctagttctatagactagggaaactatcatggaaatggtatgcaaggcaagtgcctgaggctgagatggcacaaagcaccgtggtatcttggggttactttataatcaaactctctcttctagcatagtctttaattaaaacaacaatcatctccaccaaaaactaatcatctttattaagcatacagattggaggaagagtggggagtcttgtgtctgagaaagatctcaccaataaattgtttcctttgccataataattgtgttgctgagtttaataattagaattctcactctacgcttcctttttctgtttgattttacgggtctgacatcgctgttgtttttcctgggaatacttgaggtgtcacaaagagcaacattatgatgagagccatgggaaacacttgctaattacagtatattgtgcccctgttccttatctatcagtctctattggttattattactcatttaatttttatttttgagagatgaatgcacagggcagaataggtcctgagaatgaatctagagctttgcctttgacttggatggacactttgggcatgtacgggtcaagaaatagatgattgggtatcttgtggtaggagctagaggaactattaatacatttgggagtggggagtgaaggccatggactgaaaagatgccgaactacaaacctgaatgattttatagtttgctaatggttatccctggatgccatgcaccatcatgatttaactgagccttgcaaacagggacgatacttttcctaaccccctgccatctactgctttctcaccagaggtcacagggcaaagacaagtaacactggcattgtgcatgtgtgacaggtaactgtaggtagtaaagtggccacctgtaccattgcaaccctgtgtaatagtctagtgaagtgatctgctttctgcagtcaggatgccaaatacggtggagaaggaagtgacagtcatttacagtgtcatgtttagtcttttgcagatgtgcttacagttttaacaaaggcggagaagaaattatagggtgggaaagaaatgcctacagacaggctgctaaagcctaagaaggaggaaactagtatttgtgtgttttaggaatgctaagcccttgcttacatatcagcaagcaaaatattggcattcacttctgacttgaggaaggcatctctgaagtcaatagaaggaaatgcctaaacacaggcctcactcagaaagaaaggagagctgtggaaatactcaggattatctcataaaagctctttgtgtatttgaagcctctaatgaaatcagccttgttctccaggccagacaactccagttgttcttacctttctttattgtatcttttttttttcatttcttttatgcttttgtcatctcttgaaatttcttttctttgaataataccaataaaaattgaactttttgcctgaatgcagggatgacttgctagtaactaccagtttttatcagaaagcagagtgggatgctcagtgatgttgttgatggtgaggatgtccaaatcttctttttatatgctagctccattgtctgctgcatttacctgtttgtagcgttggtgcgtggaacattggggcatataaatgtttattgaattagtgaatgaagatatactgaattttttccttaaaaagtcagtatttgctttgggtcaataaagaaaccctttattttgctttttcttcataaacaccaaaatcctaggaaatattggttttactttgccacagcactctgcagcttgtacagacttttccagagatgaaaaattctttctcacttctgtattagtccttcgctttatcctctgattcctccttccttccttcccttttctgccttcctctcacccattcatgtattcattaattcagtaaatgcttcttcaacctctgctataagcactattttaagttctagggatattgttataagccaaataatgtctctgctttcatgaagcttatatttgggtggtgggtcaaggaacatgattgatcagaagaagttagatttccctgttgggacaaggctttcagagaagtaagtggttgtataggtagtagagataaaaggattgctccctgtgagggacttgctggcaggataggctgtgatttcactttattttctatttacataacaatctgaatcccaatatagtgtttaacctgatatgtaagattctgtttgggcagggttttgtcagttatcatttatatctcctttcttgaaattagatcagattcctttgatttatttggagagaaaaatgggcaatacacaatgtgtttctgctgaatattttgctatgatgttgacacagtaatgtacactttattttgattttagtgtgttttatttaaacattccattattcagaaattgttaccccctccttgttattactgtttgcctgcagttatttagaaagcagtttaattaatgttcttttaccgccccctgcttcagtatgagtttcaacacttttaatacaaagtgttcatatcactgtatgaacttactaaaacccaggacagtgatattcattcattcattgctttatccagcaaatgtgcaatacaaaaaaagatacatgcttcctctctacacatttcagtctaatatgaactgtttggttgaaatacagaaacataacatgcaattctctgggataaacgtttcactaaataaacagcagtgagaattctgaagatacacttaactaggtcagcctaggcttatcagagaaggcttcacagcataggcgatctttgatctggttcttgaagggtaaggatgtgttttccccccagggaccagttgagaaatagctagaattaattagttctgctgtaatcattgaggtgctgatcctagagtgtggcttccactgcagtactggatgtggggatgatgatctcattgcaaacacagcctgggtgggtgtttttggttttgttttaaggattctgaagcagcatatacacaaggttgacctcaggacctctttagttggttgctgctgctgttcacaatagatttagattggatagggcttcagttttcttactgttgcattccagcattttggatcagtcactttattacatcatttactttctggcttaggcttagttgttattaagtgaatcagggataaaccttaggctactctcctgcttcctttttcaaatgatccggagtaaataaaacaactacatctctttcgtcactgtgtttcgttcccatctcagaacgggtaaaatggccaatattttcagtgaaaatgtattgaaatgcatttcactgaaagaaatgttcacattcagtgaaatgtatctaaactctaaaaagagtctagaaaagctcattgacacatttgttacttgctgaaagccccagtgaattttccaacctccgtattgtccttaaaaattgccttttagttcttaaggtggtggaggtgtgtttttttcttcccccttaaaccctcttctgagcaatctttgcagagacacctggtgagagagtaggcccttctgctttgtgtgccctctagtaagagatgatcatcagcagctttatatcctaatgtagaaaatgtgctgtgctagatcatttcaacccagcaactcacctcttcatgcctaatgcctggagctagggccttgtttctctctacattagacaaaaaataaataaataaatgtgggtgaggataataataattatgatggcaggaacacttattgagtaagcaagtgtttgcttatttaatctacctgacaaccctaccagatgtaggtactgttattttctccatttggtggataagaaaactgagtcacagagagactcggtaatttgcccaaggtcagacagctgtctgcccggggaacctatacacttaattgctctgctgtactgtggttgagtatctcttatccgaattgcttgggaccagaagtggttcaggtttttgattttttttttccgagtttgaaacatctgtatctacataatgggatatcttggtggtgggacttaagtctaaacacaaaattcatttatgcctcatacacgtagctggaaggtaattttataaaatacctttaatgattttgtgtgtgaaacaaagttttgactgtgttttgactgcagctgctcatgtgagtccagtgtagaatttttcacttgtggtatcataaaagtttcagattttggagcatttcagacttcagattttcggattagggttgtgcaacctgtacttcatgagccaattgagaaaaatgccttcataatttctttctagggcctcaaacgcctggacgtcacccctgactattgcatgttgtgcattggacagttagatctcctcagtgcctgtgaacaagtgttcttttgagtgatactcttctttttgtgactgtattatataatatagctttcatagcccccactttatttgctgttattttattcccctctcatccccgcccccccccccccccccccatataaaggactcatttcaaagatgggcgaacctggaagctgaacctgactctactcttcatgtcttcaatttactggccataaaggttcagttttgtatgggatcttctgtcctctagaagatcccgtacaaatagaggctttaatttatgcttgcattcttgcattttgtgtgatttattgcctaataaatgaaagaaaaaagtttatttagatagtaaactgaaaatgaaaaaccatttttttccacgaacttgctaattttcttccattgtatagtatgaactcaatctacaaagatctggcaaaaaaaacaagtatcatgttctgtaacaaactcagttacactaacaccagaacttactgagtttaattggagataattaaaaaaaaaaagttctttttttctttttttttttttttttaaatagagatagggttttccatgttgacctggccgatctcaaactcctggcctcaagcgatcctcccatctcagcctcccaatgtgctaggattgcaggtgtgagtcatcgcacctggcctcttaatgtagatgattttttaaaatgaagatttttttcatagtaagaaaagggaaaccataattccagaccacagagaaggacttctttaatatatttaacctctttatttacagatcacttctttctagagagactaaaattagggcagagaaacctaaatcctacatacaaagagctgctgcccattcaaaataattacaagtgtgtcgggcgcggtggctcacgcctgtaatcctagcactttgggaggccaaggcagtggatcatgaggtcaggagtttgagaccagcctgaccaacatggtgaaaccccgtctctactaaaaatacaaaaattagctgggcgtggtggcacaagtctgtaatcccagctactcaggaggctgaggcaggagaatgcttgaacttgggaggtggaggttgcagtgagccgagatcgtgccactgcactccagcctgggcaagagagcaagactccgtctcaaaaaataataataataattataagtgacagtaaagcatctccccacataatcctgtatatcagtaagaaaatatgttttgagattcacaaaactcaatttacgaatctctggttgtagttatttgacttaatatataagacacttaccagaggagatggttgcaaacagatttgatgacaggtaaatttttctaaaggtctgctaacttcttattcagtcatggccaaccactgatacaatgctgagagttgctttctcctttcccctctactagcttggggtccacagaccaaaaaaatctataacttgcaaggctaataaatgcatgcttcagctgcctggaaatgctgttggactggcaatttgctgccccgctctaatagagactgcctcagatctggtctttaacctggattagctggataaagagaatcctctgggatcctgtgtgccatcacctgttagtgtgtttgctgtataaatgtaacatccactaactttgtcagatgatgtctggcctggctgctgtggctgtgattggaattgaaacatacagcttgttattaaggtagtgactggctgtgggggacaccgacgtctgttgtttttcattgttgatctagtgagttagaatgcctttcctgggctgttaatgttaaatagttcagtcctgttagtcgttttgtgagatcatctttctgtgtgatttgtgtgtatttccttgatctagtggggtgcagggtcagggactgaggggaaggtataattgtttacagaaaatgtgacaggacatggatttgaaatcagataggaagttaaggaatgccgggctcctctgaatattaaggaaaatctttaagcccctaattaacttcagaaaatccccttgctctcacagatgggaatttggctgggtaagctaataactggaatgaaggctaggagttgtgggttaagtttctccctggcaaataccaatatttcaggattacttcgactcttgtcctgctgcctcccactggatctttacaaactctgtgcagtagagattatcttgataaagattttggatgcatgttgggcctttattgaatgatgaatgctgttttttattcatttgcacatttattgggtacctactatatgtcagcctctgttcttggtcttgtatggtggtatacaagagaaacaaaattcttagccttatggaatttatatcctagtggactataaattacaatgttcactatttgagaggacccaagcttcagatgttgtggctgtttggcacactggtccgggttgaaagaagagactgggattcaagttgtagttcctgtcctgatttctctgggcctgagtttaactaccggtaacataatgacattgggctgtatctaattatttatagggttctttccagttctttcacttatgatcctgattttcccaaacattttagccaagttgtctttttttttttttttttttttttttttttttgagatggggtatcacccagtcacccaggttggagtgcaatggcactatctcggttcactgcagcctctgcctccctggctccagtgatccttccacctcagcctcccaggtagctgggaccacaggtatgtgccaccacgcctggctaatttttttgtgtttttgatagagatggggttttgccatgttgcccaagctggtctcaaacttctaagctcaagccatctgcccgcttcggcctcccaaagtgctgggatttcaggtgcgagccattatgcctaaacagcccagttgtctttaatctagttgggcttctggctaattcgtgttggtgaccaatgtttgcatattaaatcaaacaatcagttattgtactggagaagaaaataattgtttctaaaaagttcatatttcgactacatggtcatgccatttaaaaaaaagtagtaaagcaacaataaggaaatactcttttattctggaatgacatacctacctgaaatctttgagtttcccttgtgtcatgtgagctggttgattacaggtgaggagaattgcatgttcttacatgctcctcagaaacactcatcactgtgtaaaaaatgcttttttgtttgtgtgaaatcataatatagagcccattccaccatacaccttcatcatcaagctcggggatacaagcctgttaatcaagtgggaatacaggaagtgagacatgaaacactggttttattttcacacctctaaatgagtgactgcagaggatgaacttaaaaataataatgccacctcatacttgcatcacaccttttaataaggcggtttaaaaatatttagggtgaaccttcatcaggatgctttaattgcctcagcatagttgaatagtacattagggtaatgcctctgctgtgctgaaaagcctggagggagatactgtcactcaatgatgcgttgaggatgattaggtagaaccccttcagatcttgggatctcagtttcctctcaaatgcatgctgtgggtagagaagcctgggctggtgtgtgtataatttacatctgttataagtgactaaacttgtaagaacgggtacacaaggcatctttagtaagaagtaataatatctgccttagtaataatatcttctcattcttgtaggtccatttgaaatggctccatctctagtacatctttcctgactactcccacctggccatcatatcatctttctccattagatttcaggcagactagaccgagactgtgggtttttatcctgttagccacttagaggctgtttgatcttgggaagattacttgcttttctgtacaaagtatctttatttctgcatctgtaaagtgaagataagaatccctacttcatagggtgttagtgatatgagttagtaaacatgatgcccttagaacagtgcttggcatgtgctgctgtggttttgtcatcattattactccacttcttccttggtacatagctcatgttctccttaactatacggatgtatttagcgatctgccttaaattgtgatgtgttccttctggtctgagagcccttgtcacacataacatgataactttgacttggtaggtacctagtgagcatcttggattgagctcctacaggatttagttaagaattcaaagcagggtgtattctcattctgacttttaaagcctttgaggtcagttgggggcaggtcttatttgtttcttaactggtgaagctgccataccaaggccacttgcccatgatcgtctactgggtagcctgataagaaggtcagttactcaaggctgtggactcgattccattcttgctgatattactagcgtaaatgagatgcttttggataattctctgagcaatttaggccaggtgaatactggacagtaatttcctgaagtgccatgaagtggcaggaacatgatttatgtaacatgggctcttgctagctgggatgaacactggagcccctgccgtgctctggaattatgagtgcctgccagagtgcctgcctgcttttgttctagagagtttttttttttttctttttcctttaagttaaattctcaagttgcgggcaggggcgcaggtctctatggtgatgaatggagagatgttgaactggctggttgcaaaccttaccctagcagttcttagagacaactgggataaggacattttagctggttgacacttgggttgaaagtactgatgtaaaaaaaaaaagtgatgtgtgtatggggagggacatatacaaagaagtagtaccttggcattctagccagataaaggagatctgtgttttttaaggtaggagctttgagaaaaatgcaaaacttgtatatttcagcatgcagaaaattgcacttcactatcaggcaaacctcattcatattagcaagagaagtatatgagaagcatgtggttgtgggatgccattatcaggaagttgctgtgttcttgaccttgggctctggaagaacaattagccccttgcatgcaaacttgctcagtaaagaaaaagttttggccctaaggcctgtggaaccaggcttaggatggatgatgggtttattgtccttcacagccaaaacacaacagtctttctccctttctttccaggctacccacgtgagtacgttgataatatttctgagagttttaaagaattttccagcagaatgagagaagatagaaggaccatcttgataatttaaggacatgctcttatctcttgatctgctgcattttgtttttgcttctgtttaggccagtgttggtagttatattgtcttctctccactgggcggattacatgtagcaatccaaaattgtcaacataattattccacttcttctttggcacatagctcatgttctacttaactgtactaaattgtgatgggttccttctggtcaagagcccttatcacacctaacaggacacattggacatggtaggtacctagtgagcatcttggattgagttcctccagaatgttgttaagaattcaaagcgggtgtattctcattctgacttttaaagcctttgaggtcagatgggggcaggtctcatttgttttggattacatgtatgcaatccaaaagagttaggttttttaaaaaaattaattacccccaccccttttgttaaagagtcagggtctcactgtgttgcccaggttggtcttaaactcctggcctcaagtggtcctcctgccttgacctcccaaaatgttgggatcacaggcgtgagccactgcgttcagtctaatttttatttaaaatttaaaatttaaaatttgtggtatagtccgggcacggtggctcatgcctgtaatcctagcattttgggagtccgaagcgggaggattgcttgagctcaggagtttgagaccagcctgggcaacatggcaaaaccccatgtctacaaaaaatacaaagaaaaaaaattatctgggcatggtggcacgtgcctgtagtcccaggtactttcggggctgaggcaggaggatcgcttgagcccaggaggacaaggctgcagtgaggtgagatcatgccactgcattccagcctggctggcaaagtgagaccctgtctcaaaaaaagaattaaaatttgtggtacaatataaataacataaaatttaccatgtacagttcaacagtgttaactatatttacatcattgtgcaaccaatctccagaactctccgtcttgcaaaactgaaactgtctaccattaaataacaaccgcccattctctgttcttcttagcttcctggaaaccaccattctggtttttatctctatgaatttgattactctaagtatctcatataactggaatcatatagtgtttgtctttttgtgactagtttattttacttaacataccctcaaggttcattcatgttgtagtatgtatgtatcagtatgttcttcctttttaaggctaatattccattgtatgtgtataccacattttgcttattcattcattcctcagtctacatttgggttgcttccactcttggctgttacaaataatgctgccataaacatgggtgtgcaaatatgttcttgagaaccccctttaaattattttgaatatatacccaaagtggaattactggatcatatggtaattctatttttatttttttgagaaactaccgtactgttttccataagcagctagatttttaagaagtacatttaaattcatcgttttgggccttggtctccacgctgccttgagttgtccctaggtaagtgaagttctcagtcagtcacctgctctggcatacctctgagctttgacacacctcagccactttccatggctcactttggccctttgtaggttggtgcctctcattagattcaacgaacaatttctcaggatctgggcctaaccagtggtgttgaatcttagaaagactgagctgaaatgctcatcagctggtgccatgcttctcactttaggttatacctccagttgtgtttggataagagttggagtggcatgacagtctcccacagaatctgaaaatatagttccagatgtgcttctcccaaacttcttctctgccattggggttgcaccactggaaaagtgtgtgaagcaatacttcactctgacaccctgctactatatgcttgaggaagaactgaagactgtatcatggaatgagctgcccataggtcgcgcatgtgcgcacgtttgtacgtgtgtgtgttgagatgggagagggaatctagggatccttctatactccattgattatgctaacatggatcttatttaatattacaaggacatttctttgtcatcgtctttttttttttttgagacagagtcttgctctgtcacccaggctggagtgcagtggcgtgatcatggctcactgcagcctcgacctgctaggctcaagtgatcctcccacctcagcctctcaagtagggactataggcacacacaaccatgcctggctaatttttctattttttgtagggacaaggtttcaccatgttgcccaggctggactcaaactactgagctcaagtgatccacctgccttggccccatcaaagtgctaagattatagagacgtgagccaccagcctaaaaagacatttctaattagaaagtgtagtgtgaacttttgccgtagttggacttctctccatgtgggcccttaaacactgatatctcagtcatatgaagctatcaaggaccaaaataagggggcatttgccttttctgtcagtgcagaaccaataggggccaggccaggtatgaccaacccattgtatgtgcagtggcttgctccatctttctgtctctggtttatgtatgtgatcatttgcggattccagcaggtacatcctctccaataccttacctggtaagctgtctagtaaggtttatatttcagaccattgggggatccccctcttcatggcacacactgtgcctgttgcctaatattcctttattgtctgcagcatccaggaccaatttaaatgtcactttgtgaaacttcctcagaccctcctctagagcaagttagtcactgcctcttctgtgccttgctttgaggttattgtcatcactgaacctgacccagtgtattgtaattacttcagacggtctctcccaccagagtttatcctcctctgtgcaagtgctattttttagtcctatctgtctaccttagaaccttctgcagtatttggtgtattgttctgtctgtggcaattgtctggtaaatgttttatcagacaagtctctgatgcaatgggatggagtggaattaatagttttaatcatgaccatggcccgaaatagccgtttgacaacatccaagccactcactctctcagactctcacgctgggttgtgtaaattgaattctttcaaatgagcataagttaaaaaatacttagcacttaccatgtgctaggtactttgtaattaagcattttacttacataaactcatttaattttacaataacctagtggagtacatttcagtttcatagatagtgaaaaagacacacagaacggaggttacctgctcagttcaaaccctggagtgtagcctgtgagtgtatatttctttttgcatgtggttaataaattaatgttgtatttacagctttgcagagctgggatgcccttaacacatgcagctctggacctatataagctgtcaggtgtagaagagtgagcaggaaaaccttgtgggggtaactgattccttgtacaaaagaaccagatttcagttagtgatgaaaatggaggaagtgaagaatccaagtcgaatgatagaaaaggttatgtgtcgttgggcaagggttcaaaagacctagttgtcttgattagagaggaggggagctgagggaaaatgagtcacagaggaggaaataatgaagatgaagtggccagagaagacgggctcctgcaaggaggggcctgggttttagatagcctccaagaaggacaggaagtgtggcctgatgggattagctagtctcaagacaccaggtagaatgcaggccatctttgtagactgggccttggggtgtccaaaccatgaaatgcatggcagagtgtggacacacttgtttgtttatactctttctcccatcctgtacaatgaggcagaacatgaaggaaaaattaacaaacaccccaagtctcctgacacagggatcaaaacatattgatgatgtcttgcaaatctgataatttcattgaaccatgtgaagcttaaaattgatacataggcatacccttaacattaagtgctgctgtcagtctgacatagctggataaaccaatgttgaataatctattaaatatgtcagacttgaacaaagaacgtaaatcatattatattatttcagctgtaattaggtgggagataaaatcacaaatagatgagtttagtgaatatttcttagtgtgtacacagtgtcactggaatttctttccttgctctatgggaagaaagaaattgactgccttccaagtattgactgctgtccaggaagtgggaggttgaagggtgacttatgtaatgttcacagagtgggtttcatttataaattcaatgagattagctacaatcttcctgaagttaatggtgatggaaatgcaccattctgcatttagctggaaatagctagctatccaacttggagacttaattgttcctcagattatgatatgtttgcatttatatctccctcccctcctttcctgggagctggctgctgcctttattgtctagaaattaataatgcagaccagagcttgtgggtgaacagggcgatgtattgccagtcttttgatgttcctgtttcccaacccacggagtaaacttgattattgagaataaacaagggacataaactaaggtggaaaagataaagaaattgcattaggagggtccagtgaactgagctgtagctaagaaatggagataattctagtcattacttcacggggttgttgtgaagggtgaaatatatgttaaaccttcagaacagtgcctgccatgtagcaagtgtttcagtatatatcaggttgctttcattgttataagaaaactaattggcatttgtggtggatggtcagggtggtgtgaatgtgaaattcaagagcataaacatggttgtttcctcccagatggttggtatagtgaaacagacagttaagggtaaggaagtgtaggccctcattggggctacacatcacagcatgctattaatataagcagtgtatactggtcatcttttattgagaggctatggcttttttgtgtgtgtgctggtggtttttaaaatattagtttgattcatttcaggtgattttgttaatctagcaaaacatcttcttgcactttttacattataaatgaggaccatagaactttgtgtggacattgcagtcattcagcagacatttagcaaatgcgtataatgtgtgtgaatatttttttgtatgaaaggttttcgacacctgagactcactaccctcagccctgagttcacatgatgggtcggtggatttccagagaggcaggtggaggcgccgcagtgggagcatcctggctacctgagatgtgttttgaggtgccagcctcttggctccagctggagccaattggcctgttgggcatgagctacatggcatgtagagtgagctacatgacatgtagagtgagctacatggagttagaggtggttatcctacttcttctacatcacaactttgcagagcgcttcatataagacttttgtaaatttcggagatagtgtgctttatatagcaaggatttccagggacctactagaggacaacagaaggctgacatttccccctccaggccagtagcttgtctttcattactttgcataataactacttccgcttgctttttttcccccctcacctcagctgcacttaggaggacttaatgacatcatttaacgttaaggataaatataaaaccgatctgttcatgaacaccagtaaattgcacttaaaaaaaaatggtttcacataaggcagaacaggttgctacttaaaagagttaatggccagttggttttagagtagatcacaaaaagaaatgtgacttcacccgccaactccttagttaaagaaactgtgtgtttgcagtgttggagaaccatggaggaggattcagaactttaggcaggaagaactgtgaatgagtagccctgttattcccctggccactgtgcactcatggcttctgcacattactgtgtaaactcctttctcaccacctaaaacctaccaaagcacccagcgatcttcctgtatgtgaactcacaggtttttcttggataatttgcctttccattgacctactttcaagagcaattttccctatagctttagcaggtaactaaaaaggggagtggtgagaaagtaaatttggagttccaaagggaaattacttggctttgagctacttagtcaaaaacatgtattgcatgcaggtaggtcccaggcacagtgttgaacacgggggtacagaagtgaataaacattgcttctgctgtcaaggagttcacagtctagtgtggaagatctgtgtgcaagtagatggtttcagtgcagcgtggaaacctgcagcagtagaagtgacaaaaggtatgttggtagcacggaagatgcagtgctagttccgtgtggcaaagggtgaaggtgtcttagaggactccttggtcaagaagagtttggaggacaacagggagtttgcctagtagacaataaggcagattactggggcagaggaacagtggtctcttggggagattaggagctgggaatcaaatttcaagatcaggtttttttatttcggttcagtctcatacctgctgcctgtcatgtgaccttttttttttttttgagatagagtttttggtcttgttgcacaggctggagtgcaatggcgcgatctcggctcactgcaacctccacctcctgggttcaagcaattctcctgtctcagcctcccgagtagctgggattacaggcatgcaccaccacgcccaggtaatttttgtgtttttagtagagatggagtttctccatgttgatcaggctggtctcgaactcttgacctcaggtgatctgcctgcctcgccctcccaaagtgctgggagtataggcatgagccaccccacccggcccgtgacctgactttttttactgagaagaaacagaaatggggatccttatgtcttcattccttttgtttggcataggaagctggactgcatccaaaattgttaccttgtgcaatttctggataactgaagcttacacagcctgaagtgtacacaactggttaatgacagatccggttcaactcagaaattcacatttgtccagattcattcagttgccctataatcttaagtgttttttctgatgttggattcattccttctcttacttgttcaataaatgtttgccaagtatgttataaacaactgtgcagtctgatagaggtataaggtcctttctgtcagggaacttaaagtctttttgtttgtttgttttggagatagggtctcgctgtattgcccagactggagtgcagtggcacgaacattgcaaccttcatctctcagacttaagccatcctcccacttcagcctcctgagtgacttggactacaggcacataccaccatgcccagctaatttttaagtcttttttggagatggggcttccctgtgttgcccaggctggtctcaaactcttggtttcaagtgatcctcatgccttggcctcccaaagtgctgagattataggcatgagtcactgtacctggctggaatttaaggtcttaaagtggaaataactttgaaagtatagacttgtatcagattatgaggagccagactaagaagttaagacttaatgatttatacctctcagcccagagaggatgccagtgagtttctgaatttacagcctaaggcaaattctttttgatttctgtgttccttgactttatttattactgtaggataatgccttagtgtatttgaataagtttaaaaaatttatgcctaaaggtaggtttatgagctttgcattgtataaaagagtacggtatgtaagaatgaggactccaagagccaaacagccagcttttgaatcccagacctactatttatttatttgaattttttggaaggttagtgcgcagccgacctagtatttatgagctatgtgaccttgggaagttcatgtaaatgcagtgtctcttgccttacatggaaaatgtccatgaaaatcatacccacgtgaaagttattacaaggattaagtgaggctgggtgcggtagctcacacctataatcccagcactgtgggaggccaaggcaggcagatcactcaaggccgttcattcaagaccagcctggccaacgtggcgaaacacaatacatgtatctgcaaagctcaataaggcaaagcatagtaaaacagcttgcctgtgtctcatacacggtgctacaaaacctttaaactggaaatgccaagaggcacagaccaaaaaaaaaaaaaaaaaagctttaagaaaaacctttttccccaagcctttggcttggggaaagggtgggctacaacagaaaggctttttgacagtatcctccctattgctgccaaacacccagggaaaaaccacaccccatatcaccaacccctgccagtgcagctgggctgtgcagagttgatcttccacactggtccttggaagcaggcggtgcttcagttcctctgccaggtggtgtcaggagaacggagaagggtgctgatctttcattccccttgctgggcagaactagttagtactccatggcagagccaggagtatcagcggggtccagccttatgctgagcttccgtctctaccgtgtagcaaaaaaataatgtgagtcagctctcctccctggtggcagtggggctaaggggaatcccgtcgaacaccctaacttggaggaaataaaccagtgccagtcagtgcctcatattcagtggaaagttgtctgcagggccaagttgggaggcgaacttctacctcattgtctgcagcaggcaatgtgacccagtgccctgctttttccactctagtgatgatagcgccctggaggaagcagagtccacacccaccaccccatgctacatgtcaacaggggtactgcctgctaagcaaagatgtccagggctgggagcagtggctcaagcctataatcccagcactttgggaggccaggcaggaggattgcttgaggccagaagtttgagaccagcctgggcaacgtagacctccgtctcttaaaaaaaatttagctggcggtggtatgtgcctgtagtcccagctactcaggaggctgaggtaggaggatcgcttgaacccaggaaattggggctgctatgaaccatgattgtgccactgtactccagcctgggcaacagagtgagactgtctcaaaaataaaataagtaaatatcttttgatgtccgggatacagtcaaaaatctcaagaaccaggaagatcaccgcatgaatgcgaatagccagtaatggatacaagcactgagatgaatcggatgttggaattctgacaagaattttaaagcagacatcatgaaaatgcttcaataagcaagtatttatttattttaaacaacaaaaataggaaatctcagcaagaatttatgggcctaccatgagggaaatttttgaggtgatagaaatatatatcttggcattgtggcttatgcatttgtcagactcaacaaatagtgtacttagagcaggtacttttaattttctgagtaaagtatacttcagtaaagttgatttacaaatcagggattttcatccctgaagattctggttcagtaggtctaggatagagtccaataattttttttttaattaatgccccaggtggttcttgggaactcctgatatctccagaggaacctaggctagttgagaattcttcagaatattaatctgttagcaatctgtgtaaatagaaactaggtctggtaaattatgaattaaccagataactacttgcagaataaacagaatacataattagaaatcattaagtgtgttatcaccacatggaaataattttttgtattttttttattgggtagtgttgtgaagaatattacatggtatccttagaagctgtaaattgtgatgctgggttataaaaaaactgtattgtggtatgtttttgcctctctcacttaaccccacccttcactccattccttctcaggacacttatcttcttggtggctaatggcagggtggattccacatttgggaactgctgttgcctgggcagtcatggttttcatcagtgtgtcccagggcgtggtgctttctgtcaacatcctgctctccatagaggctgagaatgatccctgatgcagtcatcacggcttttaggcctctcccattggcctcactttaacctgatgactatcatatttccatctaggctgcatttttaaatcttgtcaaggaagcccagggactctcctcactgataagccatttccaatccaggcctggggttgagtcaggtcaccttatgttcttactctttcccttgacttagattggtctggctggtccacccagataaagtgtagcagtgtctgaagctggatgtgaggggtcgggaagttgttgatggggatgccttcattccgcagcacacatttcaaggcaagcagatcattttcctatagcagtactggtcagagctggattcaggggaaggctgtctgtgtttcccacgtgggccgggtgagctgctagcatttctgtcagtgctagaaggaaagtcattctttcaatgtggtcccagattcaaaatcagttttgagtgggtgtcagaatgtcattcctgatagcttctctgttttgacagtgcaaataccccggtctcatttctctgcttttaaataatagatccttgagattggccctgggtaggagacctcccccaccccacttctttctctgagttcaccatgggattctcctaatctagccagagctggatttgatccttgggtcactcctgtggtctctagccctcctcagtgcttacttagttggtctttgtttctattggttgtttttgcatgtgtcgtggttatcgtcatcatatgactaatgtcagggggtcaggcacagttatagcttctaattgtgttgcgcttttggcaagggaactatgtgtgggggaaaaatacttattaggaatcgtcagcctgcattaaagggtcgtaatacttgaacaatttgcacatgatatctatctctacatcctatatggactgtgctttctaggagggattagttaggtttttcctttcctagtatagaaccaggactagtaggggaaggcatagaggaaaatactatggttctgtttcagagagagcattcttgcaggggtttcccaaatgtaaatttttttgttttttagagatagtgtctcagtctgatactcaggttagagtacagtggtttgattacagctcactgcaaccttgaactcctgggctccggtgagcccctcgcctcagcttcccaagttagtgagactacaggtgcacgccaccacacccagctaattaaataaaaatattttgtagaaatggggtcttgctatgtttcccaggctggtcttgaactcctggcctcaagtagtccttctgcctcagcctcccaaagtgctgggattacaggcatgacccaccatgcctagtcaaaaatgtaaatattaggtcttatgttactgaaggtattccaggaatgtttggatgtggtacagaagatgtgggtattgggaaacctctaagaatatttccaaattttatcttctgttgttctttaaaaaaaatataagctgtgaatacaaccgtggaaccacaagtaatataagaggagctgatttcttggtgcctgcactgctgactaaagatccagtctggttgcttattcagtaaacctttgagttagtgcagggagtcactctctgttttctcagggagcccttatttgagtaactgtcattacctctttccctaacccactacctttaattgtccttctgtggttagaaaaacttagtgtttgaaaggcatagtatctcaagggaactttagaagtatatcttacctttgctcttgggcatttccagatgaccctggcagtgtggccacaagcaaactggagaaggctgccagtatgtgcacgttttaataaatggaggatatctagcacctcctaacccttaccttctcctccatctcatcccattttctgattgaacagtcacgttatttctagtcttaaatacttagcttttctagttgtgttaatggaattgttgtatgtatttcagttgtattacttaagtgtcttctaaaagacatttgtatactttataattcagagaaaattctttggttgattgaagatcttgctaccaggtcctggtggaagcagctagaatttcttaagcagttcctgtgaatgtttcctttttatgtagatcatttcttggaaagctgtgttttaaaataaagctctacaggcactactgttttactctaaggcctttgagctctgatatctaagacatatttatttcttcaactatgcccaggacagtgctttgcattcaataggtgaccagtaagtgttgagttttgttgaatataaaattatttacaaatgattttttgttttttccctttaaaaattaggcttccgagaaaactttgggcttcagagtccctgcttccaagcccctctttgtaacactctatgaaatgaaaagcatctttggatggtatggggagagctgaacaatgtgaggtgggagggcgttggcctttaatcaggtttctggggacagatcactcatgctggttcatgctggcccaaggctgtcttctttcttgtttgtggatgtgggttatgttcctatactgagatgtgctggatgaaaagctaataaatattaatgaagcagttacttctgtcaggcacagtattggctagagagataggtagaaataaatagaaaatacagttcttgactttgagaaccttattgtgtaattggaaaggtaaaatgtaaatgccttaaaagttaattaacagtaattcttaaggatccttagattgtctaatacagtggttctcaaacattagtgtccctcagaatctcatggagagttattaaaatacaaatcacagggccttatccccatatatatatatatatatatttttttttttttttactcatttggtctgtgtcatgagaatttgcatttctcagttaccagatattgctggtccatagaccacacttggagaactactggtgtggtgcagttattctcaaccttggctgtatgttagaatcacccagggagtttaaaaaaaaacccatgccaagaccccacccactgtagaccacttaaatcagaatctcagtggggtaggacctaagcatttttttaaagctccccagatagttgtaatgtgcagtaaggtttgggacttactgctctaacgtgtcagggccacagaactttggattcagagatatgatgttaccatgggctgcagcagtgtggacagaccagaggagttagcctgatcttaaagaatgataaataaagaaaaaggaatgatttttgttcttgtaaagttaatgctgggaacaagccagttggttttctagctgtttcttgggacagactgatgagtttgtgagctcttaggagtcagcatgatttcccattcagcgtgagctaatgagtgggactgaggtgtgggtcaccaccatcaataataagcattcactgaccacattctctttttcctgatatagatgagcttgtgtttatcctaacaagcttagatgtgtgtgtgtttggggtggggtgtggttgtggactgtgcaatagtgagaggctgaactttgaaaaatgactttgccatttttacatttcatctctttaagcctctgtttattcatgtataaaagaaagtactacacatagttgtgagcctttttttttttaaaaaaaaaaaaaaaaaaaaaaaaagagtctgggtcttgctatgttgccaaggctggtcttgaacttcttgggctcaagtgatccgtctctgcctcccaaagtgctgggattacaggtgtgagccaccgtgcctgtttgttagtatgtgtgtgaatactactacaattttaggaacactgttttatttatttagggacccccagaatctatcagtgagcctgacacatagtgtctgtgcagtgaatccagattggttgaatgaattggaaaggttatcttttcacattgactgcccaggcattagaaaggatgggaagagcttgtttcctgatctttacaaaaaatgctgccaccttgggttttccaacttaggcaagaaatctgttatgttcaaaataaaggagtataacttaaaaaatatatagatagaagccaggcgcagtggctcacacctgtaatcccagcactttggaaggccgaggaaggcagatcatgaggtcaggagttcgagaccagcctgaccaatgtggtgaaaccttgtctcaactaaaaatacaaaaatatagctgggcttggtggcacatgcctataatcccagctactcaggaggctgaggcaggagaatcacttgaactcgggaggcggaggttgcagtgagcccgagattgctccactgcactccagcctgggtgacagaacgagactccatctcaaaaaaaaaaaaaaaaattaaaaaaaaatatatatatggaaatacattttctcagtgtgtatactagtcatagctacctgtgacttattctttattttgtgtatttttttcagacagggtgttgctctgtcacccaggctggagtacagtggtgcaattagagctcactgcagcctggacctcctgggctcaagcagtcctttcacttcagcctctgcagcagctgagactacaggtgtatgccaccatgcccaactaaaattttccatcttttctagagatgggggtctttctatgttgaccagtgttcttgaactcctggcctcaagtgatcctcccactttggcctccccaaatactgggattacagatgtgagccaccacagctggccttacctgtgatctaaagaggtattttcaattgatgtttggccatatcagattttagttgctattaaattttattcttaatttatcaagtttaattgattattaaaaaattgcactctaagaataagcctgtgttttatttcttggaactactagagccttcgttacaatacattttagagggctccaaagttataaaataaatactggagatttggtgcttgttaaaattttgaccttttctattaaagcccattggagtgatgtacagagaaaaggctgtcttgtgttgtgatagggccatgctccatccacaggtcctgggaaggatgatgtaactgtggtctaacagcattgtctgaatttttggcctagggcaaagaggaggagggcgggtaaagaaacctgatcagaccatttgatgctaatttcacaggtgactggtcactgtgtgcctggctgttgttatttatagagctgtaagtggctggagctacacacaggaacctgaaaggatggtctgtattagagtgtggtggtagatagaagcacagcagtagaatctagggacaaatggtcactggtgagtgtcattgctggagttaaatgagactcattagtggctgttatgatttccactcttacttcattgctattcctgagtctttttgaaagcaaacaacaaaatagaccgaaacaacctctgatagactctccgttatttttaattgaggttgataggattttaatcaggtcaacttgcatactgatttcaaccaccatttaaagagctatccacaaagctataaattagaattatagttcaaaaggtctgactgttttaacctactgctcctattccccaaattattgatggggaaactgagatctagcagggttaaaaaaccagcccagtttcacagttagcagtgatgctggagctgtgatctggatcttaaatctctcagtttagccttttctgttttctaccgtattagtcctacaatgaaaatgcacttctctgtctttaaatttcagacgttgtctccatggcctagatgaaggttatcctttgttatgatattttctcagaattactttgaaaaatggttccattgttatttcttaaaatgaaagtaatatgaaaacaaattccttctattgataatacatttgcccactactgatagttttaggaataatgagaaaagagggggccaatttatggtattggccaagaaggagcgctcagcagcactggactgctatgtgtgggctggaggtaccagcagataacactcggaggcagtgggtcctgtgaatcacagcttggcctcggcataagctctggagaccagctctcctaaggagaactgccttctttggccctgccctcagcagcctgttggcagaggactagaataattgtttgtttaaaagttttactagctaattatactgcaccgaattgacaggcatctctattagagtctttccagtctcttgaaggctcttctccacattacttgtaatcttgcctcagtgtagactgcagtggctgatttttgtttgtttgttcttctctcctttcccttcccacttgttgcaaaggccacacaccaagtctggagagagagctgcctgtgggctgggaattggctgccttcatctggtcagccatatgtggctactggaaaaagtgcctttgggtcattcattctcaggtcaccaggccctagagtaaagccctaaacatgggctctctagcagaaagacttattaattccccttctcttaagtggaggcaaggaggtgtttctgaaccttcagaataacccgagggaacttgaaagtacagattcccggatgctatctcctggatgtgggttcaggttcagtaggtctgaaatgggaccaggttttagaatcttcttcgcggcccggctcacacctgtaattgcagcagtttgggaggctgaggtgggcagatagcttgagttcaggagtttgataccagcctgggcagcatagtgagaccttgtctctactaaaaagagagatcagctgggcgtggtggtgtgtgcctgttgtcccagctacttgggaggctgaggtggcaggatcacttgagcctgggagatcgaggctggagtgagctgtgatggtattactgcaggtggggtgacagagtgagaccccatctctctctcttgttttttttttttttgtttctttttaaaagaaccttcattacattaattgacttccaaggtctcatccagtcatgatggtttttgcatggtccctaccagtagaagatggatttcagaccacagggaatttatttgtagctacagtcaattttcaaattatttgccttacaaatgttttcaatcccagagacctttttcccagctggttcctgggttatattgccaaagtccctggttggtatgcactcgagaactgaaagataattttcttcttgattttaagaaaagataattaaggagggaaatctaccattaaaaaaaaaatcagacattacaaccaagtataacttttagagcagatcctctattgggaaggagcaatatgttatgttaccttgtatttgagcagttaattagggtcagatgtagttagttctcatgctttggccttgcaaaagtaatcccctttttggaaaggctttgttgagtccctaggaattattttaatggtctctaagtatgtttaactcagtcataatattctagttgtttggatttgttgtgtattgacattgacttagatattctcccctgctctgggctttacctcttactcgtacccaaatccatggtccacatgctgtggtgtcccctgggcatgcccagccttgccatgtgtgcaaggtaatccctttgaccctctcaagagggtgctgctcatcttttttttttttttttttttttttggcttcacttatcccacttgacattgccaaacgtgctttgacttgaagcaccgctgctcctgtggctgtctcctttgcttctcctcttcggctcattgagaatctgtttgagatacttgtcatcctttggagattagaactcactttagagggaggaatgattttacactgggactgttaggatcagtttaggaggaaacaggcccacgatgattttaggaggggtttctactgtggtccttgtaaccacatagtttgtactgagctggacactggccatttgagtagatgcttgttctccagttatagaatggttcccagctggcagatttcccactgggattcagtttccttggccgctgctgtttgttgtgctcacactgatttttgcggcatctttccaggcccttgagtcttttccaagcagaagaaatagcagaatgccttgccctccccttctcttctccttttgggtattccatggctattagggaaggacttcctgtgaaataaaatgagggcaaaggaaagtagcatgcctgtggcataaaaatgctgttagcaagcttgaggcatatcagagagattggtcctaagagtaacatttactgcctttctgcttttgaacttttctttcccccttcctttgcctgtttctgaggtctgggatttatccagaatttaagaacggactgtttttgatcatttgaataggtatcatcattcagcagggaatacatgtgcagactgagatgtctcttaaagccaatttatagtataagtcatttgaaatgatttcttgagtcagtaatgcatttctgcttcaaattctctgcctggatttgtgcattcatctcccattttaccaggtgatttgctttattatgctgctatgacagcccccctccccaaccttcaactgctatccccagatacgtgggcatgcttttcagggtgagtagccattaaactacccaaaatgacaccgaacgttgtctacacaggcttggaaacatggagggcctggattccagtaaaattctccaggctgcttcgtcaggctattgcagaaaagattacagggtcctttaagattagttttggagagatctaggcagatggatgggtgaagtcccaatgggaagtcagtacccagttgccacttggaataatctaaaatcctggcatgatctttcctctcataacttgaagtactcagctagaggagagcctctccttcgcaagacccagctatctctttgagaagaaaagggggtttggatggagtccaaccttctggtttgttttgcccgtctgccatttgccttttccttgttggtgtttgctgctgtttgttctttggagtctgaggggcttctgaccttggctgaagggcttctaaccctggacaggtcccgaaggagtggcatcagatagttgtgttttaatttcacaaatctgttatttctttaagaggaaatgagcaactggtagacccagaacagtaccaaggggagctggggagttgttatttgtaagtgtagagaaagaaaggaacagttacagggaggtttggtgcatgatacacagctgatgccttcagagaataggaggttttctttctgtgctttttctcataacattggaggaagaagaaagaggaggcatgtggcttgttggtggttgaactccagtgcagaagttaacattccactcatttagctcactaatttattaattaatttcacaaatacctattgtgctactatgtgccaggcacccttctaggtactgggtttacagtggtaaacaaaaaaaggtccttgctgtcgtgaaccttatactctagccaagggggtggtggtgatgaggacatatttataatggtggtggtgatagtgataaatactatgaaaggaaaaaaaaacaagaaagggaagagaatgggatagggagctattttagtaagtgtgttcatggaaggccttataaatgactatacaatacataaataatcattaaaatgagattttattacctaaaatattttgaacacttcagttgttcaaattattatggaatgctagcatgcatagggactgaaaatatttttttctctgaagttttgagggttttccaaggatttagcttctctttgtttctctggatattcagactcacatagctagattagagttcaccatcacagttgctttcagcattgattgagacagtcttatgttgtaagggtctgctttttacaaaattgctataaaattgttctgtgtgattgagaggctccctctcactcaaagtagatgtttggctgtttttgttgttctgttttaaacagtaatgagtaccttttggtaattaaagtccccttcacaaaactgtagtgagtgatgaataagacataaacaaagaatcccttctgcggagcagagtgccaatggccatagacataactcaggggctgtttgaccacataactcagtgcagtggcttttcaccattggaagggtggaatggtctggtatggttttctggattgctctgataaacaggagttatatttgctgtcagtttctatgaaaggacagcattatatgagccatggtttgtcaggggcctactgtgtgctgggctctttgctataggatcaaatgctaactacatctattccacaagacaccctatcacagtgattggtttttttgttgttgtttgtttttgagatgaaattttactcttgttgcccaggctggagtgcaatggcgcaatctcggcttactgcaacccttgtctcccaggttcaaacgattctcctgcttcagcctcccaagtagctgggattacaggtgcccgccaccacgcccagctaattttttttatttttagtagaaacggggtttcatcatgttggccaggctggtctcaaactcctgacctcagggtgagaggtgaagccagctggacttcctgggttgagtggggacttgcaaaacttttctgtctagctagaggattgcaaatgcaccaatcagtgctctgtgtctggctaaaggattgtaaatgcaccaatcagcactctgtagaaatgcagcaatcagcactctgtgtctagctaaaggattgtaaatgcaccaatcagcactctgttaaaatgcaccaatcagcgctctgcgtctagctaaaggattgtaaatgcaccagtcagcactctgtaaaaacgcaccagtcagcgctctgtgtctagctaaaggattgtaaacgcaccagtcagcactctgtaaaatggaccaatagcactgtgtaaaatggaccaatcagtaggacattggtggggaaaaataagggaataaaagctggccaccccagccagcagtggcaacccgcttgggtcctcttccatgctgtggaagctttgttctttcactctaaatcttgctgctactcactctttgggtccgtgccacctttaagagctgtaacactcaccacgaaggtctgtggcttcattcttgaagtcagcgagatcaagaacccaccagaaggaactaactctgaacacaaggtgatccacccgcctcggcctcccaaagtgctgggattacaggcctgagccaccgtgcctgacctgtcacaatgattttttaaactgcatatcttaatccattagtgggtgacagtcagaattttattttattcagtttaaaaaatagaatcaaatagatgacatcagagtatactacacttagtgtgtgtattgtttcaaaaaaacttgttttaagtgtatgtgcatgcaggcagacatcagaaatttttatgtgtcatgctctaaaaagtttgaaaacaagcctatcagttgaggtttggtatcatttataggcaagtaaactgaaactctgaggttaaggacgttgcctactatcagaactaaaatttgaactcagctctttctggctttcagcatttgatccaattatgtttctcacagagctttccctctctaatggttttccaagactcttgagatcacagagacactgatttgctcctgacgttgttctaaaatcagaggaggaacatgcactctgatgaccagacccaagtttgactggtttctcaaaacatctttacataacatagtctatttcaggagaagggaaaagaaagatgactctagaacttgtctttattaagaaacaaggaaaatctagacactctttttctgtcatagaaagatagcctagttttaccagagaggagaaattctaaccagaagtagtatcaggatctttctctctaaagcacttaaagtcttttgttggcgagacgagtagagcaagaggaatctgccaccttgtgtaaaacattttggttttactagtcaggcatatttttgaataaccttcactagcatttattatagtagttattttattttattttgacacagagtctcactctgttgcctaggctggagtgcagtggcatgatctctgctcactgcaacctccacctcctgggttcaagtgattctcctgcctcagctgtaatcccaagaagctgggattacaggcgtgccaccatacccagctaatttttgaagcctctattttagtttcccccaactttactagagatggggtttcaccatgttggccagggctggtctcgaactcctgacttcaggtgatccgcccaccttggcctcccaaagtgctgggcttacaggcgttgagccactgcgcctagctgttacaacattttggcaccagttttacctacttccccagcctcctaggaatgaagtggaacttttattaaggacagatttttcagaggggcattattctcactggcattccttccctcttgcctggaatcacccttgaatgaattcctgattggttcagctagactttttcttttacagaagaaattgctcttggtgaagatgccagaaaaatatcgtaaaaacctgctctcttatcctcttctctgtactactttgttaccccaccccaccccacctcaagcccccagtaaaaaatgaccttttggcccagggccctatctgagtatattgtgtggcagagttgtctctggctgactcccaggattgttaatgacttccttctctgtccctaaataattgcttgaaaagacagctgtggagagacattgcccccagcttgcaggctcattaattcagccctatgaaagagggtgcaaaggaagaaggtggaagttactttgccaagagtagcaggcttgggggaaactaaaatagaggcttcaggggaagggcagcagcatggtgtcagagattacacttggagtttgtgaagtctgggcaggcttcaatctaaagaaactttatgcacaaaagcccaaatccagggaaataaatgaaagtgattattcacttttctaaagtccttacagtagcgttcctctggtattgtttgaatacagtttaacctgaagggcacttggtttttgtgcagctcttcaagaacagaagcatctaagtaagtagaaagtctgagaaattaacagagaagattccctaaaagtcagccttcattacttgaccattattcataattctgcatttgtctattcctccagtggccttgaagcaaaattaaaaaaaaaaaaagacacttctatgccccttaaaaaaagaataatcaaaacttgcatagacagaataagaatcaaatacactggggaacaaatactctgattagctgtccggttcagctctgacgcgtctagcactctgagttataagggaaacgataggacacttggtttttgttttccaacaacaggaaacatatcaggtttctaagaagatgtaaagtctttcttaaaacccaattatagaaggaatttatgcaagtctttaggcaaggagtattaaagaaattaatgtttaatgccatcaacaagttttcaagcagatgcagaactcctagtgtgggtgactttttggtgtttaccttatatcaagaatgcagcatttaaggccactttgacagagtgcagctaagctttttgggtttgcttgtgtggacaatttccattcagcaatggctctcaaacttcaatgcacatcagaattacgtgggggcacttaaaaaaaatgtatgcccaggctgcatccagaccaattcagtcagaatctctgatggtgagccccaagtatcaatattttgtaaaactgattccaaaggttagctaagtgtgaatcagtgcgttagatgatctttaacgttaattatcttagctggatttctcaaaggggtagtcctagaatgctgatattccctgttattaatttaagtaagtccctgttgtttctgttaacattctcttagaactctgagacttgtatttctgctgggacccagggctactgcacctttcttggcctataggagtgttgtcagaaccaaagtacttgttaagcagcagcttaggatcaacattagcagacctcattgtggctgttggagaatatagaacatcagatgaagtaggggcttgacgtttccacagccctaaatcacatatttcagagtacgttaagattccttttggaactcagatctttttctggccatggatagactgttgtcttggggggatgccagttgtctctccagtgagaaaaggagatgtttatgtattctctagttcccttctggaagttaaaaatacctgtcattgttagatttggtttctgaactctctgcccctaacaaagctgaaatgatgacagtgagtgaagtatttgcttaaataaatatcttttttttcaactttgaagaactaaatatatctcaacgtgttgaaacatcagagaattggctgggcccagtggatcacacctgtaatcccagcactttgggagtctgagctgggaagattgcttgagctcaggagtttaagactagcctgggcaaaatagtgagacctcgtctctactaaaaataaaaaataaaaaaaaaaatggctgaatgtggtggcacgtgcctgtagtttcagctatttgggaggctgaggtgggaggatcacttgagccctggaggtcaatgctgcagtcagctttgattgtaccactgcactccagcctaggtgacagagtcagactctgtctcaaaaaagaaacatcagagaatcattgattttatgtaatctagattttatcccattccaaattgtgcttctgtgaatacacattatggaggataacggaaagggtgtttagggaaggggatgacaatgggaggagagggagaaaagggtggtgggagaggtaatataaatgataattaccatgacttgaatcttggtaaaatcgtataataggaaccatgtggtactggtgttctgattaaaaaccacttcctggctttgtgaccttgagtaagctataactctatttttcagttttctcacctgaaaaattataatgatacctgcctgttaggattgttttgaagattgagattgttcgtaaaatacttagaaaagtgccttggcacatagcaagtactatttaagtgtttatcagagcatagtctcaacttgtcccattaagaatattataaaactgtaaggtccagatgatgctttattctgtaaaggccattaatggagatgcttgaacatctctaaattacctttccctttgcttgctcaggaagtttgctaatctaaattcttcatgctgtgctgctgagtgtcatgtgtgattgcttgtgcaaggagacccaactgggttctatccgcacttaactgaaactcaagttattccctctctagccttaattcctgtcttctaactctccaatcgatttcttggctccactaattgaaacctaccccagttttctcatgctgttgagcagggatcttcttgagactgattatgatgggagaatgacctcatagtttctgatgccatcttccaatttatgtaactcagccccaagcatgctttttaaaaataatggccctaaattgctgacatcttgtcatctgctcagactcctaaatctttttgtgttccctcgactgaatgggattcactggagcaagatgcctttgtgcagtctgcatttagtgcacttggcgagtgacctccaatagagctgtgtgttcccttcgagcaacatgggtaatgattacagcgacaatgctgctattgtgtccagaggtttggggctgtaatttcataatgaaattgaaaaacatgagattaaaaacctgaatatagcacagtaattatatttaagtatcacaaatcatctccctgtatttagttaggtgtttgagatttggcctctttgtggagtgcagtcacgtcgtttcatacatctgcaaaatggaaggcttctaatttatggctaaaatgtgggaattgctttctcttaatgggaaggtgaggagaatggtattgaatttgaaggagctggtttgcttcattgactagagtcaagaagggaggttgtacaatagctgcttaaggtaaagaaatgtttgggtcttttcatggtttaattcccagatacttacacatgactatagtctctccctttagaaattaactgacataggctggcctgggaaattctacagtcctgcagcaaatggtgcagttgcagaagtgtgaatctttacctaaggcagggtttctggtatagataaagacttaactggggtttgtttcccacaggtaagttatggatgagctgtgcctggcccatttccatttactgtctgagaatctgcatgtggcctgcaggctctgtagttgggctgagtcctcctggagtaggaggctggggaaggtgttggtggtggctgtcgataggcattcctgcaggatggtgggtggagagttagggtgaggggtgttctttaataaaggaatagaaattagagtggaaagtggtttaaagctagtgatacctccttctccttgatttctaggaactatcaagtatgaaatgaacatagaaggaagttatgaaaggaatcattattattgtcagtgattcttgattatctactataggcaaacacgttaagttgttgttttttttttgttttgtttttttttaagacggagtctcgctctgtcgcccaggctggagcgcagtggcgcaatctctgctcactgcaagctccgcctcccgggttcatgccattctcctgcctcagcctcccgagtagctgggactacaggcgcccaccatcacgcccaactaattttttgtatttttagtagagacggggtttcaccatgttagccaggatggtctcgatctcctgacctcgtgatccacccgcctcagcttcccaaagtgctgggattacaggtgtgagccaccatgcctggccaacactttcagttttggttaccatctttaaacttcacagtagacattgatacagaggtatactttctctgtgcacatatactgcctctcaccccaaataatttttgatacagcagtgcagagtgtccctttttttccaaagctttcctcccagattcttagtgaatctacgagactgagtatctgaattgcctaaggccttttatcacaaaggccttaggcaaatgtatgcaagtgtacatacattaccaggcttcatcaacatgccctactcagagacatttcggttcattaggtaggggtgggagaggttgtggcctaggaatctgcatttcaacaagcaccaggaatttttatatacaataaattctgagaatcattgccttaggaccttctttctcaggggccgggctattccagtgggtgtgttatgttgagatttgctttgtggagatgtgaacttgctgttcagtcccttttcctagcccctggcttcagtatatctttcacaaaaatacctacttttattctgtttccactggatacaaggagggctgggctttttgctgctttacccactattacagatagcaggttgggagacagtttgagtcctgtgtttgcactccaggcctactagggaagaggtggcctgcctccagcagtaaactggtaactatctaagacctatggtgctctctgtttccactggaaactcattgaaaatgctaccactattcatgtttttgacctctcagagcaaagtatataaaagcagcagttcaagtaaattcgtcaaacatttattgagtggtggctgaggctaaagtattattttaaggggcctgggacagataagtaaaacacagtttccattctccatctatcctgtctttctttctaatgatgtagacagtcctgacacagaactatggcagacttagtgtaacctgtgacatgatcgtgtctttgaacaagtgaaattaaagtgctataggaatgtctgggtgggaacagttagtttaggttaggcaaaaggcttcttaggggaagtggctttgggcagggtgtagggcagaggctctcaccttggctgtgctttacaatcacctgagagaattttgaaaaaccccaatatttagaccaaaccctataacaatcagatcagaacttctggaatttggacagagacagcattttttaaatgtttaaacatttaaaaacattaaattttttaaatgtttaaacatttttaaagcttcctacatgattttaatgtgcagccaagactgagagccactgacaaagaaggataaataggctgtcattcagatgggggatagtcagagaaggaaaggtattccaagcttgagagaataacataagcaaagctgcagaggcagcagagtgatggcttaagttggagaatgccactcaaagcgggggtgattggagcatggggctcctggcatgagcgtggagggaaaattatgctgattaggtaggattggattaaaatactgcatcaaggaattgggagacatgattttgcactgcctttggaaccccttttcacctcatattaggatggagaattgaggttcggagaacttcttgcttgcccaaagtactagtaagccagcaggcatgcttggttccctttgcaaggctctttgccatagacctgctgtctcaagctgtgcagtacttaagacttctcttttggcatctgtcctatagcacttttctttcatcagagcaccctaaaggtaatttagggtcagaatggtaggaaggtattggtgttaggcaagaatatggcacgatttcttatctttttgctgggcccctgtgggaatgatatgggagaattgctgggaatactgggggcagatgtttgcaagtaaaagtgtatatgtttctgtgttcttgcagctgcattcgttttgtgcctgattccactaaggactgtactttatctgcttattgctgtttctaggaagttaatttgcaggtgctataagtatgcatgcttcatatacttcatttattctttcttccttgaagcctctcctctttattaggcactattcatttgtctacttggtacctgtatttttttaatgtcactattttgacagtaccaataaaggtaaagccactcaattacgcagggctctctctttatgctttgggtaggtgcacctgtgcaactgaggggacggtcagtgttatcaaggttacctgttattacaagtagaagaacccacagagatcaggagagagctcattttcctccattagtaggaggtaggactatacattcacaaacacgaaccttaaaatagctcacaaaatagtgtcatacatgtacccagccatctttccactcattccttctcaaaaggaatgtagtaccatatagtagttaagaatatagacactggagccgatcttcttgagttccaatagtggctcttctactttttaaatctcattttccttcatctttaaattgaagatagtaacaatctcatggggttgtgataactaagggggtaatgcatgtaaagtgcttagaaaatgcctggacataggaagctctaagtttgctgctactactgttattatggttactattattaatcattgcaaggaaaatgtatcaacagatgaatttggttcaatactgccttctagttttgtgaccttagaatttataggaacaaaaaagatttgaaagggaggttgggctggatcatagagagccttgattccatgttttaggatgtatacacagtgagaagtccttcaggttttggtcttggtaagagttgtgaatcagaaagttaactcttgtagccaggcggagtggctcatacctataatccaaacactttgggacatcgaggcaggaggatcacttgaggccaggagtttgagaccagcctgggcaatgtagtgagacccctgtttctgccaaaaaattactcttgcaacttcatgaaaaataaatgattagcagaattagagcagttaggaggccatcttaatagtccaaggcacaataaggcaaggaaatgaatgagagcagtggcagcagacatgaagatgagcagttggatgcgaaaggtttgttctatagatagattcctcttggcttaagaaggggaaataggaaattaattagtaatcagaaatatttgcatattagtcttctccatcttcatccttgatgagaggagagcttgttatgtatgtaccattgctgggtacaggaggcagaagagctagcgccagaacaaggagctcagctttttctggtctctgcttttacgtggctcgttataaaccaggacccaattagttctttaggcatgcctgcctgttctctttccatgtaattactttgtggagcttgggttcatgcacatagttacctcgattaaaaaataagtttttggagctataaattttcaaacactgctttgagagggtctgtcaggcattaacattcaaggtttctgtggtgggctgacgatagcctctagcctctggatgtttttcacattccaggaaatgacacctgaagttttcagttccttttcgcatcttcagcaatccatagacagtggggtgaaaagatgtaacctaattgaagacggatggagtggagtagaagttgaaaatagggaagaggctgggtgtggtaactcactcctgtaatcccaacactttgggaggccgaagtgggagaatcacttgaggccagaagtttgagaccagcctgagcaatacagtgagacttcgttctctaccaaacaaacaaacaaaagctagttgtgcatggtggtacccacctgtagtcccagctacttggaaggctgaggtgggaggctcatttgagctcaggagttcgaggctgcagtgagccatgattgtgccacttcactccagcctaggcgacagagtgagactctgtttccaaaaaaaaaaaaaaagaaaagaaaatagggaagagactgcatgagtcctgccatgcagtctttcccagaattggacatttttgtggtgtggtctggaagaaggaaaacatttatggtcatacctctccaaattgaacaattgtgggaatatgtacagacagatttgcagggtagctgaaaagaaatgcagttctgttatttttttgttatagagtggtaacttgagtgaggattatgaaacattgcctagcagaactgtttttttaattgaccttcatgtataattaagaatatcaattattaatgttaaatatattggaattttaaaaattgtgattatttctttgtaatctgatttgtgctatttgccctgattatcagagtgttgtttgagattaaagtggtctagcttgggttcagtttgcaccaggagttttgaattaactaggctccatctgaatgtggaagattttcgtcgtgaggatgcaatggaatcgtaagtgtaaagggcctagtatagtgggtagtaatttattttactcctttttttccactttaaatgaagagtggctaaacttcaacttttgggacattggtctctacctgcacctccagaatgtaacctcttggggaagatatttggagacctggggacttttgcaggtgggtagtattacgcagagcccagatacccctgccttcttgtctggaaatcagtgattctcaaactgctttgtgcttgagtattacctggggggacatgttccgttttcagctccccaagccatagagttaagattcaatagacttgaggagctgctctcagtccaggattatgtgcagatcccgaatctgatcttgggctgctgtgcttttccagtgcccactcagtatttctggggctgcaaggaaggcagtggttccccttcacaggtacgtgaagctcttaactccatttttgtccttttaaattcacattaaagagagttttagatatgcaggaaaatgagaagggaaattgaccttgcctgtctctgggtcttgtgaatagaaaggaagagcctgcgcttggaggccactgggaatttgtggtgttccagaagacctctgctctcatgtgggctcttggcagcctcactgagagccacaatgggcttccttatttaagatgctcttaaattttcttttctaacactataaggttatgtcttcaccagtttctcagattttaaaaaaagaaacagggaggtaaaacaaatcccaaaacattttttttccttcttgtaaaggttacaaacataaatcatatttgagaacaatgaatggaccttattttttatcttcagaatgctgggcctctggcatcttagaaagtctctttactttcgaaaggaaggagacttgtatagtgagagcatcacactctggggatcaggtaacttggctatgctactgggcacctgggacttcttggtcagaacaagtctccactgtgagcttttttttttaatccatgaaatgtgggggtcctgaagctatcaaagcgttaatgttttatgattctagtgatgggcttctgtctgcgtgacaggcattttccagactttgttgatctatttcgagcttgtgaggaatagcatgtaccacccttcattacctcactcatggttcctcttcatcagtgctttataaactgtagtgtgtttgtgctgggaggaacgtaagagaacatgtggatcacccctttactcattttacacatgagaaagatgataccccaagtgattttctctaaggttgggacatgactggggctctccttgcgatttgcctttcccttcagtgcgttcggtaaacgttgcattaccccctcttcagggtattattctttcagttccatatgcctttcctttcccctgggatgctggagtattcagttttatttctaggcaaaagtactcctaactgtggcccctaatttttttttgttatgtatcttttctagaaagagaatttgattatgcattgtccatatgtttacatactgtactcataaatgaagttataaaatatatgtaagttaaaaatgtggagaaaagggaagtcttgtgcaccattagtggggatataaattattattggtattacggaaattagtacggaagttgcccgaacaattaaaaatagctgggtgtggtgactcactcctgtaatccttgcactttggaaggccaaggtgggaggactgcttgtggccagaagtttgagatcagcctggacaacatagtgggatcctatctctacaaaaaattaaaattttagctgggtgtgatggtgcacgcctgtagtcccagctacttgggaggctgaggtggttggactgcttgagctcaggagttcgaggctgcagtgagctttaatggcaccactgcattccagcctgggcaacagagcgaaacctagtctaaaaaaaaaaaagtgtgtatataagtacacacatacacacccctcaataaggctagagagaaaaaaattatatgtaagtatggtattttttttttcctcaatcacagtggatcagtttatgccttccctggatccagggtgaacttgttttgaggaccactgatccagaaagtggtggagttaagtctgtaccaccagctttagaatctcctgtggcacttattaaaaatacgaattttggtatctcaacccagattcactgaatgagaatgcctcctggtggaacctgggagtctacgttgtcttcatttttatgtttttaccaatagacatggggtctgttgcccaggctggttttgaactcctcagctcagagtcctcccacctctaccttctgagtatctgggaccacagtcacaatgcccagcaaagtctccattttaaaccagaggcaagtctccaggtgcctctgaggtccagcgagtttggggaaccggtattttagacaggcagggaagtgtcattcatgggttcatgagcatgggacttcttacactgacatctcagaaattgctcagctgttactgttaaatctacagtgatacagttagcactctggaaaatcagatgggcagttttcatttgagttacatatgagggactataacctgcataatcatacatggaatttcttaaaactccttggcattctctatgtggttttttgatttgtaaatccaaatatttgctattgtgcctcagtctttttttcctcattagaaatctaagctctccccgccccctcctggtgctgttccttgaggggctgtgtttttatttctgagcttttcccatttgtgtgtgttccttttgtctggagtatgcccaaccccctcacctttttacctgggcagttcctactatctaaaaaattccctataaatgacattatttttcattcttaaaatctaaagataatgaagaactagctgataatcagcatttaccaaaatagatttaagggttattatttgtaataactcatgtgtcagtaaccttatgtatgtaaggatagatcagtatcttggttattaagcatatactctctgaaacattcgaatcaaaccagtgtaagtcagataaatatgtaacaggaaatttgtttctgactattcactccaggtcaatgtattcccagctgccttgtgggtatcagggttatctgttccaggatcagctttaggaaagcccctactcaaatctccatgtagcaagagtgcaggctagttgagaacatgtgataattaaggttaaacaaaaaaatcaaggcagaatgactagaaattaggacagcagggaaagcaggggaagcggttgagctggtagaaatgggtaatacctatgattatttctgggatcaacagatacatccctgttgtagaagtccaaagcagtccttctttttggtgtcttttcctgcctttggtatgataagcccccctaacatctggcacactattggggtgacattgtgaagttacctctgcccacagtacttactccagtttgatatttttaagaaatgctcactttccactagccatagtttattggctttcagaaagtgtctggcagtgagtatgccaaaggtcaagaattctggcagagtttgatttatctctgctcccttgatagcagctagccttggaggcatagaagctcttgacaagtactatgagtcagaaggccacatgtgactaggtccctgcccacctctccagggtcaaatagatcttgcctttttccccagcccctccctgcactgttcctgaagagggctgtgtttttctttccaagccctcccatttatttacattccttctatctggagtacttcttaccccctcacctttttacctggctaattcttatatatcttttagataattctacataaataacacttctttcacctttcctaaactagaataggtattcctgctgtatgcttctatggtcccctcatttcccctagaataacttactacagtttttcgttcatacttactgttatccccctggactgtctgttctgctaggataaggattcttgctcaccatttcctcattgctaggcataaggtatgggacatagcaggttatcaataaacattttttgactgaataaaagcataataaaacaatatgttaattaatggggtgactggcagggatctagttgccaatttcagcattggtaattaacatggctagatttagctgctaggttctatgagaaagaatgattaaaaataaacagaaaggagatggaagttgatacgattaaaaacattttatgtgcctgctgatggacctaaaactgggcaaacctttctgcaaataaagctctaccttgatggtcttattgatataccatatatacatatatatgtatgtatataaataagatatacctatatataaaatatttatacctatatatggtatataaatgaatataaatataagatatataggtatatatatgtggtgtatatatacataaatatgtttgtgtatgtataataaaagacattactctccattgaagtgtttactacattatgtactatcttaaaacaaaacttcccacaggtgtcagtacaaacatgcatttgttcatttattcattcattcaacagttttgttgattgtttgatatatgtcaggcacttttctaggtgctcaagacacaacagtgaacaaaacagacaacaatctctctgactcaatggaacatgcattttagtggaagggaatgtcaataaagaaacgtctaatatctagagtattagaaactggtaagtgctaggaaggaggaaagggggccaggaaatgatgtgatgtgtgctgttgtggtggtggggcatgcaattttagattcagtggccaggaaaggagtcactgagaaggcaactcttgagtaattacctaaaagggggtgaggaagtaagccaggtgggtatttgggagaagtgaggtaggacagtgtgcatagctctttggaatgtgctcctcatccctcatgtttattacgttggccagaccagcaggttgggctttcagtggcctgtttgatcagaatctgcaaatgtttcctgtctttggatagtttccctgactaaatcttagcctgaagacgtatgttaaggggagagcgtatgtttcttcttgccaacttagttttatggaaaaggccctaaggaaaaagcctgtcttttccttttcatgggtcagaatttgtgttttgttattttctaagctctagtttgtggtggaaccacctctctcagatcttgtttttccttcagggcacagtgtatttctcacttaagtagtttatgcagtcttatcacagtgtcccctgcatggggacctgataacttactctgattgataacggaagggcttttctgtctacttctgtctccttgatggcttccttatctgttgtcctgtaacactaactgtgaactcatttcattaggtaatgaaatgttatcttctgtaattgcttatttgtgcagcagtcttgtctctgcaactggagaggaactttaggttctttctgaaccttagagtactggctcatagtgcctgtgctataaccatcattgattgctgttggtcaaagcacctgactttttggggtaagtaaaccaacatcttgcttttcagtgttttgtttttctggattacccatctatgctttgggtttaatgctccttaggacttggccttagtatgctgctggagagcccaagggaacagtatattagtaagggatgaattctttgtgaattcttaaatcttccattgcgaagatctttgtacagaatactggttctgtttatattgacagttcttcagagaattgtgtgttgactgttcatggcagaaacaccataagttaattgctgtttcaaatttcattgacactttccccctcatttggaggtcatttcctcaaaaatgtcgttgtccacatgacagtttgtgtatgcttaataaaagagaatgacaaacccaagttcagctgttgttactggactgggtggtttttagctcctcccacaatgggcaataatcagtttggggtctcagcagaattataaatacctgcatttcatagtcttcctgaaggaattgctttacttggaatactgtagttcagactgctgatgtaccgtgcactcctttctctttgatgatcagctctgaagtgcaccaattggagagaactcttgaataaatgctgtcacttgtcacatgtggtcactttctggggactgtgcatgtgccagtgggggccatctagaagccaccgatgcccactaatataacaaaactcactgggtttgcttctctataatgatgttggattgctttgctggaaatccttaccatcttggtttctctcctctgtttcctgtaaacaccaaataaaagtccttgcatacaaatgttaccatctttggaaaaaaaaaaagtccttgtagttgttaacagttacagaaaatataacctgaagacttggagtcaaaaaacaaatccctgccttcccatacagtcagtaccagctataagctaattaaactcaactgttcccacctgttcccggggaggcctctaacagtggcacatgcttttctctttgggacttaacatttttcagaactctttaaatttcattttctaggccaggcatggtggcttttgcctgtaatcccagcactttgggaggccaaggcaggaggattgcttgattctatgagtttcagaccagcctgggcaacatgacaagacactgtctctacaaaataaacaaacaaattagccaggcgtggttccaggcacctgtggttccagctactcaggaggctgaggtgggaggatcatttgagcctgtgtggttgcggctgcagtgatcattgtttgcaccacagcactctagcctgggtgacagagtgagactcttgtctcaaagaaaattttttttcattttccattgacaccatactaaacaacgtgtatttccagaatcaacctttatttccctaagaaaatgtagattgtgatgtccctggtgagcaataagttaatattggctgatagtatttgagcagcagtgacagataggaggaagacaggagggaagagatgggagtgttgctgggggagtgggtgtgaaaccataacacacatatatggtcacgtacacatctgtagtttactcaaatggcattttcacaaagcacagtagtgttgcaggtatcccccagtgggcacacagagctttcagtcctcactgtgtgaaacttctcatacctttgatgttgaatttaagttcattagtggctcctatagcatgtcagaggtttacctcacttggttcctgactcaactctgaaatgctgagtttagggtggatttgaagtgtcaccttcgtctctactttctaagagtcagtaaagagctgccatgatagttaatcctatagtgcctccaatgaagacttaaatatacttactagcccagactttgctttatcattctcctgatctattagttttattcctgttgacagccaaaatgtaggatcatgaaccccacagttacatggatggtgacagacctgagttgttgtcgagaatcgtgctgagttttgttatcacatttcttgtctcgatttgtagcatctctggattttacttctttaccagaatagtggttatcaaagtgtggtcttcgaagcagcaatatcatcatcatctgggaacttgtttgcaatgcagatttccaaggctctaccatgacttcctgaatcagaaacctttgaggaggaagccagcaatctgtgtcttaacaagccctcctgtgattatacccaactttaagaatcactacacagacagacgttgctttccttttagtctcttgagcttgtaacagttgatattttaacttttatatgagagaggacagttatatcttcctttaaactcttatttggtgcagttgattgtcagatgcagagtgctgatgtgaggatggactgtgaatatgatccactgtggcagtgtttatagtctcagcccaatgccttgttgacttaagtagcagccttgataacaggagataaatctgcaaagatactgtgaggttacatggcaaggcttttaaaatacaccaacattacatttgtggcaagtgctttgctcaatgttggcatttttgaagtcaccctttacctctgccccctgcccagaaatttccttgtgagaaatgtttttacgttagacaaactgccatgggggaggatagtcagaaagaggagacaaataatacgcagaggcagacttttttttacatttgttgctcagaagaaaaaaattccaatgaagaatgaaagaggcttcatatcctgaataaagtaaatgatctgggtaggatggtacaggaatagaatgtgactataaaaaagaaccaaattgtgcagacaagaaaatatgaaggaaaaaagaataggaaaaagacagggaaaatgcaaattcttatggaatatttttgcaaatctgtgtacagaaggaaccaagcaacgcagatcagttcttctgaggctgggagttctaaaaattatgcagtatcaaggaaggctttcttcctgagtcaagtgtaggaagcagaaccaacctttatttctctatgaagatgtatattgtgatgtccccagtgagcaataagttaatattggatgatagtatttaggcagcagtgacagaaagttttctttctcctgactgaatctcacaccaaggtccctttttatttttaattgtttagtttaatttttgttttttgttttttgagacagggtcttactctgttgcccaggctggagtgcagtggcgcgttcatagctcaactacatcctcaaactcctaggctcacacgattcccccacctcagcctcctgagtagctgggactataggcacgtgacaccacacctggctaattttgtaacttttgatagagacacacacggtcttggtcttgctatgttgcccaggctggtctcaagcggtcttcctacctccacctcccaaagtgggattacagatgggagccaccatgcccagccaaggctttttttttttttttttttttttttttttttaaaccagcgtcacaaccacagaagaaagacaagaggaagatatgaagacaaaactcaattttttttacttagtgtgtctaggtaaaggtttagtaggagataatgtagaaatgaaatatgataatagcttatttgtgttgagtgctttgatgtatgaggcattattctaagggcgttatacttgttgaactgtctacttcttacagagtctgatgagctacactctgtttgtgtatttgtttttggtggcttttttgagacagaggctcactccactgtccaggctggagtgcagcggtgccatcacggcttactgtagcctcgatttcccaggtttaggtaatttacccacatctcagcctcccaagtagctgggactgcaggtgtgcactaccacgcctggctaatttttttgatgagctagactctgttaccctcatttgctagttcatgaaattgaggcagagagagaaagtaagcaatctggccaaggccacacagctagcaaatgggatttaatccctagcattttcattccagagccttgcctttagccatcacactctactgtttctcttccatagtcgtcttctttcttgtgattccaagttaaagaattgtcatggatgagctttttccaggagtaaaggtacttgttggactcttcatcagatttggtcgcgggaaaagaggttgttgctcttccttagagacctgttctttctgcatttaaaatctgagtgtaaatttttttttagctggaaattttaaacgtgtagcaagtgtggccagcttgctcttgtaatgtttagtttcctggacctcatgttgcctccctaaaacttaaatggggttgtggttgcacaacagtatcatggaaatgaaatgaatcttaagcctaatgagtttgaataagatgagcacaatctaattttgtttccagtcgtttttcctcctttaaacaaagaatatcatgccaaattggaaacattggattgtgtcactgtgggtatttattttttactacatgtcaccaagatccagatttgttgagtgtattagttacatatggggtaaaattctgattttttaggtgtattagttatgtatggggtacaaaattaccacaaaacttaccatcttaaaacagcaaacttttactatcttagtttatgtgggtcaggaatttctgagtgacttatctgggtagttcttgcttgacttctcttttgagattccaggagtaaaggtacttgtcagactcttcatcagatttggtcccgggaaaagaggtcattgctcttccttagagacctgttcttgttgcatttaaattcttagtgtaaatttttttttagctggaaattttcaacctgtgtagcaagtgtggccagcttgctcttttaatgtttagtttcctggacctgcagccgaaatgttatctggggccactgtcatctgaatgtttgactggagctggagagtctgcttctaagatggctcattcatatggcttttggcaggaggccttggtttctcaccacatggacttcttaacatgacagctggttttaccagcgtgactgattcaagagagagaaaaatgacctaatcttgcaagtcagacactgtcacttctgccacattctgttagtcagaagcaggtcattaatggcagcctgcactcaaggggaggagaattaggcccaagctttttttttttttttttttttgaaatggagccttgctctgttgcccaggctggagtgcagtggcacgatctcccaggttcaagcagttctcctacctcagcctccggatcctgagtagctgggactacaggcttgcactaccatgcctggctaatttttgtatttttagtagagacggggttttaccatgttgttcagactcatcttgaactcctgacctcaggtaatctgcccgcctctgcctcccaaagtggggattacaggtgtgagccaccgcactccggccaaggccgcacttttgaagggaggagcattaaattgtggacgtattttaaccaccatagtaggcctgactccacacctactaaatcaaactctctgggtatagtaattttcatttttaagattctctcaaatgatttttatacacacttaaaatagaggacaactgggtatctagaagtaaatgaatgctatcatggcactatactagtttatttaaaaggccagatgtttttcacatgtttagcattctaaatatttgaggtttgtggatgaggtcacttggaagtaaaaaaaaaattttttttcaggtttgcgcttaggcactaaatcatatactaggtaatatagtacactctgctcagactgcattttatctggatgggcccttagctttttttctgttgctcattcaggcagatgagccccactctaatgtagcctgtggtatctgaccagctgctctcagtgcatatagcccaagcaggagctgtagctcctgattagaaagaatgaagtatatgtctgggcagggcaagccaaaagggattctgaggttcttgtctcaagatccagggtgaaccaggcaccatctgatgatggtctttggctcattggctcctacagctgcatactttgttaggagacatgaggggtacagaaccaggagtttgcaaagaacaatcatttgccttctggagcccttctaacctggacatcacacccttttgatgttaaatgacagacgtctggctctgtgtgacatcatacctatcttatcttagtgtacctcagctaacctcctgaggcttttggtggggaatcaggcctcattccccatcatagacataatttcctttttttttttctgagatggagtctcgctccgttgcccaggctggagtacagtggcgcgatctcggctcactgcaagttccgcctcccaggttcacaccattctcctgcctcagcctccccagtagctgggactgcaggcacccgccaccacgcctggctaattttttgtatttttttttggtagagacggggtttcactgtgttagccaggatggtctccatctcctgacctcgtgatctgcccgccttggcctcccaaagtgctgggattacaggcgtgagccaccacgcctggccgatcatagacatcattttcttaccttcccattcacattagctcttagccatctgaatgcatgcctacaaggaatgcaattggttgcttaagaacggaggaaacatgttatggaaatctatacttctcttcaaatgtttgtaccactcacctacccaattcccttcccaccccaatcaaaagacaaatacccatgctcagaacctgggggctcacattttacctgaaattccacaagtaacagaagcacacatttaggggataaaaccctagagagagagtaacacaatcctggctgccatctcagaacaagagagcattgtacccagagtccatgatcacatactggaatgactgtgtgacggagctgacatgccccaataggtacaacagattgttctgcttgtaaccaatcaataccacaattaacaaatatttattgaacaccccggaagcaccctggtatatactgtcctcatcagctatttgttagaataacacgaaacctcctgatcctctgtctgccttcaggcttgcctctgccccaataaaatcaattctctacatcaaaaccagagtgacttttcctaaaatatacacatttgaccaggtcatttaccttgaaatgttctggttgatgttcagcatccagataaagcccacacttcccagcatgacctaagaacctgaccgtgtgactctgcttccctcttacagcttctccacacatgttccagcgtccaggcactctccactcctcgtgcctcccaccatgcccacctctcttgtccttcccatctttatgtgccacataacagcggctaagagtgccggcgtcagagctcataaggctttgattcaaaacccaactctatgacttaataattgtagagtcttgggtaaattactggatgtttctgagcctcagattcttcgtatacaaaaataaaccaccagcctcacaggattctcataaggattaactgtgatcatatttaaaatgtttagcacagtgcctagcccataattaagactgagtaaatattgctattgctatattgatgtatggaaagcccttggcacacagtagttgtttaattaaaaaaaaaaaaagatccttgtctccgggagcctcagtttttttttgatcattggaacttctcagtgtgacattcagagtttgatataggagtggggatggcattggtgtgggtagagaactagggttttgagggaaagagagagaaagttgataggaggagcatagatgtaaaaaccattgtgtgtttccatgtgatcttccttccgtttgaatatgactaaaaatgtcattcgttttggggcagggaaaaatggtagactaggattcggaagaaactgacattctgacgttgagtaagtcactgctttgcgcctttattagttcatatgtaaaattggttcatcagatactgtttttgagagctttttaaagactagaaaacataacgtgaaataaaatgacaatattatacccctaattctacatttacagcatattcaacatttttttgaaagcaacatttttgtttacacataacagatgctgaagcacacagccccctagaaatggaggttgccaggaggataaagaagatcatgaatgctgccagtgtctctaatctttgccctcattccttgtgtgtctctcatttgagaagttctcacctttcctgggggttctctggccagagtgtttttactctgcaccactctacctgccgttgactgggttaccttcataaaagaggaatctgaagggccttatgggaagagtactgctggtggacacatggaatcaggaagcatagtttgaaatctagcacagattaaaacttgacctaacactcaaaaggttttcttctctgtgatctagggctctctgtggtcaccatattgcatcactatgaggtttaagatgaatgtgtgggtacctagcaaaggtctggcatgtgatggatacaggacagtcttgtcttttcctacttggacacctgagatagttccccagtgtaccctgaatatctgaatccaaaatcttcagtcaagaaggagcctctacggactagatccaagcctccctttctgatcttatttctattcattaccttcatgctccccctcccgtccataataattatcctccagactcaaggcccttcacgtgatttttagtttattacaccttagcttttcctttcttctgtatagactttgctgtacctgcaataagtgatacctttcccaggtccatgggacttgaaaatcctgtttccatcaagcttttccgcaaaccacccctcctcaccaggtgggagccatcgttcattccctgttcccccaatgcatgttgttttgcttctattatagctcttatcacagtctgccttgtagcatagtcatttctgtgtgttttccctctggattcggagcccctggagggcaaagactatgttttattttatgctgtatttccccacccccacagtgcctagtgcagtaggggtttggtaaatactgcttgaatcaatgcatgaatgaaattgcctctcctagttctgtttgcaaggctgtaatgcagaccaggtgaatgtagaattttggcttactggatttagtttagcataggaagggagttttccaagaagcaatagtggttttgaaaacagaaattgcctttaatcttgtggaaaacatatgccagccctctccataatagtctcaattacaggagagcatcgtgttactgtaaaaacacaaataaataaacccatgacaatactgtgtttgggagataaaaaccacataaaagccatctttccccaactctccagcatcataattagggtatttctgggaggagaaaaaaaagacaccagcaaaaaacaagtgatactatgtttaagaacacttcttgctattggcaagatgggagtagggagttagattttccatacagcacaaatacaagggttcttcccagctcctaccaggcttgatgctatatagattacactgcatgataaatttgggcactagaggtgccaaagatggtggcagaacctggagggcagaaaatgtcacccagaaggtgatgctgtgaaatttattgctctgccacactttacctaaacatgtcctattattctgaatgctgggtcttcattggctcagggatgcccttggtgcgtccgttgccatgggctacaactttcaactgtattttgtttattgctggtcatttaagtctctatctggtttttttttcttttaacttgagggctccagatttaggttcttttgaggtaagagtaggaatgactttgaaatattgcctacttttgtcagtattagttaacaagcactgagggctgaatgacactgaacagaacccagccatttctcagcacctctgttgccactaccctggtctgagttgccatcatgtttcacctggactgcctcagtagcctcccacctgacctctttgctcctactttgcctccctgcagagtgttcttcactcagcaaccagagtggcccttttaaaatgtactttagatcatatcactcctcagttcaaaatcctccagagtgcctcccatttcactaagaatgcaattcaaagaccttacttaccatggcctacaagacactgcacggtctagtgcctgctatctctcaccccatctcctactatccccttagattaatcctctctgacccttcagcttgcttgctgttcttgaacctggtcaagcatttcccaactcagagtctttgcattattgttctcttagcctggaacatttggtcccagatataaacacatggttcatactctcacttccttcaggcccctgagtgtcaccttgttggggaggtcctgtccacctgtatttctattgctggagcaagcacttaggaagtctttgttggaattgtgaataagcattgcccagagattctagcacatttggaaaaagagagtgtggtttagaaggacagtggctctggagttggagcagttgggcactgctgggtttgcctgccccccattggatagatggctgatgttgggaaaattatttaacctttctaagcctaggtttctctactagttaaatgagattatgtctatctctcagaatcgttgtgaagagtaagtcagataatgactgcaaagtgcttggcaatgagtcttgtacacatactgggaggcttcctaaataccacttctcacaaatcctacttcctgcttgtgaaatcatgttatatggaagaaggggagtgtctgaaaatggtttgaatcttgtgtgtaattctcaagtaccagcaagtagttgtgattatatttaaagcacctagccctgtgcttggcatatggcaggccttaataaatacccaagtcttcctgcttttaatcatcagacttagactctgggtgtgaactaaggtagctctgtgggcacacagggattttggtaaacagaaaaagaagtcagcagctgaggtaggggtggttcacagtcttgcttgtggttcaacagggactgcatttatgaaaatggcaagtgagcccagggcaattggaactttgggccttgccagcaagtgtggtatttcagtttacatcctcagagtaagtacaatttcaccattattccattgaggctctccttgccaagaaaaacccattgtaaatttctggtttaaaggttctgcagttttagggagttgtactttttgttgctttaacattttcttggcaccacacattttaagctgcactggcttaccttgtaaatagtatacacattttgtgaaaagctgaaccacgtcatttgttttcctatgttccttatgggaaatggtgatgcttctgccccactagttcccctgggtttctgatcaggcagtttggagtgagaaaatgagactgagacaaaatatagattgtcagcaagagattggagctgtattcacaaaagcactttgtggacatggtagagccaggcaggagagaaaagtctgtggccggcagggtgtctgtgtgacgtggacccattgtgtgtatgggctcctcccgctgtaccagtggccagctcccagccaggccacccgggcgagggcctctgaagcagagagccctgcacagtctggagccgctctaacccagtgtactgaataggactccaaagaataggagctgtgttccctttgtcacctgcaaccctgctttcagcctgcacagtgaatgtgcacttgggggctgaattggcacttggaaaaatctgcaggaactttgtgtgtgcacagcgtgtgcccagcggtatgggcgaatggagcgtgcacgctggagatgtctgggggctgggtgcttgcagaggagggctgacctctttatgctgcagggtttgccaagaatgctccgcccttgacagtgttgtggccaacagaaaagcattcgtggcatcttaatgaaaggcagcagttccttttttcaagaatgataggcattcttttcttgagcgaggtccccatttagggatggagagagaagccaattatttttcagttaaaatttattttttaaaatagtgatgcctcagttgtaaattaccctggctttgccatgaagacatttacagctagccttctgacttggttttaagttgctgccttgtagaataataaaatagtagcccaaactgtgataaggcatcaaagactttcatatcctatctgtgtagctgatgtgcgttgctccatagctagaaaatggatatattttctgaaagggaatgggtgtatttccctttaccttgcagcttgcacataatcgaacacttcttttattgaaattgggggttttctcccttggacttaataaggagatatagatatctatatatctatatatctatatctccttaagagggagtttcataagttcaaaagttgtcaggttgaaaggattgaggtattggaaacaacaatcttaaagttacctttggaatgatagatctttgaaaaaaacaggtagtttatagtacattggaggaaatgctctgttgttttgcatcttctccaggcctctttatgactactttttttttgagatggagtctcactctgtcgccagactggagtgcagtggcatgatctcagctcactgcaacctccgcctcccaggttcaagtgattctcctgcctcagcctcccaagtagctgagactacaggcacatgccaccatgcccagctaatttttgtatttttagtagagacagggtttcaccatgttggccaggctggtctcgaacccttgacctcgtgatccacctgccttggcctcccaaagtgctgggattacaggtgtgactacttttttaaatgcttcaatgaaacttaacatgatgacctacacatttcagctgcgcatatgttctacctgttaatggtgagatacaacagagccatctttgactacttcacgctgtttactctaagaggcctgtatcattagatgacttcctgttggaagcagtaatttgtgtttggacttgggtgactgtcagtatgaatctagccaagaaaggtcatgtcacctgctacacagtttgctagagggaatacaggccaagccttttgcctctgaaatcaaagtactgtagaaggtgtaatagaaatgatgcctaggtttgtgtattcagggcctgagtttctgattaaagctgttaacaatgggggcaagctttccccgtgggagacaggcttcttggatctaaacctttctgacatctcaaagctttatttcctgatgatttctaaaagggaaggagccagccccttgaaattaaaatatcgacttacattccgttctccccagacggaagaatattagcagattgaatcagttggggttagtactttcttttatgtgttaaactcagttattctggctaagatcagatttttgtctaggacggagctgaaacacatgcggaatcttgttggttgagggctggaaacgaaggttggcttcacacaggttgcttctccaaaccgtaggtaagctcttcggccccgtgcacagcattcacagctgctgtctgctgcgctttcttgctccatcctgtctagtctcagaagtttcatggtactaatatcttggatccttacaaaggactgacttttgacccagttgactgataactatagagtactttacagtttaccaagagctttccttcatgtttgctctttacatcaaaattacaagatgggttttattatccacattctttttgtagatatgagggccagagaggttatgagttagccaaagtctatccagtaattgacagagccaagattctaggctgggacatctgattccaaatctactgctcttcatgctcctttatactgcagctacttacctgctcaaagtatgtcattcactcattcgttcagcaagttcttggtggcatgggctttgaagccagacagctgggtcccagtatctgctcactagctttgtgacctctgttacctcttggaacctcagttctttcatcagcaaaatgaagatagtaatagtacctatctaggaaggctgttgtggagtcctttaaacagtgctctggacatagcaaatactccataaatgtttgccattcttcttcatcatgggctcactcagtggtacagggactccacaccagtgacagcactgctgttgaggatcacttgttctgatgcaaatatgaaaatagaagactgacaattgcatagtaaagggattgctaagatataagcaggatgctggggaagcttgaaggatgaacagctgtgttttcgattgccaagaactcggctctctagcagctcacccttgttgcctctacccctatttggtcacattcctgtcttactcattccttgctgaaggcagtatttaatgtgcaggggttttatgggtactttgtgtataacctctttgaggaggaagagaaggagagtatgtctggctaagggaaccttagtggtcatttgggattataagacctatatttaacagttggaggactgttcaagacaaaatagattccaaggttctggtgtgcagtgttctgtctgagcaccacaggatatcatatgtgagtggcttccagtgggttgctgagggaggggactttgtgggggaagtaggccttgagttggacctgaaagaaatgaggatttggattatgagtagcagaagcgtggagagctgggcagaggtggagttatgatatttaaaccatggcctgccttgggtggcgggacagccctgcccggggatgtgggtggtccaggaggcaggtgctgtcccctcctgcatgagaacctgcctctggaccccaacaggatgcacacagcttatccccaccctctgcaaagctacctaataatatctttgtgtttatggtaatgttttttgctgatttggtgggagataaaacctagagagacccacagcatggatgctaggtctgagtgggtctgtgagctgcaacctagctgcagcccctttgtttgtgagctgtttgcctgcatttaaatgccatttacataaggagctgtcagagttgagttggcccatgattattccttgatgtatgttgaaaaaagagaagaaaagaaaaccctggctaatgaggagctgggttccttttctccattgatgacagcttcctttctgatctgatggtccgtcagaaactaaggtggtgtgtgactgtggggttatgtccccgctgaagccgtcttttcctcagagttgtaattgatggggagacctgtcacttgttatgctgatgctgtgcagatttttgtgcagctgccagccaagagagttgtaggacagcatctgattgggtgcaggttgtggcaaaaatgataataaatagagagctggtgagggtagattttgattgacccgagattgtatattattaaactggagtctgcatgtacatgtcagtttatgaagaaccagacccataatccaactttaggactgtggcagttcgggtttattaaatgtgctttatatcactattaatattgaggagcaaagaggaatatctgtaatcttttaatctatgcaataatggtttggagggagattaccagatacattggactattgtttgtctataattgtattcagaactctccgaagcattgatttgtttctggcatgctgatttggctcagcagtctcataaagctcttttatagtcctctttgctttgtgttttccaaaaataattggagaataataataatgtggctggcgataaagaagagagagtaaggttgaaagcaaatttctagccgagtggatagccataaacatcttctatgctcataaacacctgggtctgtgacctttgtgtttataagatatttatcgcctcatgggctctctgtttgggggttaccacttcagtgccttgtaaaatttgattgtgtttagtaagtagattctgaatttttgctgagtagggaaaaagtgcccctcacctttgttttctttggaacaaccaatctgccaagaggggcagatctcaccaaggacaggagcagagagcttgggtgtgcctgagttttgtggaaatggtacagtgggacccagtaagggtatcttttgtacttgattaagtggcttgtgatggaaatgacttttgaacggaagggaattgtgcaacacatcaaataaactcaagcagtgtcgatgggttttccttttccagtagaaatggaatttttgattcaagtcgaggaagctttcttgggatttggatttttgccacttcctcaccctttcttcccatttccaaaacaggcctgaggaaatgagccagagaaatggtcaaattcagtttcattgactttaatacgaaggtatgactaagtgctgcaaaagcacagttgtcttctatcttcagcagtcctctaaacatttcttggggaagttttaggcactttgtcaacctctattgtcctcctgatggtgttgcttaattactcttgaaggaaacagttggattcctgtgaactgatgacaggtgtatgctgagctgcctgtgtaaactattggctgcctgttcatgttgtgcacagtggatcagaggcatatgggagaatgtgccaaaacgggaatcttaagggagttttttaaaaagtaaaaattgtttgcttttttgctgtggtgcgaacatggctcacttccgccttgacgtgctgagctcaagtgatcttcctgtgtcagcttcccaaatagctgggaccataggcacatgccactgagcctggctaattttagtgtatttttgcagagacagggtcccactatgttgcctaagtgggctcaagtgattctctgtgccttccaaatcattaggaatacaggcctgagccactgggcccagcccccagtaagctttattataactcaactagcttcattataactaaagtatgagccagtcttgaggtgtataggacctatatttatcaaaggagactgttctacctaagacttagtttcttgtcctatgaggttaattgctgctgcatttcatggagtttatgagatgtgcttccctctgcccttcttcaatcagatggtactgcctgggagtcatatacatgcaggactgataaagagcggctcccacagtggcagtacctacagtggactgtgctgtaggtaaagggaagctccatcacactggcatgtgggaactggactaaaaggccacgaatcccccaacacttactctctgcccagctttgtgaaatacaaaataattatgagttccagactccagagatgctttccacctagttggggaaggagaagtttaggtcagtggttctctaagttggtccccagacaaggagcaccctaattctctggggatttgttagaattgcagattttggggcatcgcccagactaacagaattggaaaccatggatggtgttttacaaactctgcaggtgattcagatttatgctaaagtttgacaactcctgctttaggttcatcagttccagggggaataaatgagtaaacaaggcacatagaattaagggcttcctatagggcacagcgaaggagagaataaggtgctttatagcaggatgctaagctggactgtcaatcatgtgggaaaggggtcaaagactggaagagcagggatcatcaaggcagtgtttgctggggagagaagttattgagccaggttttgaggactgaataggagagaaagaggtagagtagcatgaatgagctcagatgtgatagggagggttctgttccttcaagagcttagttaagtgtagtgaaaacacacacacactccggacaagaaaaattaatgtaaaatcaactatagaacttaggcaggtttatgaagaagaaaatatattcctcacaagttggattcctgtgagttcatctcttttattacctctggcaatggtgcaattaattggggccagggctctgcacctggaaaggctttataacgtgagattctcaagaggaagattttatttgcctaaggctactactttaaaagtgagagaggcactcatgaaaattaggggtaactgtaaaaagtgataagctgctcaacatagattcagtgcccagtatgtataaagtgctgtgtgtatactggagagagggaactggaatctaacttggggatgggggtggatccagaggagtagagatatgaagaaatacacatttaagtccagtaagtttttcatgcacctgtagtcctgagaggtgaagccagctggacgtcctgggtcgagtggggacttggagaacttttctgtcaagcaagaggattgtaaatgcaccaatcagcactctgtgtctagctaaaggattgtaaatgcaccaatcggcactctgtaaaatggaccagtcagtgctctgtaaaatggaccaatgagcaggacgtgggcagggacaaataagggaataaaagctggctaccccagccagcggtagcaatgcagcactgatccccttccatactgtggaagctttgttctttctctctttacaataaatcttgctgctgctcactcttagggtctgcaccacctttaagagctgcaacactcaccgcgagggtctgcagcttcattgctgaagtcagggaaaccatgaacccaccgggaaaaacaaacaactccagacgtgccacctttaagagctgtaacattcaccttgacgtccaaggcttcattcttgaagtcagtgagaccaagaacccaccagaaggaaccaactctggacacagtccaagctactccagaggctgaggtgagaggatcgattgagctcaggaggttgaggctgcagtgagctgtgattgcaccactgcactccagcctgggcgatagagtgagacagggtctccaaaaaaaaaaaaaaaaaaaaagtctagtaagtttttgttttcctttaaaggcagaggggagccactgaaggttattgagcagggaagtaacaagattagagttgtaatcatgaatctaattaaaaaatcagtgactggagggaagtagatgggttagaaggctagtctagttttaatactgtgaggcagatgagaagggcttgaactagcagagttctagaaaaatggtgatgtaagcaacaatagagtcatattagttaagggtgagagggaagaaatatttacaattcactgtggaccagccacttatgcctgtcattggtagagcttaaccatcacaattttagcaacacagagattgatttttatagaaggtccaaaggatatgtagcttggagacatattcaagatttgactcatgctgggtgttatggctcacacctgtagtggctcacagctacctggtaggtcaaggtgggaggactgtttgagcccaggaattgggaccagttgggcaacacagcaagatctcatctccaaaagcaaaagatttgattcaagcctgcctgcctgcaaagcctgtaccctttttgctctagattctagactttggcgaatagaatgatacattttgtttataattggacagttgttgatcttggcagaagtgttgactgctgggaggtgttaagagaaaggaaaaagcagcataagatatggaagtttgtttgatgaaactgtatctcaaagagtttaagagttttagcacaggacagatagaatcttgccccacccaagatgatggaagaacaaaacaaagtctgtgctgttttctttgttaaccagagttgagagtggagtccaatccaatatctgcctagtgggagtctcttgagtcctgatcccatgagatcatacatatggctgctactcctgttgtgaggaaggttgcaattttagaaataaacctggagcttttgaaggtcctatttattacttcagcccacttactgccgaggtccccatgttttgcaagtgacaaaaataaatctaaaatggaaaactagggagaaggtgagagaaagtgtccagagaaactggggactttgagttgtttggtctaagctacttatttgcatttttgtctccacttcctagcaagcatattggtacttagcaatggtgggaggaaggcagaactgtaaaaaaaacgaagtcatcattctatccttacacttgagtttcctttcagcaacctctctctcccttgtctttgtcccgtctcataacttaggcgtgatgtgctgctgtatctgccttgctgccttctcctgagtggaagctgcagctacagtgttggttattacacctggcaattagattgtgcaggacagtagttggctaggaatggcataaggttgcatgcctcgttaaatctgaactccactcagcatagactcttgtagaagcaagggggatttgtttaggtaaggagcccttgaaaggagcctgcttgttgaactgtatgttgagcagcagtgatgaaaagatgcctaaacatgtgtcccacagcagctacagtccatcagcattggacacattggtagatcacccctgctgttaacacaggtcttttcagcttactcgtttgtgtacttaactgttgagtgctcttttaattaggggcgactaacatcaaagtactatagttgtgccgggcctgctaatcaacaggtttcacttatactggggatcacttcagctttacaccaccattatcatgacattgatttttctgtgcacataaaaggaagcacttactgaatacaggaaaaaatcatgattgctaggtggaaaaaaaaacaaaaaaccagcaagaggaactcagttacccagggaaaatgtaaacgtttcatatgaacattgacagtgaaatggatttgatgagttttgaggtgattttgttagatactttgagagaaattgagaattctgtattccgaagagacagccggacttgaaactctagaggtatgattttgaccaagacctgaacttctctttgcctcagttttttcatctataaaatagggttagtaataataccaacctcactgagatattgtgaggattttgtgagatattgtgagattgaatgattagcttagtcactggatgtaagtactcaaattatagctattaataagtgtgatacggctgggcacggtggctcacgtctgtaatcccagcactgtgggaggccgaggtgggcgtatcacaaagtcaggagttcgagaccatcctggctaacacggtgaaaccccatctctactaaaaatacaaaaaattagtcgggcatggtggcacctgttgtcccagctactcaggaggctgaggcaggagaatggcgtgaacctgggaggcggagcttgcagtgagccgagatcgcgccaccgcactccagcctgggtgacagcgcgagattctgtctcaaaaaaaaaaaaataagtgtgatacttaatgtcataaatcattgttattatttctgagaactgatatcttgtggtccattgttgtggcagaagtataatttatataggaaccgaaaccagccctcgatttttttttttaatcgccgatcttggttgggcttcactatcattttcatcagcttcacaacccctcagttctgagaaccctccttgccatacaagccactggagtgtctgcgtttcctttctgtggacattgtcacctttcccttcattttggtaaggccatggaaacagagcaatcagataaaagacctgggcatttggcactttcattggccatacttctccttctggcttgagtttatatgtggtttggggtagttactggtgaaattgagctttgcagctgtctacttaatctgcatttcctgatctgctttggctggcaatcaaaagctgtatctatttcggagattgcgcaataagacttttaatgacaagttaaaagacaaagggttggtgggattgaaccttatgcagaaaatacttcactatacttcggtggctcctgtttactggtgattttgtgtggatagtaacttaaaatcaagaaacatttttgctaacatatttcctgggccattttagaaagaaatttctttatttagccagtaagtagagctttctttagcgtttacatagttatctttttaatattaatttttgcaatccatatgaatgaggccacatgtcctttaacaattttagacctcttctgttatgcattactgccatctgtcagtatgagagaaagcttcctggggcagaaggacttaaaacaatggttctcaaccctggggtcacattagaatcactggcagagcttttaagaaattttagtgcctgggccagttccagatacatagttgctctgggatggggcccaggcattgatgtttttaaaaaactccctaggtgattctagggtataactgggctgagaggctctcctccgaaagcactgtcttaatggaagaaccagtggcatgagaacagttctgctttttctcagcagtaaccttgttgtcttccattgcagtgctgattttgacaatggagccatgcggttgtatttgggtagcggtttggagggtaacaagtgtgtcttttgtatctctgaatcctctgcagccagtctagtgcctggcatatactagatgctcactatcctccacttcacttcttttggatgactaaataatggaatggagcccagatgtactagcctttttacttaatccctgagcctttctccttcagtggtccgtaagggagcaggtccacaagcatacacttttattgttccaggaggaggaagacgcccagcttcggaatgcttgaggcataaaactgatccttggttaagatcagcagaggcttgctgtgtgcaacataaattgtcaggtaaagaagcaattaacgtagtgccatttatttcctctttaagcatctagtccttatgagtgttgtggttctgcactccaactggaaacaggttctctattgccctgttttgctcttaaacacagacacctttttcagtcaagagaattagggccttttaaaaactcttctttctttcttttcctttttaggtagcccatattgaatcaggtcctgcagctatagttattcatgcagggagaattctatgaacacaggggagaatggcctgggagtttgataatttgttattttttggtttgtagattgagaagtatattaagtaaggataaccccttatagttagttagttattttatagttttcctgtccagaaggttttaatctctcacacggctgtggactggcaaagtaactaattattgtctccagtttatggataaaaaaatttaagatgcggcaaggttaagtgacctgcctaaggtgatagacctgggccttgaatccacagcttttgactgtaaatcccttcagtacactgagctttggatagtacttttgcttggattagaacaccctataaatgtgactaatggcatctcagggttctgtcctggctgtcatagttgaatcctttatttgcattgcatgtgcttgcttgtgtgtgtgcgtgtgcaactattaatattaagcatcttgccatttgcctctgtagagcacagttgatagacgggaatatacacttgatgtagtcaagagagtgtcatcttttattaagaattctgatcttgcctctccaaaatgcctactttcacttttagtctattgtaagtgtgaatatttgtgtgtggtattttattcctaggcaaggtgtttttctcagtctatgttgtgtgtctaggatgataatgttaaagcttaatatatttagttttggaagactacatttttctggggtggtttatgagttgttttccttcctccaacaaattattgagtgtctagtatgtgttctatgctgtctacctttacttccatctcaaggaagtctaggataaaaataacattgtttatctgtgaagggataaagagtcaacacccatttcatgtcagctctgtctttattaggcatttggctattgagctttctaatttcttgacttttgggagtgtttctcccagttaccagacaggtccagggtgggaaatgctttccttgggccccagaactagctcatggagaggtggttgtagcttctgggaattttgaaaagagccacacccaggaatctgcttggactatgtgttctttctgtcctgcctttactctcctcttttctccctcttataagcaaagcgtctttttgcttccttgcccccaatcccagagagactgttaacttatgtttgcatgtaaggagaacagtcagagttaaggatctcaaactcaggaaagtggtttttgtactcaagagctccctgtgtgtttgcgcagcacacttacctccatccaggatgcacttatcctgcgtagatggattgtaaccgtgatagagggggaaaaagaagaggggaaaaaaaaacccctaaaaaaaccctggattctgaagatggctgcagtatattcttcaatagaaatttgaagcatgaagtggattttagaacaccacatgaagctcttcttacttaaaacacaagaacttaaaacttggccaggggaaaggtgtagggaggtggagaaaagcactccttccatttaaggggaagtaagcacttgacttcatcaattgtggttaagataaacaaagcttatctttttggttggcatcagaaggggcatttaaagtctcatgaaatgagagaagggttgttctgttccttatttactgtacttgaacggagtcactgaaaaccttgatgggatgtctctatgactgctcattcctagttgtctgcagcactgtggccagtgaatatgctggttcccacagaggaaggcccacagcatggtttccttcctcttcttttaattttgcctcgtgtcttttgtagacgagagtgctctgcagtaattcttttgtagaaactgccatgcctcaaatcacattacataatacaggctggggaccagcattccgtgaggacttgatcaatgggttgggaaacaaggttgatagcattgctgtggaggagatgtcaatgcgaatttgtcagctcacctcacatccttgcttgcagaactttgattttatttaggtgttcacttccatgtggacttgagttcaggggggtacatcttgattagtctattccagtcattatatttctactccttgtcagtgatgggcttaggaaggtccaggtctggctggctggacatgaggggaaatcttgtgtgggcacttctagaaaacgtttccttgattttgatgaagagaagtataatttctatctggttgttgtctgcatgtggtgctttgaaattggcagttgccatctttgaaccgtgagccagcgtaagaggacaggcccacatgcaggggacagcaaagctgtacaaaagatagatactatctttgatgatattgtggagctgttgaattgatcagcctgagtccattccattttgggacttcttgttatgtgtgagaaagaaaaatcacgttttaactattttggctggattttctgtttccttcagtctagtgtattataactgataactatcttaccccattcatacaggatggtttgagataaaattagaaaatattggaaatgcttttacacaagtatgacacacacaattaacatagacattaacataaatattatattgtaatgtccagtgttctcatactttgcttccatatcacttctgctagcattttctccaaagcaaggggacaggccatgaggatgaaaaacagccatttaaaaactgtcttgggggttttcagtattctttctgtaagaattgacatgatacataactcctaaaacatagtataaggcaaaaattattctttcctgatgaacttgtatttcttcttattggaaagtggcaaataaaataatccagtataggaggcatcatgctacctgacttcaaactatactacaaggctacagtaaccaaaacagcatggtagtggtaccaaaacatacatatagatcaatggaacagaatagagacctcagaaataggaccacacatctaaaaccagctgatcttggacaaacttggccaaaacaagcaatggggaaaggattccctatttaataaatggtgctgggaaaactggctagccataggcagaaaactgaaactgaaccctttccttacactttatataaaaattaactcaagatggattaaagacttaaatataaaaccccaaaccataaaaaaccttgaagaaaacctaggcagtaccattcaggacataggcatggggcaaagattttaccatgaaatccccaaaagcaattgcaacaaaagctaaaatggacaaatgggatctaattaaactaaagagcttctgcacaacaaaagaaactatcatcagagtgaacaggcaaccaacagaatgggagaaatttttgcaatccatctgacaaaggtctaatgtccagaatttacaaggaacttaaacaaatttacaagaaaaaaacaccaccaccaaaaagtgggcagagggtatgaacagacacttctcaaaagaagacatttatgcggccaaaaaacatatgaaaaaaagcccaacatcactgatcattagagaaatgcaaatcaaaaccacaatgagatgtcatctcatgccaagtcagaatggccattattaaaaagtcaagaaacaacagatgctggagaggctgtggcgaaataggaacgcttttacactgttggtgggaatgtaaattagttcaaccattgtggaagacagtgtggcgattcctcaaggatctagaaccagaaatgccatttgacccagcaatctcattactgggtatatacctaaaggatcataaatcattctactataaagacacatgcacacatatgtttattgcaacactattcacgatagcaaagacagggaactaacccagatgcccatcagtgatagactggataaagaaatgtggtacatatacaccatggaatactgtgcagccacaaaaaggaatgagattatgtcctttacagggacatggatgaagctggaagccatcatcctcagcaaactaacacgggaacagaaaaccaaacagcgcatgttctcactcataagtgggagctggataaggagaaagcacagacacaaggagggtaataacacataccaggagcagtgtgggaggaggcaaggggaaggagagcgtcagaacaaatagctaatgcatgcagggcttaaaacctagatgatgggttgataggtgcagcaaaccaccatggcacacgtatacctatgattacataggtatacctgtacattctgcacatgtatcctggaactttaagttaaaaaataagtaaatacataaatacataaaaattcagtatgttttcttgttgtcttatttcaccaatgagctcagatccaactttaatggttaataacactttgtctaaaattcctaatatatcttctaatattttctagttggttttatttattttagttattttaacaacagtgagtgatctgtatcacatcctcctggaagtaccttggatttcattataactgaggaagcgtttgttatttgtttaaatgagtgtcccagatagcttgcaatggagcatatttatttgtttactctcttatccattcactacacatttattgagctcgtactaaaaattagccagacacttaaatcgttttctttggcttgattgtagagctcataaacaaaagtactaggaatttagaattgtagatcacagagcattagaataggggaaagtcatttttcattgttgagcctgaggagagtttcgaaggtgacttgaaggtattgatttgaggaatgccgatggttttcatcttcttttcccatcactaaactaagtatactcccttcagaggtagagagccaggagacctttatagtagtgaaaggacaggaaaggaaggctttcatagacagcctggtactggagtcagtattcaacagtgaaattctggggtatagaaaatagttaatttatatactttaattcccacctgatccccactccccaagaaggttggaatccttgtttttcctccttttggaatttgctactttgaagggtttttttcttttgaaggaataagaacagtctgttcattgtgctatttagtgcaattagaattagggagcaatatttgttctgtgagttatctaccctgacagaagctctgatagaagctcagaatagttaactgccctcatagaggcttggggcatcattgctggaaatgagatgcctaactccaggacttcatcctgtggactgcagaattaaacggaaccaaagaaaataagcaacaaaaaacagttggaacagcttctcagtggacttactgctgccagtcttggtggggaagcaccagtgcttcttggactctggctactttgatcttcccagggtgctggagaacctggaaggacccaggttgtctctcctatgtccactgtaagccttggtaagaagcatgaaccttctgtaagccaggacccaactgaccttttaagatttttttttttttttaatcatctgaacatgctatgccgttgtcttggcattgctttgatcccagatgtctcagttttaaagagcacctacactaagtggcaaggagaaattagaattatccatattgatgatgaaaaataaacctcagagggcttccaattgcaccctaattcttctcccttaggatattgagagagtgaggtgtagaatttaaagttaaaaaattttacatcactttacttaataattgaaagttacttggctttggcccttggcatgatttaaatcacaatggatttgagagatgctttgtcattgacttaattttcagggttttaactcattcagtaagttggcttggcagccctaagcagcattagtattttgtgtgacattttcaaaatatcctttgaacctatggtaatccctaaggcagccatgttctaaaactcagagaaggacctccccaggggcttgaaatacctgtgtttcctcccctcaccgacaaccccctaccctgctccccatagcaatgttttgaggttgtgtgatctggatctgggttgaactcctgcagcgttttaaaccttttgtttctttcttctttaataacaacagtgtttcttaccctggtcatctattgagaagtgtaggtgaaagtaagcatcaacagaatggtgattttgaatatgggaatgggttcttgggagccactgatgtacctatagggactggggatatgattggtagttctagaatgacgttgcagttgctctatacatgacccatcacgtggaagatcctgacctcagcagcacacagcaagcatgtaatagctgcagagaataatgctgagcactagtcaactggtaagcattacagactcccctgcttctctctcccatgggtcaactggtgttgaataacagggagactagtactttggacatttttacctactgaagttgactcatgctgttcctttagaaggctaataaatttttggtgattaactgaataaattaacaacaggctaagagaataattacagacctatttaggaaatctagttcttggttttgcttggagattcttgccagaactttaccttgtaagttagatatttttacctgttgcttctcagaaaaacctacaagcatactcttaggtttataccttctatccctaacaacaacaaaaacattaactgtaaactgcctcctgttatctgagggtaaagtcgtaaaaatcaaagaggaattttgaggagaaagtcttggtaacagaaaatactaattagttgtctgtgttgtgagatgtgttgcttgagagtgtctgagcttcagagaatgtataatttccctccttgatgtccacaaggagcttctaggatactttattaaaagacgagtaatcagttattattcttcgtaggtatatctcaaactgcagctttaaacagaatcaactagagggctttgttacaatacagattgctggactccactcctggtggtatggtaggtctggaaaagggcctgagaattaaaatttttaggtcctccagtgatgtctaggttaccggtccgggaaccacccattaagaatcactgttgtatctggtcctctgcctctttctgcacatcttatatccatgcagcaggtatgaaaatgagctccccaaaagcattcaccttcactgttgacctgattattatataattataattggatctcaaccttttaaaaggccaatcgtatctgaactacatattaattataaatcttagtgaaagctctattatattatctcaatttttttttcttttgagatggagtctcactctgttgcccaggctggaatgcactggtgtgatcttggctcactgcaacctcgtctcctgggttcaagcgattctcatgccttagcctcctgagtagctgggattatagatgtccaccaccacgcccagctaatttttgtacttttattagagtcggggtttcgccatattggccaggctggtttcaaactcctaacctcaggtgatccgcctgccttggcctcccaaagtgctgggattacaggtgtaagccactgcgcccggcaattatcctgatatttgatcctgaaaaatcttgcttgaacttgaaacttgtcctagaatgtctttgaaaagttcatattccgataagtgtattacattctacaacaattatgctaaaaggttacttcacagaaaattatatccacactcatgatagaatcatttggaagtttaaaaaatatggtcatggttggactccatccaagactgattgaatatgaccctctgggattgggcaccaagtaatatacaattttgaaaaatttccaagggattttaatgggcagctaggtcatgaaccactgcgataggccttggagagggaggggagcagcagggctctggtaagtcctttacacttgctttaacctgctgctctttccccttcccactgttaaactcccctgcacctctacgtcactcttctttacaggctggctagcgtcatcacattgtaggtcgttttctgtgggcttaggaaaacagtccaacagactgttaccctagtgcgtgcaatgaaaggcctttattcttagggttcaaattattttacaacgaaattgtttagtttggagcctagccagtttcatctcttctatactccaggttgatcttctgttttagatggtgttcctcactctgccttcttcacctgaataaaggaaaggcaggcaatgtttccagagctcctgagccacccttagtgctggaggcaggtttaggaaagagctggctccctcattgctaaacagaattaatgttgttcaatcactttattctggctctgtgaaataatacacaggaggaattgctgctttatgactttaatctgataaactacctgctctggtgtgttacattctgtgtgtgtttctctgccaccactgcagaataatctcagccttatgtgtagcaactagaatgcaaggttcaaaactcaaaccaagccttgatgcagacgtcaaataagaactactttagaatgctctgtgataatgctaggcacttagcatgactgctggggctcctaaaaggagccaggaagcagcagagcctgagaatcctataacatttccttttgagcttgggcctgaagcagccaaatgctgtaaccaaataaaagccagtttaccttttgcttttcttatgtcttcttttcttgttctcgtcttataaattatgttcacacttttccttttttcttttccattcatgcctttcctccgttttctctgtactccatgcatctgccgcctgtctgcttgcttggtttttcttctgtgttctctcagcttttcacttttggaagagtcaggaatcttgtatattttgagaattagcgaaacatcgtgggtatttatccaaagtggaccttgtacagtctcttttatgctcgtttttaatctcaccaatttctagaatctcactaatttctaggtttgttaagggacaacatggtgtattgctggagatcaagacacaaagagtaacagagcctcagagctcattaatggtggtctgaaacaaggaaaggagaattaaaataatgtccttaacccaggacataagagatacagatagagagatggcaaaatccatggcatatctgtgacggttttctttttttgtagaaaatatcataaatagatcttagaactctgatcttctgatttttcttaacacagtactctagggagaggccactagacaagatgaatcccatcactgttagtgggagcttagagggaattttaggtgagggaaaatacggagataaatgccatcttttgagataggtcttttgattcagtgttgaagatttgtgtcaagagactcccaaaccataatagatattgcaggccttccctttactgcctgttaacccaggcatgtgacaagagcaagatttctagagattgccatagaggaagaataatttcagtgactttgggaaagcctgaagactgatttagggtgaaaggcacatgtcattaaagagtttcattatagattgctggttttattaggaggtaagtggttggagacattcgtttcctggaatcatgtaggacatttaaagtgttgaatgctatatacaacaccccagaggtgaagaagatgtttatcaatttaggtgcacagatgtcagtctgattattgggaagagggtgaagaggtttgacagtatcagagtatggacacatttgagcagcagcagctcattgtcctagaacgaattgcctcctggccgtgatttattgacatagctgatggagggactcagcagaagccaccatttatctgtttcttcagttgaccattggaaagccttacaaaattatgtgcgtgagaaatgtcaaagtgacagatttgggttcaaaagattgtacacttttatacatccaccctttgcccttctttttggacttgagtattttagacaaaactaacattttcttcagcttagtataaacagatttctgctcagattagctgagaaggcatacaccatgttatccttttatggatgagtgatacatgtgatgtctttgtcaaataggaattgccctctgccttgtgtgtttggagagatgactggccacacctctgaagcaatcagctgtggccaaattaacataatatggtacctgtacataaaactaaatatagaacaattttatctttttgtagtaaggatactatattccgaagaattcatgtaagttgaattatttaaagtggatttagggacattcattgtaaagttaatctttggtaaatccttgtgtggtgattttttttctctcctcttttgcatccccatttgaaagcccacaatttaatctatttgggtaaggtagattcttatgtgattaaatcactccagtttatacgcattgaggagtaaagtcaccagactaaactcctcaggaacaatgacagagagttttgccatgggtgtttgggaaaactgcatttactttctgcacacttaaactctgtttcagtccacatatttgcacgcctaaaaaaattaacaaattttcacagtaacaatgatactagcgtttacttattgctcaaaagaggtattgaccgctatagtgtgtgtgaagttggaaactttaggatgatagccatagtttgtacttcgagctcactctagtgggggaaatagacaagaaaacccataattagtacacagtaaatgttaggtatatttctcatgtgaatgtgtgcagtatggtaactgctcgttagaggggaccctatagaattgattacctataagagaccttgactgcgcttgggatagttaaggaaggcttcatgaaatagcgacaaatcagggttagctcctggcctgggatgatggctaaaaggactaaagggcgagtctttgcctcagtttcttatttgaaaatgaggataataataatccaactttatagagattattatgaggattctgtgaaacaaatgcacatagatagttaggcagtcctggtaattgggaagacatcaataatgatgtaagttatccatgtccctagtcctttatttcttacaacaacaatcctttcaagacagtagtactttccctattttgaagatgctcagagaggttaatttgcccaaggttacccagctagaacttggtagggttcagctttgaatctagacgtctctctcctggttaccttttgttctctttatgctactcagggggcccaaaatgattccagctgcttcctgcttcattatccccctaagtgccccactgagaggagtctacaattgcctgcccctcctctccctgcctcctggtcttgccatgagtcactgctgagccatttgtgtcagagaggaaaatgggggcttgctattcacatgtagcaatttgctatgtgttcttgcttatttgccagggacaccagcagagaagcgttcatcaagaggcgtcatgtttgttaagggaccacatggtgtattttaaaagctcttaactctctctggtatcatcgattatgctttagcataagaaataaagtgacactgagcctcttattaataatacacgttttccatttaactttgactggttaaatctggcataaaatgcagacttgcaaaccagcctccctgggatgtgtagcttctcttaggctatttatgatgcggatctctgttgagcagcagcctctgcctgcagctaaggctctggactagatgttctcttttccttttctctcttgatggcatggattgttttgtttcacaaggctcatgttctagatgggattgtagctggtctactacaagctggtctagttgggattgtagattggtatggataaatactgaaatgggagctggtatctgacaactggaggggttatatatgtgcccccatattctgatcaagctttggcattttgtgcatttggcaaaagtcagtggtcaatatttgaagtttgcatgaagttagaagaattttgggctctgaatatgagatgacttagagataatatgtttattttacagataaagaatcaggcctaaagcgattgatgatgatgatgatgatgatagcagaatctctaacaatggttaagccagacactgttcagagtgatttttgtgttaacttgcttgatcttcacaatgactctgtcaggtagacagtattattatccctgttttacaagtgaggaaactgaggcacagagagtttcagtcatttgcccaagccacatagctggcaggtgatagagctggggtttgtacccaggctatctggatccatcaaaacctttgctatctgtgtatcactacactgtagcttgtccagagttacaaagctgggcaggaatagtccaggacccaaatcccagtcttttgttggctgaactatatttgttatttaaagattcttttagcagtggaactcttctttaaatggagatattactagatagcacaaccaaataaaaaaagtggaaacttagctgctgtggtttaagtgggataggccaggcattgaccatgcattccctttattcagcccttgctgtggcttctgagaaagccacatggagcatagttttattttatttattttaatttttagtccctacaacaagactcacagtagggatatgattttaaaccctggctctagttagggatatgagctccagattgctctcttttgggtcacaattaaaatcctaaccggcaacagatatttttggtcagatctggtcattctctctgcctccgtacccattgggggcaaactatgaagcttttgtagctgcattattgtagatttgcaggatttctgttcgtaatcagaatcgggtatgtgttagaaaaaggccttcctgagtgtatgaacccctttgcctgctgacagtctctgggctggagttaacattaacatctgcatgcccagaggacagtgaattgctaacttttcactggctttctttttgcttggacattttacagtgctccagggtcatcattctgggcagtacttaccttgtaagtacctgattttggctcttttctcactcactagtctgtgatctagtcttctctctgtgtctgcagagttcagtcccatttctggagcaaagcagtagctcagtaaatgtcagtggagttttttgaatcactttttattattccagattataggcatatatgtatagatcaagtaggctgaatatgacttaatccccaagtttcttctataataggaccttattttatctctccaagtaatggaataaagggatggaagctggtctagttggggttgtagatttataaacaagacattaatctgaagcttatattcttttagagagttacaagaaaacccaagatctccccccatccccaattaaacactttgttctttgtaaggatagtagagtagtaggagtgggggtattcaggaaagcaggtcttaaggcagaagaatcacatcaacatcccaagttctattcctcactgcctcacgaatggtctgctagccacctgcagttgttgttgttgttgttgtcgtgttttgtaggtaaaggaaatatggcaggagagtgaagtataagaggtccaggagcttggtggaggtggaggagaggggggatggggaaagataaagaggcagataagaaacaggaatcattgtagaccagtggttttcagagtgtggtccctggaccaacagcttcagtgtcagctgggaacttattagaaaggcaaatttgctggtttcactctagacccagtgagtcaggaactctgatgggggtgggcagcgtctttgaaaacctttacttcactaactttttccccctctatcttaaatattcccaattgttttaggttttagttgattcccatattatacttcaattgtgtgtcagtgagtaggtctgtattaaaggagaactgttgaggaaacataaagaaatctctttgtattccaaaaagcgtttctcagagttaaattacatgttttgttagtgtctgttgcttttgttcagattaagctctgaaacaaaattaagattctcgtcaaggcttgagcttattaatagctgtttcatttgtttagcgctaatttaaaatgtctgatatctgtagaggaagtgctttataaaaacacatacttgttaagtgttccactaggagaagcactgtgaagtccaaaggatgtggagattaggcaaataactgtggttttgttgagctctcttcagtgtaatatatgtgtgggtgggataagaacactgggcttcacaggtcgaagaggcttccactggtcagatttcagacaatttgtgcattcaagagaattactgcaactgagtgtaaaacactgaacaaataaaaattcttgaactcatagtgatgagagatggggtgggaggagagaaagagacagacagacactctgggcatcattggaggtgactatgatgtcaacttctcattctataaattgtaaattacatgaaacaaacaccctgtctttactgagaaactgtagttctttcatgattggtaagagaaacctctgctttacaaatggatgctaccaaataaaatatagaaggatacagaatatcagcatttgcatcctgcagtgaaaatttgaacaggcaagtgccgtcaatgcaaaactagttgaaagcatgttggggaacagaataatcttattagagaataacccacaaattaccagcaaaggggaaagtatacccttaacaatggcggtcaccaccttaacaaagtggttcaacttagcatcacagtggtaggatagcctgacagtaggagcttcctgatgtgacgaactacacagcatcaccaacaatttatgccaaaaatgtttaacctgaatctaaccaggtgtattaggctgttcttgcatggctatagagaaatgactgacactgagtaatttataaggaaaagaagtttaattggctcatggttttgcaggctttgcaggaagcatggtgctggcatctgctcagcttctagaaggaggagaggggttggcacatcacatgacgaaagcaggagcaagcaagagagagtgtgggggaggtgccacatacttttaaatgaccagatctttcaagaactcactatcacaaagacagcaccaagccatgaaggatccactctcatgatccaaacacctcccaccaccagcattggggattacaattcaacatcaggtttgggcagggacagatatccaaactataacacaaggtttacagaaaatagaagggtttgaaaaacaaattaatccacaccaggaagaaacagaccaaaaatgtgggtcattctcaagaaaactggtatgtctgatcttttcaaaaagccagtgtcgtgaaacaaattgctggtgggtattactccggattacaagagactaagggaacataacagtcaaattcagtgtacaaatcttgatgggatctggcttaaaaattataactgctgtaaaagatgtttgaggcagttgtagaaatttgaatatggactggctatcagataacattaggaacttaatgtcttaggtgtgatagtattttggttgtgttaggaaaatatctttattcttaggagttgcttattaagtatttcatgaaagtatcatatctgcaattcactttcacatggttccatgagagagacgagtgcatagataaggtgattttggcaaagttttaacaattttgaatctaaatagtaggcatatgggtgtttgttttatatttatatttatattcagcatagagaaagctgtgaattcaggaaaagtttatatgtaatttctgagatttctagctcatgcatgcatttctgtttgagaatgccttatctagaattttttatcaagaaatctgaatggtgtttaagaatatcttatctagaaatatgttggcatcttaatattatggtttggtagataaaatggatttttttaaaaaaagacttgcaaagaagtggatgaaatgctaatataagaaaattagattttataaggaacatgtgaccagataaacttgtcctaattattgtgagtctctttaaagcacataccttaggacattgtgtgttgacgcttttactgttcataacatattctttaagaattctctcagagccttaagatgatttgtttttgagaaacatctgaagtctcctgtagcttattctgatgttatgaagtaagtgactaaattttgatcacagaagtgtgtgacagggaagtagtgggatattctttgcccctctttgtgtcctgtgatgctggtggaaatttcaaaggaagagtttcaaaagtagtttactttgttcaaactctctagccctaaaccatcagtgacaccagtgagtgtttcttattttacctatttgggtgtgttagatgtattttcactgggactattcttttggtcagagagcctaaagttaagtgtttgagcttctggtcctgtgatctcagcaactggacttgattcaggtgctttgactcaagggcacagtggtagcatcaccaaaaatagatgaatggcagcagatccctaatggctggctctctgctggttgcccgtctcagctcaggacttccgagaggtataaaacctcactgatagccaggcataatggctagggtttactcagagatgctgggggcttgagtgtagtattgctctgttgtaggctgataatggagtatgtgccaggtgggggcaggatggtatccaggcagtgtgggcaaagggctgcagttagtcccttgttacactcagtgacaggtgactctgagctgtctggaagtaagataaagtgattcaaggataggatccatacctgaaagagaggtattcagaatagcatttgaagtcaggtagacttcagctcttccaatggacctgcaagaggtggtcaggaaatatctcatagatgaattaaagaagtgttacatgaaaatgtaaaggggcaaaccaaataaaatgggttcattaggtcccaggactagtggaggggcattcatgttggaatggagagtagtgagaattggggaggggttgcataggggcttgttcttagggcagagtttttcaacaacaggtatatataagaggtcaaaatttaggaagtctgttagagaagattataaactccatgaggacaggagacatgtctgcattgttcaacactggatacttgatataatgcctggaaaatagtagatgtgcagtataaatttccgttgaatgagtaaaaatgttaagtggcgaataaaggaatgcatggggatgatacagacaaagcagtaatctgtggtggttgatggctgacctggttgtagagtaccagggggaatgtgaatattttagatttcctcagaggctagtttctgagatgttttgtttaccagtgtggtaaccttctcatggccctagctcaaatggtaatcaactagtctttgcagcacaactgtgaggtaaacatgctgtgtccattttagagaagaggaaactgagattcagagagatgaaggaatttgcatgaaggtccacaactaagaagataagatgtgaaactagatatttcagctcttgaatacaatcttctttttacttgagcgctcaatgctggggacagttctgcttttcaagtggcctgataaatagtatctttgtatcatgtgagagttattaagactgtgatagaaataaataaggaaaaattcacataccagccaatcctcgttactctgcttattcccctattcatcatttggctgattgaatactgaagatgataaagctgaatcggtagagcaatgtgtgattaaaaaaaaatctgctattccacttaatgggctacagttattagaaagaaatagaaaccccagttaatgttagtatgggctacttatttaggaaaggagatttttaaatgaaataagcctttcctttttattatattgctggagacagttttcatttttgcccacctggtacttaaatggttattgctataaggaaaccagtcttactgataaccgaatgaaataaattaaacagacacatgcaaacaaatccaaaatgtgcctgagaaagatgtggtcttctagctttcagtcattcagtgagacatttggcagagatgggtgcagcagataaaactgtcatggttttcagaagtcattccaagacaccagagaggaaacatgacagacactggaaagagaccctctttcagatatgagtaatatatattttatactcatattaatatttcattggagagaaggtcaaaatctacatttaaatggaaatatttaaaaagcagaagcataatatttgactaagtgaaacactcagggtttttcaagaacacaagctgcacccctgggacctcagctctctagatctgttgtttcttagagcacggtagaatgtttgaattcctttagttttatcggtagatcttagccctggcatttaggaatcttaatccctctactccccttccatttgaccccgaattgtgttacatactacctaacagtgtgttcagtgcacagtatggcctctctcagtcctataaaattatttaaatttctaaaaattcatttttctggtcctgtgaaatggacataataggattgtggagatggacataaataagatgctttcaattatgagtaatggaaaacccatctaacaaagtatggtggcaagaagatgggaataggaggcccagggtttattcagaggctgtgttcatccttcgtttccctctgctattcaaagtgtgttagaattcaccttcaggcttctgacctcatgattataagatggctgccattgtttcagaataatttcttcatggcatctaaaacaagaagatgggatgccaggagcaaaagaatcttcctggtacctttttcctcctttttatcagagaagatgatttttcctcaaagcctacagaagacttgcctttatgtctcattgaccagacttgggtcacattaccactccgttatccctgccctcaaactggcaaagagaatcaagaagaccttgattggcgtagatcactcatgcttgatttcctgaggctcgtctcattgcctctctcagaaacttggggctctatttttattagctaagaagggcaatggttattgtctgccacagtgatgctcttgtgtgaagtaaaggtgcataaaatgcatgtcttccctggactttagtgcatccttggtttgtaagtgactacgattacatgaatcagaaataaatcaggaaaaggaaagttggtaattttggcctattcctgcagaaatcatagcagggaggggagtgtttgtgaacgaagggagggtccagttctctaaagctgtgctggtgaactaccactgcatagggtggccctctgctgaccctagagcaagctggaggtgagacgagtttgtcaggacatcccagattctttcttctgtactctttcctcttctctgttttccaccaatccaatcaaaggcagtgctgatgtagtcagcacaactcctgggatgcaggtgcctggggctgcaattctgttctgacactgactgtggacattctggttctgggcagccacttgaggtaacaataatgatacacagttcctgcttttaagaggttcatgatgaggagcttcactgctcccctgttgctttatgacaggatgaggattcagactaaatgaccacttccctcttttctcactctcaagttttatgatttctttcaagtttatttgggattttttttttttggtctgtgccttttgttaatatattctacatgcattttgcttctaggcatattgatattcacaaagtttaccactgacagttgtagtctgagagtgtacagaaaaaaacgtagttgaccactctatgattattctggactctgtgactctcttaatgcaagccaagaccacattagcctttttggcagtcttattactttgtggcttttgttgggtttgcagtcatccagaatttctaagaacaatatttggaaggtggctttgcagagacttgagccactgaacttctcttgtcatgtgcttcctttacttcactcctttctttaatatatgcctggcattgggcccagaatccataatacgatattcataataaataccaacatcttttgagcactccctatgtgtcgggtgttacactaagtgctttacaggtattgtttcatttaatccccacagcaactttcttcccctttttctggagacagagtctccctctgtcgcccaggctggagtgcagtggcacaatcttggctcactacaatctccacctcttgggttcaagtaattctcatgcctcagccttctgagtagctgggattacaggtgtgtgccaccatgtccagctaatttttgtgtttttagtagagacagggtttcaccatgttggccaggctggtctcaaactcctggcctcaagtgatccgcctgccttggcctccaaagtgctgggattacaggcatgagccaccacacccggcccccacatcagctttctaatctaggtgttaataattcccattttacagatgagaaaacaatatggagcaagctaagtcatttgagcaaagttatatagtagcaggtggttgaggcaggactagaatctaggcaatctagtagcacagcccaggctcttaaccttgaaatgcaccttaaggcattttataaatttgtcttactttccttaatttttcccctctcccctaccccccagtacatgcataattgctttaaatattattacttgtcctgtctttcaagctggcttaatagaacatacgacgtagagatcaaaagttacagagtactaaagccgtagaataagagtttctttattcattaattcatcctttaattcctgattgactcagttcctgaggtattacactgagcgtgtggatagagagaggaaaaagacctagcattctgcctttgaggagttcacaaagtcatatggtaaatggtgggcctgagattcttgtcccgcagcaaattctgtcattctttgtagatcatggggaaaactttgcattttgctctaagtgtgctgagttcagagtgtaacatctactttgctccgccatagcctttaaaacaggattcatctctgagcctcagcaccagtacatctctgggaatctacctggccttcttcattatgtcctgcttccctgacctacatttttttcctttttcagattgatttgttgttcaaaaggccggtgcccctggaatgaggacctacaagcttacttttatactagaaaataaaagactagaagaatcaagcctttgctcagatcatactttgtgaggtgggcaagagtagaaagccgaacacttgaacgtgagagcgaggagggagccacagatgaaggttgaggacagagaaagggaagctggagggctctaaacttgcagaggcctgacctggcacttcatctgtcgcctctgaaaacagctctgctcttgctcttgctctattctcatccaagtactaggcgatcctccttttatcacttcccagtttcttcctttagtttcctctaaggtcattcctcctttgcactggatttactttggagtaacagttgttggtgggaggttctgattctgcagagagagaaactgaggcatgggatagagaacagccatctgtactttgtcctgtaagtcattagagactggcagagccttgtcatagatcccgtggtttgctgtaagccacaggtggccctcataccctcataggaatagggaccttcttccttccttaacatgattggattttgtttttacctgaaaatacgagctacttctaacagaaggaaagacgattgcagcctgtactgcattgcccctatctgtaaccccattaagaggttgtaaatagtactataatgatatctcagtcatttgttttgatgtatccaggcttttaataaatcagccgcagcttgcttaataggaatatgagagcagagcacgttgctgccagcagctgctagtaaattataaagcattcatctgttttacaagggaattaaatgtttgttctctttaaagggttttgactaaacaagggtgtgtgcgtgtgtgtttgtgtgtgtgtgcacacacacagtggcttcctgcccatgccctcccaggtacagtagcaacctcaggttcctggggaacacctgtaaccaaagccatatgaattagagtgcccccaggtaaaccctgtcattattggtctctgctctgcgtgcatctctaaagcaatatttgttggattacatttgtcttccacgtcaaaggattctgtgaaatacaagtcccatttcccgctttctcctttttttcttaagactgtctagggaaggagctttagataaactatacatccagcacaacattcaattgtctgcacaattgagttagcctactttatttgacttttatgtttacatttgaagtggactccccccgccccccgccaccaccttttcgacacccttggttttattgactaaataatcttcagaagacaagacatcagagttggtgcttttggtggaaattaaaccacagcaggtgtttcaagaccagctttggcaacactgcaagaccctgattctacaaaaataaaaaaaattagccagttgtggtggcgtgcgcctgtagtcccagctactggggaagctgaggcaagagcatcccctgagttcaggagtttgaggctgcagtgagctatgatcatatgactgcaccccagcctgggtgaaagagcaagattgtccaaaacaaaacaacaagacgtggggtccagctaaccaatattcaagagctgttggctacttatcttgtgaccttcaacaagttatataggtttttaaaatctattactttattttttgttacttttaaatttggaaataattgcagatttataggaggttgccaaaataatatagagagatccagggtgaccttcacctagtacaatatatgtgtatagctctatgtcgttctttgacatgtgtacattatgtaaccatcactgcagtaaaagcacagaactgtttcatcatcacgaagatctccctattgcttcctttttataacaacttctaccaccttccctatcctcccctccactgtcttacctcctggcaagtactaatctgccttccatctttataaattttattcatttaaaaattatataaatgttattacacatttgtatttatataaaatataaaatatatcacataaatatgaaaatatgaaatatatacattaaatcatacagtacatggctttttgaggttgactttttaaactcactgtaatgctatccatcaaccttgttgcttgcttttatgaatgtttattctttattactacctagtagtattccatggtgtggacacatcagagtttgtttaatcattcgcttattgaggaacattttgattctttttacttttgggctattataaataaagctgctaggaacaattatttacaggtgttttgtgtggaagtaaattttcatttctgtgggataaacactcaggattgtaattgctgagttttatagtgtttggtttttaagaaatgtcagacttggctgggcgcggtggctcacacctgtaatcccagcactttgggaggccgaggcgggtggatcacctgaggtcaggagattgagaccagcctggccaacatggtgaaaccccatctctactaaaaatacaaaaataaattagccgggcgtagtggcatgcgcctgtagtcccagctactcgggaggctgaggaaggagaatagcttgaacccaggaggcagaggttgcagtgagctgagattgcaccagtgtactccagtgcaacagggtgacactctgtctcaaaaaaacaaaaacaaaaacaaaaacaaaaaaacccggaggttgcagtgagcccggatcatgctactgcactccagcctgggcaacagagcgaaactctgtctcaaaaaaaaaaaaaaaaaaaaaaaaaaaaaaaaaaaaagtcagacttttccagagtgactgtaccattgtacattcccagcagcagtgtatgagggaatcagcatccttgccaggatttggaattgttgctgttttttaatatggctgttctgataggtgtgtaatgatatctcattgtgattaatttggatttccctaatggttagtgatggcagacatttttatgtgcttatttgccatttgtatgtcctctttgatgaaatgtctgttcatgtcttttgcccattcttttggattatttgacttttactgttaagttttgaaatgttctttatgtattctagatatcagtatcttgtctgatgtatggtttgcaaatattttctcagtctggagcttggcttttcattattataacaggatgctttgcagagcaaaggtttttaattttggtgaggtcaaatttatcagcattttattttatggagtatgcttttgatgtcatgtctaagaaactcttcaccaaacccataggtcctgaagattggctcctatgtcttcatcagaagcttaagctttacattttacatttaaatgtatgacccattttaaattaagttttgtgtaagtatgaggtttaggttgaggcttatttattttttgcctatgaataatctaattgcttcaacactgtttaaaaggcatttcttctaacattgaattgcttttggatcgttgtcaaatatcagttggccatagttttgtgggactgtttctaggttctctattctgtccgttgatctgcgtgtctgtcccttcgccagtcccttactgtattgattacagtataactatttagtaagttttgaaatcatatagagtgattcctcttactgtattcttttttgttaatagtttcaggtattctagtttctttccatgtaaatttttagaacaatcttgaacgtatttacaaaaattttgcagggattttgataggaattatgatgaatacttttatttttatgttttgtagagacagtgtctcgccatgttgctcaggctggtcttaaacacctggacacaagcaatccccccaccttcgcctcccaaagtgccaggattacaggcgtaagccactgcgcctggcccatatgtgaaatctgcatatcaattttgggagatttgatatctttgctatactgaactttcccatccatgaacactatatgcctttccttttatttagatcatctttgatttctttccatcagcaatttgtagtttttagcatacaggtcctatacatcttttgttagatttgcatctaaatatttcatttttctgagacattatacataacattgtaattttgattttgcttttcctgtgttcattgttagtatattgaaatacaatttgtttttgcatgttggtcttcaactttgcagagttgacttctaggagtttttatttagattttttgggatttttgtaagcatatcatctatacgagcatgtcatctataaacagggacagttttattatttactttctgatataccttttccttttattgccttattatgctggttggagcttcagtactatgctgaatagtggtagtgagagtggacatgcttgtcttgttccaaatctgaagtgaacaagcattaggtctttccctactaaatttgatgttagttgtaggtttttgggtagttgttctttgaagctgaggaaattcctttctattcttggtttttataaatatgtattgaatgcttttttgcatcaactatgatggattatgttgattggtttttgaatattgaaccagctttgcatccctggaataaatcccatttggtcaggatgtataattctttttatatattgctaaattttgtttactaatattttgttaaggacttttgtgtttataagaggtagtatgtgattttttttttctttgctggtatttttagggtaatagtagcttcataaaaattggaaagtgtctgctttccctgttttcttttcttttttttcgagacagaatctcactctggagtgagattcagattcagattcctaggctggagtgcagcggctcaatctctgctcactgcaacctccgcctcctgggctcaagcgattctcctgcctcagcctcctgagtagctgggattacaggtgcctgccaccatgcccggctaatttttgtatttttagtagagacagggtttcaccatgttggccaggctggtcttgaactcctgacctcagatgatccatccatctcagcctcccaaagtgctgggattataggtgtgagccaccgtgcccggcccctgcttttctaatgttatcatttattgctaaaagtttaccgttagtactgcttgtgtcccctaaacttggtatgttgtaatttcattttcattcagttcaggtcattgtttaagttattttgaggcttcctgtttgacccatagattatttgccagtgtgttttttagttcccaagtttttttagattttcctgttatctttctgttatttatgtctgcttttctttcattgtggtcagagaatacactgtatatgatttcagttcttttaaatttgctaaggtttgtattatatcccaggatatggtctatgttatttgttctgaggtcatttaaaaaaaaatgtggcttatgctttgttaagtgtagtgtgctataaatgtcagttagatcctagcctgttgatggcattgttgaaatcttttacatttgctgattttctgtctagttgctctatcaattaattgttgataaaggggcattttagtctccaactaccttttgtctatttctcttttcagttctgtcagtgtttgcttcacactttacaactccatttttttgccacaaatacatttgggattactatatttgcttgattgattgacttacatatcatttttaatgtccctctctgtttctactaattttctatgttctgaagtctacttattttattcatgtaggtactcctgttttcttttgactgttttcattgtatatatttttcatatttttactttttacatatatttatcattatacttgaagtgagtttatggatagcatatagttcatgcttttttattcattcaaccaatctgtattttaattggtatatttagtcactgtacctttaatgaaattattggtgtgttagaagacccaggcagctcatcactttgaagttccttgcatcctaaggtccctagcagttctgcctgttctctctaccttcaagaatcttttaatgttcatgttatatatataacacccaggaattgttttactgtacttagcagaaatgataggaaaagtacatctgttccatctttctggaactgcttctttacttttaaaattaaaaaaaattattgatacacctataccacaatattgctgtaagtgagatgaaagtgaaaaaggattcaacatttaaattctatttggacatcagttattatatctaagtgatatatgaaatcatgttgctctagaacaatattaacagattttatgaggttcccttataggaatgaaaatttatacgtgtactctttctttctctttgacaccactctacccttttctccttctctaacatattccattaagaaattttactcaaacttatgctttgcagttggaataccctaataccgattataagtcctgaatcatttattaagtaccttgtaattgcccagcactgtgctaccaatgcctttcagtgactttctaaattcaccctgttaggtataattatcttactgtgtagctgaggaaacagaggcttagagaagtcaagtgatttgctaaggtcacttagctagggagtgttaaaactgggacttgaatacaggtcttagagtttaaagttcatgctcttaacctttatgttttacttcctccctgtattctcttgtacttcatcaacctgaattctttagagctttttgatctgttgggacctagtttgaattcttaagcattttattatttttatttgcttcaatgaaaggtaaaagatataacctagattttatccattgctagtttcttttagtgccatagtggttttatctgtcagcgtgtctgtgtgtttcttaatgttcctagcaaaatttaagatgtgatctagtaactgtattcttccaattgattcatctttagtgtcactttaattttatttttgaaaaattaacgttatcttctcatttctctgttggagtgtgattgagtgattaattcagcaattatttatagagcctactgtgtgataattattgtgcgagatgctggggatattcagtaattatgtgtttctttgttcttgtaattgttctgtgactttagttacatctttcttcagaatctttcaattcacaagtcatctgtaagatttcactcattttctatttctagagtgtagtccagaaaccatatgtgtttgtgggagtttggtttaattttggggaagatattgatacttctaaagttaggtacaccatggtctactgtttacttttcaatgcaaatagagactttattgatgaatgctttccttctcaagtacatgttttgagattggtgaaaatctacagaaaacaaataattttaccccttacgctgaatgctgggaaaagaaagggtcttgtctataaattaagagcattacctatgagcttcacaatgtacgtgatggacctagtctgtgtaaaatgaagattctagaagcagaagaaaatggcttcaaaagcaaatcagaggttatagttcatggacaagctaagtactaaaccaatcttattgttgtgaaattaacattttctgttttatctctgtggtatcacggaattttattattggacaggctaatagagatctgtttgagcagcctattcattttatagacaagaaacctgacacctgtagaggtaaaatgacttttaaggccttttgtgatttagcctccaaacttgaagacctgggcccttgttactgtatcctctggactgcattttagtaatattttatcatttcattatagtctcatacttacccaatattcttcctttacagggtttcagttttctcaactcaagagagtagataaggcacttaatgtagttcatttctagttggagtctgtaaaggtttatgaattgctttgttaatccacgtcactttgtatcttagctttctagactttaaatgttggttgtagtccgtataactgccagacttaacttataatgaatgccttcaggtaggtagatatttgtttgtgtgtgttccgtaaagaacaaacaaggggctaagaattatcaactcttgctgtgagggccccttagccaggcttccaccctctgcctcttcagtcttagggacttgtcaaccaacttctgcttcagggcctcagggatggtgggtggtggggaccttaggttggctaattttaccatggcatgacttccatttttaagagttattttcttggattgagacacagttagcttgcctgtggcttccccgcagtgattcttctgagtggatggaataaatcaagtttctctgtgtttcctgactaaatattgcaggttgtttgtgccattcctcactttttggattttagataattcactattctacatgcttcattttttttatgtttcctcaggtgagccccaacttttaactgagtactttagaaataggctgagtcccaaggggtcagtggaactttcttgttccacctagcataggcctgaaacagaggctcagtcttgggactccttccttcagcctggaaggaagaagtgagggagaaaggaagaaagtgatcaccaaggcaggcctggtgcctagaagctgagctttgagaagcatactttagtaacgcattttctgtgtcctctcctcagttaactcgtctcttgaatctttattattaaaaattaacacctgaactggtaatctcagttcctgcggtccctctctgtatttcaactttacatcagccactttttttagtattataaacaggagatcttttagacccctaggcttccagttttgattggccgtcaccttctagctccctcatctcattacagactaagctggatgcattaactagttgcatagtcttggacaagtcacttaagtattctcagccttagtttcctcagttgtgcagtgggtctcctcacacctactcacttaagaaataaatgaaataatgtgtgtgagagagttttctgaacaagaaaatattagctaaatatcatctttccttgttgtacccttgtttctacaggacacagttggatcagcggattcagtgcttttcctgggatctcttacaggttccctccatgcttgttgcccttgactgatggtatattggaacatttgtacacagtggccttgaactatagtgggcacttgaaatggcaacattttgtattcttctaggaactactgtttttctttgaaaagccaggaatttcacggctccagaggaggggatgcagaagctatttctttttattttcccctgttaaatcagtataatgagattctatgtgcatagtaatccttaagctctttgcctagttccttttgccctaggcaccttggagtgatggaattgtagtcagtcagacatgtgcagtgtattcacacatacacttagagggctcctcgtctgctccccctagctaagcagcccctttgaaatgtctaataaaatccctgctcttgtgcgctgcattgaaacaaagcaggctcacgcagtcctggaaatgagccctgagaggtattatttctatatgtcggtctttatttgcctgttttgacagtgtcgtacaatgagggtcctgctgctgatgcagcagaatcacaaggagccgtctttgctgtgtaaattctccctcaaaggtctggcattcgacctgcctgctaaaccctctttgaaacaatgcaatgacaaaatattttcttcttactgataataggcagattataattgctataattgcttctacctcattctctgaagggaggaaagtagggctatggaatgagtgcttaaaatttttatttatcgtcttagagatatagatggttcatttattatacagaagtttacatagcagcctctaagtgtacgttgtttctcaatagttggaattaaattcgtacttttggactactgtttattaagacattcccgggaggctgaggcaggagaatggtgtgaacctgggaggcggaggttgcagtgagctgggtttgtgccactgcactccagactgggtgacagagtgagactccgtctcaaaaaaaaaaaaaagacattcctccttggtgatgaataacacctgtgtgccaaaaggatttttctcattggctctgattaaggggatatccagccaataaccgtagcaagccttagggtgaatttttggcaatctccaggtctagtcattgccttatgggcagtctgatggcaccttgggcattgtcttattgccctgagcacaggtgttaggggcatggagtctgatgagccgtgctctgctgtctacccccagtctgttctccagaccccctaaccaaacttctcatagaggtgaccatcacaaggacctggtgtgtggctagatcagtgacaatttatgaccacttctggggaaatagctcagagtgcacgtccttcgtgtggtaggtccaaaatattatctttgtatgttcaaagtagcataagctttagttgctgctgttggtttcaggagaatcacctggatgtcagtgccttggggttattaataatggtaaaaaaccagtatgagggtggagcttagaagtagaccaagacttgtgagtcatgcactgctttttaatttgcaagctaaataggtgctaaaactcacctaccctggctgctgagatagtcactttctcctggtcctcctctattgtaaagagaagaggttggacttaatgcccttcaaggtcttttctctctgactttctgtgaaactccaaggtgagtcctaaattttgttttggtctataaatttaaatgcttcccctgctgagctgctttgggctgagaatagaatggatggaatttacaccttctctctctctctgtcccatgtgatgctttgattggctgctaacagaagggaaggtggtcagaaggcaaggaagccttggcaaagaggaagaggagtgaaagtactaaagaataggaacaactgggggtcagccctggaataaaaaagacttcacagggcagttactaggcttgcctcactctttggaatcatgagaggtttgctaggtatgtactgtaaggcccgtgtggccagagactgagtcttggatttactctttttgccctgacattgccttgtgtagcactggatatcatgtaggtactaattatttcttctttacttaacttcctggaaaccgctgcaattgtcaagtgaatagaagtgaataggactgttatattaaacattatagagaagggtccatgctcacagcatcttcatcattccaaatattgtgcttgttgaagcagagaaccttgtcaggacagtcattgtaccaacatttacgaaatgaaagcaagagctattaaccactgtataagatttgaggatattgtgctttcaaaggaagcaaagagggtttaaaattactccagtgggatatctctttagcctcacttaaggattgtttaaaaggaaatagaaataaagattgtttcaaaagaaaaagaaataaagttagaggtgaatagatggtatatgtaagagctttatgttttggtcatactaagtttattgttaagttacaacaaaaaaattgttaactatcatgtctccagttttgcaggataattttcttttaatgtattccaaaaactgacctcagaatttgatgaagtgttagacaagatgacaaacagagagactgttagtaacgggcagaagtcattagtctcagactcatattcatttgtttgtggttattgattctagtcactcctattcttatctccatccaaaaataggcattaaaccctaatctcttgtggatgtttgctttgtagatttaggagaataagaacatgtgaccatacctggttagccatctcaagatttgttatgagctagttgacttcaagagccagtgagctgggttgtgcaggatacttgttactggataattctacttcagatagatgctctagttgctctgctaaaatcctctgttctgtcaagcctgtcagagccagagtgaaaaaacaaaacaaacaaaaacaacaacaacaaaaccctagtagagtacctgaactctaaattacagagtttaaggactgaaaatgaccttgaggatccagagtaggactctcaaactcacatgttcctggggtagacaggtagcagagtgaatgaattggacaactataagcaatgggggagactgaagagacattcaaatttagaaaattttaaggacattatacctgcctgacaaagaggtgtttttttttgttgttgttgttttttgttttattttctgtctctgatgcttgaatcaggaggacaaagagctctgatgctgattcagctgcaattttgaggacccttgaccctaactatcaggttatctatttctggtttaaggatgatgacctgagttacaggtaggaaaaggcatttaaccaaggagagacagctagtgagggctggagcctggggctctgaggtgtagtctgaggttctttctctacaccatggtgatatctgaaggggaaggcaggaacacctggatttcaatcagggatttaaaaaaaactttctatttttttagagaggtataattaacatacaatcaaatgtactcatcttaagggataacttgatatattcttatgtgtgtgtcctttcatgtcaccaccacccagatcatcccaagattctccttgtgctcttttccaacatcccccacacccctgcaccggaatcacaatttaccagggaaccatggcacttttccttccacttgcagagctggtccgtctgtcactggcccagttcctcccctcacctccctctcctcagattcaattgtaaagagctatagcaaacacaagggcacatgttgcttaatttttttttcccacataacccaacagaatcttgggtttctttaaagtaagctctctaattatgccaatgccattgactcaccaagtaggatgccaggtcccacagggtgtgtccttcacagggttctgagggtactgcttcttgcaatgtcaactgctttatacaaaagcatatttaaggtcacatgatatttgccaagttattaattattcggaggctacttttcctctgaaagaacttcagatgtccgatgtcatgattttattaaatcaaagacccatatttcattgtaatggacatggcactcaaaacctgggaatcgactcattgaaaatgtagccaacacaacactgaaaacaaagcccacctcacaggcaatgcagcttccttaaaaaaaatagctgattcccaggctgaagctgttaagcagatttttatgcagggcttcaagttactaaaaaagcaggattcaatatgcctttctctttgatttgtaggagggggtgggaagtaatgctgctgctctccccttacccccttcagaagggcttttaccatattctgaaagcaatgcttgaaggacccataaatggattttggctgtctcctagtgcagggattaacatagaattatagaagtgtgctgcatggtggttgggaaaatagggaggatgccattctctttttggagggacatggtgctcccgtctcttgcctgtggatgttccctataaagcagcctgtcactgtgaaaaatgcacacactgtaccatctcacagttataaaggttaagtaagcatcttgagcagtgccccactgcttttgtactttccataatgtcagccgataaaggattattgaaaaaggcttgcaaggagataaaaggcttgcaggttgaggttaaacaattgaaattttctgttcccagtgtagtaaattaccaatggcagatttaacgtttgttaattattagagcaaagtactaaggattgttttcttttgcctaattaattacctcatctggagtggaatgttaattcagataaatgattatttcttaatacctctgaagctttccttggaatctcctagaattgccagtcctgaagtgtggtttcctcacattctggggaagataggggataggtgaccaacgtgactactctcttggcctttttcccgtctcagaagatggcaggataacttgtttagacttttggtgatggagttggtttgctgttctagttagtagaacatgagtgtgcttcctggaatcctgtgcctcataaccaagtttttgagttagtctctcgtgtggttttgaatttaacattgaacattctttttacctttggtaattctcaatttggggcacctgccgtgaacattaaagatggtatcctttggaaaggacactctagtttcttaacttgctttttacctttaagttattttacctcctgatgtctgttcagaatgctagaggcaggtttttattctttcttggatctaaactatatcacctctaatagttgtgaatagataatattcaaaaaaggtaaaatcatgactcatgcagatataaaatatccacatgtcaaaaattttacttattttaaatgagggaaccagatagatgttacaacaggtaccaaggagaaatgaaagaaccacaaatttatatggaataaaggaaatgaaaacgaacccacaaatgaacacaaaacttttgggggagggttgttcctctaggggacagaatgtatttgcatagctatagacacttttcagagttgtaaaatcgcccagtcagacacaaaggtaagtgtccctgtaggatgagaccattttctgaaaggagggccattaatctcttttgcttttttttagggtcagaaacttccccttagacagttgtgtatgaggttttaatccagttacttaggatgacattgtatcttcaaagtagattagagatgaattatgtgacttatttttctttttagaaggaagcttaaaggtgacttggggagatgggctggtagatctgggccattggaggcgagctacaacccatgtgaccagttaccctgcacagtctctactcctgataaggcacttattttatgagcacttttcataatgatatgaaaaggcagcgggattctgtctaagattatctggagtgaaagctggaggctgatattaaatggatagtcctgttttcttttggtgctgccaagctgagctgtttaaaatgatgcttggaaaaatgcctcctgagccaggaagttgtctgattagtgaagagatttccgagacgtttggctcagagactaccccatcataccacacatgttcttttccacattcacctgagtcttccaaagatacgaggactcggggtggtgatagggtgtacattcttacatacacatatgtgtatatttgtatatacagtctgtctatccatgggttctgtattagttgattcagctaaccatgcatggaaagtatttgaagaagaaaaaaaggatgtttgattctgtactgaacatgtacagacttttgtccttctcattattccctaaacaatatagtataacaaccatttacataccatttaaattatattaggtattatgtaagtaatgtacagatgatttaaaacatatgggaggatgtgagtaggttatatgcaaattttacaaagggacttgagcattcgtggattttaggatcttgggggatgctggaaccaatcccccacagatacagcgggacaactgtattcatataaatatataggccagagattggctttaggggagtctgcaaagttccataattatatgcatttttcttaggcagtattgtgtctgtcagattctcatagtctccaaaagttttatgattcttcaaaagtttaagaactgcttacagaaaccatgcccccagtaattattctgaatctatgtgttaccacgtgtatgacttagaagaagtctagatgaaggttccacctaattacagaatccactgctgtagccacagctggattgagttatgtggcagccctgccccagagctggggaggctgcgtgtgtgcccctccacacctgagtacatcctgggtgtgctgaaatgaagcccagggagatacaaagcaccataatgccattaaggccagcacccgttgggtaggggagaggctgaccatacagacttctgacttctgcgtttcattccctgctctgaaacctgtccgtctctcaggcttgcaatctgccttcctgtctctctgacagacctgtgacttgggctatggttctgataccaggaaataatgcaggggtgggagtcttagtcccaagcaaaataaatcactgctcccattagacattacaatgtttaaacccaagtacatctgtctgccttcaaaaccaagatttagagcatgtcaagcaggtgccatgcctccaataacacatactttgttccaacatttagtagattactgtgagattttaaattcaaattctcagacattcactttgtttaggaaataactgcaataaagcaaattgtctcctgttctttttttccccctacggtgcagccaagtgagagcaaatcaattcctagtcaattttttgttgctgttttcctccatgctagagaagagatgatgcagctctctcctgttgcagccctgtgctgggtgtggttccctctccttaatttgtcatctgaaagcaattttgttcaattagagattagaattaaatttcagttgtagggcttctgtgcagaggaaatgatgcattaatgaacacacagatgtcatcttgcagccatgatgcttgcagaacagtttcttcaggattcaaataataaaaggggccacagcagcaggagcattgtttactggttggcatactaagtggaggctcacatttatttgcaaaccatttatcattctgtatactgagagggagaacatactttatttaaaatatttgaaataatgactcttaaaatcggataacagaagcattaatgccaggtgccatgcagtaaattgcataatgctgttgggttggcactgacactgtgatttgtgttgctaatgatctatccaaatagatgggagttgagaataaaaagagaatattcctggaaagagacaaggcaactagtgaattaaaagtgtagtgagaaagggaaaaaatgtgtaggatcgtattttacttattggaagacccatctgctcttctgtacacacattatgtaagtttcactctctgtattacaaataacctgcagggtggataggaagttcatatatctgccttcagctgtttttttcactcacagacgtgaatgaacagaaagatttatgtcttgtgtgttggatattataggatggtaggttttttttttttttttaagggcgttgtgtatttagactgtgatattctgtgcactgctttgcttgaagtgagtgatggctgcgactaagaaggcagcaagtggggagtgggagtttggggaggtggaaaagggtttctgtgagacaatattggtttgtctggtctttgggcctgggctacacacatgccctttgacacttatggttaaagtgtttatttccgaatggtgcccagagctatgttcagtgtgtcctgagtcactgttgaatttttaaaatttggtagtctctgtgctgtccagaatttcttagatgtgttttgaatacagagggctctcagtatcaggtggcatccacgctggtcattgatgttgacagggatgaaatctcacttaaaaccctctaatttcctagttcaaggactcttccttattcctcttcccctgttgcaaaaggaccctctgatgttggttaagggttaatagttctgtccttgaaatgttttctttctgcgacatcacatttttcttttgctttatccatatcttgtgccaaggccattctctttcattctcatttcctttttaacccctgtgtgtactgcatcaagtcctattttgctgtctcttcgaatttagagacatcatcagtgcatatcatccattatacaaaaaagccagtaatagcccaatttttatttcctgtccaaatttttctcctcaacttcatatccatatctctcttccagaaattttattagaagcacaatgtatctaggataaaatgtaccctctccctaactcttccttaccttttataatggtgcttacgttttccatgtcttcctacttaaaattgtattcatgtttgtagtcttctccctgacttcactgctcatgagttctacctttttcttgtctgttataagtcctttccttttcatttcttttgctacctgccttgtccagatcttccttacacatcacctgcaagtagctgatcatcctcttaactgatctggtagttaatggtgtcttttgctcccaagcctgcctagtcctctgctcatctacttatttctgcctactactccaaagccttcattggctccccattgcccaaaaatgaattccaaacctcccagtcctggtgattaagtagttccctcccatacccaaacaacccagccctgtcttttactaacttttccttataggtgtgtgttttgttctccctgttctcccctgtatgcctttcaaaaccctgtccttgctaaagcccagcttggatgccttttcttggaaaccttccatgattgcccccctggagtgtactttgttgctctaggtataaatgactactgcacttatgttaaggcacctgtcacatactgtaggtatttaaggacctcctctctctgctggatgatcatcattttgatagcatattccttttgttttcaacagagctttttctattaattttaaatgcaatatactgttgcaagtagtagttggaaaaaatcacagagcaagcaaagttctggaatacaatttttaggtcttcctcaacattcctgtcacagtagatgatgtacacttacagcagaagacgatggttagaaaggtaagagcctagggtctgagtcagcttcaactagaatgtgagaactgagatagaaggaattatttccaccttcccggggattttctagcatagcctatgggttgtggtttgcccagcaacaccttaatctagttgcttatgtttagtaagcatttacagcctgggttagccggctggggttcaagactcttggcctttaggccagtgcttgatgcttctgtcagcctggaaaaaggacccatgtatcactcagtggttctttagccaacttgagcaagtaaagaagtctaggaggcagaggtcttctgccagcttcagcctttaggattgttagggtgatgtggggcctgctctggtgtgtctcgtaaagaggatgaaggagcagtgagaattgtgtagactagcagtatcctttcatctgctttgttgtgagccagcttaggtggtcttttctctgctattaaaggggaattctgactccttgagttgatgagatggagtttgggaggcagataggccttgaggacttggtgggagtttgtaatctgggcggcctggctgaattcatcacaagggtggatttttaaattgccttttttgctcacctactcaaattgagtcactgagcagtatacttgtagatgctttaacaagtagattatattgaatcacatttaataggaagatgactaacacaagggagttgttttatgttttaaaaactgctcacgttcctgaactgcagaagcacctgttctgttactttttaaaatatggtcgtgaatatttttccctttttggtttccccagggcagtgatgttctggttctgaggtctagtacagcatttcctttttggccttttgtccttgcttaaattctcttccaattcttcccttccaatccactgacccaggattagagtactaaaacctcacttgtttttccttatttttgttcatctaacttaagagtgcgtggcaaaaatcttcctttgtttttaactaagctcgttaccttcaccctggtttcataatgtgtcaccctccctctctccccctattttttcctcctaaattaaaccaacaggagtcatttgaaataggcgcagtgccagaattagcaaataaaaatacaggacacatagataaatttgaatctagataaacaaataattattttttagtataagtatgtctcatgcaatatttgagaatacttactctaaaaaatcatataggaaattcagatttagctgggcatcctgtattttatctagtaaccctacataggcatatatttgaaataaaaataaaattttacattaaagaaaacattataaagaagaaaaatttaagtttattgtgtgttaaatattcccaatgctttccttactgaaaaatgtaagactgtggacaaattatgaaacagtttgtgcataagatttataagttagctacctaatgaaaagcttctgttggctattggaatcagccatttatcctaggattcagctttatctctttgctaagaagatgctcctgattttgaggtgagaatatttagtgcaagcggtagaccattgttacatatgatatatcacaagcacctgtgtcaaaaacaaatgttgaagtattcaacaattttttcctcatttaaattgtgcccagctctcttagctcaatttcttctggcataaagattcttaacacaaacaattggatgatgaagacagtaaattcttgattgagcgaagtttttatccaagactagcttccctctgtcacccaggttatatgtggagtacaaactaattatgaagctaaatcttcctcagaccacataagtaagtctactccaaagcttaataaaatgattctgcaatatttgttccatgctttgctttttaccaagcctgtgcatacgttctgatttgattctcctgacagtctatgagagaacagtgatgatttgtctcctcattttataagagataaatttgaaattttgataggtgaaatggcttgcttaagatcaagcaagacttaaatcttgatcttaggccttttgggccattgctctttccactacctgtattgacttttgaatgtaagtgatttgggaattaggcagtttaggagtaattgtaccagtgttcccctctgctagcttggaagatgaagagctgttttcatacctgtgcattgtgctggaagaggtatttgcctttggttcagtgcatacctataatacacattgggtcttcttttgaggaacagctgcctcccctgtacaaacagcctttctgaatgaaggggatcagccaccgttgacctgtgagtttgaagtattgcactgttaatgtttgggcaggatttttttgaacatgtggttgtaccacagagttacgcaagcgaaatattcttggaaatgacattctgcacaaccgtagggagaaatattgggaagctggcaagagagtcaattctatcagtgtttattgagcacctataatgtgcattttgtgaatactggatgatgtggatgagaaaagatgtaagtcctactcaggagcccttcctgccacagtaccttcattagcatctcctgcctatcagtgcttgaaattcctggctcatttttgatatattttatttctgatttgaggcatcgtgtcctttattttgataaaatattatctaaatattttatatcacataaattattaaaataaaatattattttttgtttgttatgtatagtcccctaacaaagtttgaactttttgaggtcaaggatcatatatatatatatatacacacacacactcatgtacagaagaagttcttgaaaaatattggataagcaaataaatttgtggtattcttggggaatcttggattaataaatggatagcatccctcggttgttgtatacctatattcaaaggatccatgactcaatgatggggtaaggaggctaaaagaggcaaagtcaatgactgaattgaacatggcatatcatctcaaattatactgggaaacaacattattgtctacttgttaaccaaatatatgcagttgatatcattcaggccttgcacaagttccttagtgtataatcttggtccttagaatgaagtgagcagcaggtacatattcagagactcatagtttgatggcatgggaactgtatctttggagatataatagaaaaaactgtgccttatctgattaaaaatgatttcctaaaaagtacttggataattcctaattgtcccagttttcataaatgatttggaaaatgctgtttgagactgtgattgttaatatactgtggaagcctattaacttctttttagaattcaaaagcctttaatatatggggcaagagaacatggattgacaaatggataagagtaactaactttattgtaaatcactgttgatatttggtccctgcctttgttcttttgttttactttctttcctcataggactcattaccttttaacatattagtaagaccgggggaatttgttcacttttttccttgatgtataacaaatcatattgcttaagttaaagctaaagtagatatttaggttaaaaattatgtagatatttaagttaaaaatgtgaattgacttaaggaataatattaagagaacaatgtagcaaaaattgtcatatatatacatatctgtgcgtatgtgtgtgtaatatatatatatatatatgtattcacgttatatacagacatacacacagacatatgtaagtaccagggatgaaacaaaaaaaaaaaataaaacaacatgtgttaagtactgtgttagtactaaagatgacagaaaaaagtacaaccctagatccttggccagagatgcttacttgtcttacacttcttacagtcccctctttactacacgacaggttaacttaatcaggacagactgtataagttacagggcccagtgcagaatgaaagcatggagcctgttgtatagaaagtaggacaaaggtgccattaaaggtggtaaaatataaaatatttttcttctaggggatctctctcaactttttatggtgttttaaattagctgtttaatgttgctttaagtgaggaaaaattcaaattttaaattgctagcatgaattttaccattcatggttctgttgtgcaatgccagttttaaatgcagatatgagagcattcaacttgtatgtagaatcactgaatttatacagtttatgttatgcctcataggcacataatgtattttgtttttaccgcacagtggaaacactgcatgaaatgaactcagaggtttttatttcacttgttgatatgcacacatttaaccaacactctctaccttcagattacaatgagtaaggaaggactgaaagggactgtctttccctttcctcctgtgtcattttcagtgtgattggctaatacagggaagtaatatgtgtaagaaaaggtatgttaggatttcttgccattcatgtttgttttagaacactatttccagctttctgcctttaaattgaagttttgatttgaagggaaagtataggctcccaaggttgtctgtctttcctctggcttcgtcgtaaccataacacacttatagggtagtcccccctttatccatggggaatacattccaagacccctagtggatgccggaaaccacagatagtactggcccctgtatatactatgctttttcctatacgtacgtggctgtgataagtttaattagggacagtaagagagctaacaacaataacagagatttaacaacaataactaaaacaacagttattaaccacagtactaaaagctatgtgaatgtggtctctctctcaaaatatcttactgtactctactcaccctttttgtgatctgttgatctgataactgatctgagacggctactaagtgactaatggatgagtagcatctatagcgtggacatgctggacaaagggatgattcatgtttgggtgagacagagcaggacagcacagggcctcatgctattcataatgcctcaaaatttaaaactatgagttgcttatttctggaatttttcatttaatattttcagattgtagttgactatgggtgactgaaattgtgaaactggagataagggggactgctgtactctgatttttactgaactgtcacatattgcaggctcactggagttctatgttactgggacatacaaacactatgtgaatggggcagccaggaattcgctcgcgcctgttgcgtgtattttttctactcatggacatgttccactgtgttatccgacttaacttacaaaacaaagttcaaagataagattatagagcattaaaccaagtgccgagcccttctgagtgcagggccctgagcgattgcacaggtcacacacccatgaagctggctctgaccttaatagataaggaagcacagcagagacataagctgggcctgatgccctgtgttttcacactgaggaaagcatgaattatctcttacgttccttgtttgaaactcaggcttcaaaagtaggaaaggttagaacatcaatccattgtgcctttccaccttttatctgtaacttgctgaaatgttttcttcctcctcctccttttcttgtcatgttggatatgtccttaatatatcagtgtcaagtgttgtgtctgaatgtgaacctgaattctattctaagtgctgaaattaaaacagtgtttctctgtttagtttctaatgtattcggggtactagagtatctaaaacagcattttaagaggctttaacattttttgcctttttttctcccgaattatacaagtcatttttctttttctgatttgttgtctcctgagaaagtaggcctccctttttttttcttgcatgtggcagattagtatcctgtggtccattgcaaccactacagtggttggtaggaagtagaacttgtagaaggtgcagttaaaactactattaaagtagcagggaaccttctttgccctctcagatgaggaccaggaagttgactttcacatttgaggtggcacttgatgtagcctatattcttttttttttttttttttttttttttgagacagagtctcactttgtcaccctggctggagtgcagtggtgtgatcttagctcactgcaaccttagcctgccaggttcaagcgattctcctgcctcagcctcccgagtagctgggattacaggcacgcaccatcacacccagataatttttgtatttttagtagagacagggttttaccatgttggccaggctggtctcgaactcctgacctcagctgatccgcccgcctcagcctcccagagatatagtctatattctaaagagactctcttctaatcaagtggttatcatctgctaatactttgaggaaaaaagattaatgttccaggatttataagttcagagaactagcttaacagagtgcagtgcttcacagatctgtctggctgtggaatcagattgactttaggttgctgtggtagctctgcagcataggagctgggaaatttagtaaccttacttggtggttctcagcccttattggtatggttaaggaactttgaataaacacctgtagagatttgaatttagttgccgttgggtggggctcaggctttttttttttttttttgcatcccagagttagcagtcagggttgagaacactagcttatctcagaacatcaatattctcatttataagatgagagaattagactgtatgagatcgtcgtgagatctaggcagatgaacacagcacttggccagtcaatgtgagtgactgttatcgttaaccacccttactgattctttgctgagattggaagctagattggcattcatttcttaagctggaaacctgtgctgatttgttagaaatgctgcaaggaacagaaatgattatctatcctaagggaatgactcagatcttgttagaataccatgcccaacttctcacctcccagaagagtgtgtcacagaatagctggaattacacctactttatgtatgaagattatccctggaatagatacatctttgaggaagaagttgatttattcatttgtgtaatgtttattgatacttaatacctatcagcacttctagactgtggcctggaggaatccatagattggtaattggttggaaaagtgaatgtaaattataacacagaagaacaagtgttttgttaaggataatggaaactttaaagctaagtagaagatagccaagctgagaggcctgggtgggctagggaagaaggttattactggcagaggaagttgcagttttaaagagacttagaggctggacacagtgggctcatgcctgtaatctcagcaatttgggagaccagggcaggaggatcacatgagcccaggagtttaagagcagccttggcaacatagtgagaccgtgtgtcaaaaaaaaagaacaagagacgtgaagacacacttggcatgactgggaaacttaaagtagtttagcatgtctggagtatacttactccagaggtgggagtccagaagatggtgataagaaagaggttagaaccataagcagggtcccagtcatggaaggctttatttggagattgaaattgattattggatagccattgaacattgtaagcaaggaagtggcatgcttaaacttgcactttggagatgtcacaatcctacaacaggctgaaaggctggagacatggaggccacttgggatgttgttaatggaagtccagatgaggaggtctgaattaaggtagtagcagtgtagtcacagtgaggtggacaacagatggcggagattaagaaggtggaatttgtaggtgtcagccccaggcattgcatctattttttttttccaagttgtggagacggagtttatctctgtcacccaggctggagtgcagtgacgcgatctcggcttactgcaacctttgcctccctggttcaagagattctcatgcctcagcctcccaagtacctgggatcataggcatgcaccaccatgcccagctatttttgtttgtttgttttgtatttttagtacagacggggtttcaccatgtcggccaggctggtcgcgaactcttgacctcaggtgtgagccattacgtccagttgcattgcatctgtttgatgttgggtatctaggatgtacatctgtcaactcgtgatgcctccctgaaccttcgatgattatctattgactataatctacccccaaccctttttttttttccattttcatctttcactgaattcctctgtggatccattgatcacgctttgcatatttattccttctcccccaaccccattcttcctggatgagctttttgctctcttttaaaccattgcacttgactgtctaggcatttgccagtatatcaaataagtatgtatttgaaagtctaggtgagcctttcttaaatactggatgctcagtctaaggtatccattgtgtttatggaattactttctctcctgtgtatctaaatggtactagtttgatacttttctgaagataattgagaaaaagtaactttgatctttttttcttctgtggttcagaagagaaattatttgtttcttgctcctatctgagccagattgcaaatttagtgctaagatttctggcattaagaggattattattattattgttaaattgattgtctcattagattaccaacatgaggctcatgggacttaaaagatttatgcccatatcctggttccatttttgtgtagagcctgtgggatgaaaatggctcacaggtctgtttgtgacacaagtagcttgatagatggcctatggttcatgtgtagaaaatgttggcgactatagatttattttagtatcattttaggaagcacaaaagtggtgtcccaattgaaccttatggagagagcatcattactttccatcacaggttcagactttgggaccccagggctctggaaatggaactctttgaagaggtcagagcctctatgcaccctctcagtcaactcaactgcatgtagaggagggaaagaatgttgttattattcttaatattcttatagtagcgtctaatagtacattagtaaatagttattcacaaatggttgttcctattgcttagcaatttctgatttcagatttgtgttttggatatatgtgcatactgaccttctgccttttaataaatctagaattcatttgatagtacaaattaacaaaaccagttgtaataaaaatattgaattttaactttaaaaaatatgcagtgtggccaggtgtggtggctcatatctgtaatcccagcactttgggaggccgaggtgggcagttcacgcggtcaggagatcgagaccatcctaacgaacacggtgaaaccccgtctctactaaaaatacaaaaaaattagctgggtgtggtggcgtgcgcctgtacctcgggaggcagaggttgcagtgagctgagactgtgccgctgcactccagcctgggtgatggagcgagactctgtctcaaaaaaaaaaaaaaaaaaaaaaaaatatatatatatatatatatatatatatatatatgtatatataatatgtattatatatacataatgtattttatatttatatatattttgagatatatataaaatacattatatatatacataaaatattttgtgtatatatatatatatatatatatatatatatatatatatatatatatatatatatatatattttcagtgttcatataacaaatttcttttgagagctaccaaggaccagacttggtgctgtgggatatttgataggtgtgagacagtcttttcctcagagggtttgtatcctaggagtagggataatgataactgcataagccacctgattgatctggaattggatgcaacttttactacaggaattgacataaggatttagacccttttccagtacattgacctagtagtattaacaggactgtggcaactttgaacttccctaatgagaaaaacatgtgttggtgagcaggtattatcacatcttcccttgcttttctgtttaaatacagtatcctattcagataggcaaatctctgatgttttgttgagtgaagtctatgggccagatcacataatagatgatgtgtttgttggttgcccactgattagcttgggacttgttacctagaggtccatggcccttctgaagtcttcattatgttgttagtttcccaaaatgatccgctgacacttgttctaaatatggtttattttttgcagcttaatgatttacttatttgccaaatactgggatttggtttcagagagcatccttttctacctccttgggtatataggccttgatttataatgtctagttactctgtcaatgaatcagttagtgaccattttgagtgttaagagctttgagtaaagaagtgtgtgaaaagccttctgccaccaggaagcttgcttccctgtgcctagtctaaaccaaaagtcttcaaacttttttgattgtgaaccccagttggacaaatcacttagagtaagcacctcattttaaagttttatatttatactactgtactaatatatagatcagaaacataccgaattagaaagtaataaagaatgagatgcatatttatttatttacttaaacttttattttagattcaagggatacacatgcaggggtgttacctgagtatactgggtgatgctgaggcttggggtatgaatgaccccgtcacccaggtactaagcatagtacctggcagtttttcaactcttgcctcctccctcccacttctgatagtccccagtgtcttttgttgccgtctttatttctatgagtacctagtgtttagttcccacttacgggtgagaacatgcagtatttggttttcctgttactgtggtaattcgcttaggagaaaaacacatttaaatagacattataatgcagtcttacccctcagtggaacatcctacagaccactggtgtagacagaaagtgctagaggggtgcttgggagagagaaatcatccctgaggcacgtagtgaagaatgagttgtgtgcaggacatcaccagagtcatggcaggccgtggagaagatatagttggtaccatcttttggtgtaagcagcagggagccatggatcttcctaggaggagccacaaggtagaagtggccatgccatagatgcctgcatagcatagtgggctggggtagacggtggggggcatgtgtgtaaagagagaatgtgagggagacaggttggtatcctaatcctaatcccacagcagaatagaaaggcaaagaggatggtggtggcaggtagggtgaggaggtagtgaatatgtggacatttcctgcatgaccagaactgctaaggaggaagtgagtcttgaagtctgctggacaaacaatggtttgtagtaggagaaccctaaggtggagggagcggggaggggaaggactggccacatcccaaaaccttattatgtccaattttactgcagctgttttatgactgcaacatttttgttcaggaaatcgtttatttacccccacaccttttcttttagactaaatgacaagaaccagtgctcacatccagggtcaaagctaatctttgaggaggtggaaaacgcctccttgtttcattgtctctcttgaaagtggtgtctccctttcactctcctgcaggagagagatgtccaggtactgcctaagcagccccagtgaaaacggatggttcttgaggcttccagaggtcaatctggcataagaagtaaagaagaagccacatgactcggagaggcagaatttctttccttggacaggatagagcttttaattgaatccaaatcacatctctcatcctgtgaatgctggagagcagtacatttttaactaggaagagcatcaattatgtattagccacgatactaatttaccctgagtgtgtgtcttagagctggctttcatctctgcatagccactgatgtaatgccattgtgtttctatactcaaccagtcgctcttaagatagggtgtcctgctattgaaaagagtagaaagtagggattgctattgctgaggctctttctgtgttcttacagctgagggccctttgggataccaccttagggtgggagagctgttcactcaccgttgtgctttgagatgcagactggggcttgtccttttactctgatgctgctgctttatcagttatttggtattattgtgttccaggataaatctctggaaccctcagttatagatatttgagactttctgtgtgtgtgtgtgtgtgtgtgtgtgtgtgtgtgtgtttgagacagggtcttgctctgtcgcccaggctggagtgcggtggcacgatctcagctcactgcagcttccctccatcctgggctcaagtcatcctcccacttcatcatcccaagtagctgggactacaggcatgtgccaccatgcccggctattttttttttcttttttttttgtagagacgggattttgccatgttgcccaggctgatcctgacctcctgggctcaagtcatccactcacctcagcctcccaaagtggtgggattgcaggcgcgagccactgtgcccagcctgagattttgaacatttgcctccagaaaatgtaggcagtttctgtggctgcttatttcctcgccagtaatatattttgcttgttcctagagtactaaatgtaatgatgaccaaagtggactgagcatttcctagatcttgacactcttctaagcacattatatatattaacttattaaattctcacaaaaatcctatgaggtaaatactattatcatccctatgttacagatgaggaaaatgttaaataacttacctagtgagtgtagcataggctctggtgtaaaaagctgattcaaacacctgccttgccactgtgaatcacggccctcagtcctttcctgtgaaaaattgatttttattttttttgagacaaggtcttaccctgtcactcaggctggagtgcagtggtgtgatcataggttgctgcagccttgacttcccaggcttagacaattctaccatgtcagcatcctgagtaccttttaattttttagagagatgggatttccctatgttgcccagtgtattagtccattcttgcactgctacaaagaactaactgagactgggtaacttataaagaaaagaggtttaattgtctcatggttctgcaggctgtacaagaagcatggttggggaggcttcaggaaatcttcattcatggtggaaggtgaaggggaagcaggcacatcttacgtggcctgggcaggaggaagaaagtgggggtgggggtgccacacacttttaaacaactagatctcgtgagagctcactcagtatcatgagaacagcaagggggaaatccgtccccatcatccagtcacctctcaccaggccttacttccaatactggggattacaattcaacatgagattttgatggggacacaaagccaaaccatatcacccagctgggaaaatggattgttaatagtacctgcatacagaattgtggtgggcatgtgattttggcaggtgataagctcttcattagcattcactaccacagtgaacaccaccatcctcctcctcatcatcataattatctatccagaggatcatgtgagatgcttcaaacccctgactaaggcaatctcaaaggataatttgcctcaggtgtcagaattgtttagctgtacttgcctttccttgcaaatataatggcagaaaaagaggaaaatttagacattttgagccttttcgaagcgggaaatcaggtaagatattttcagatagataatttgttttctccttgtgctcttatcacttccttcctctttctctcccacctctgagaaccctggatgagggtagatgaagtagaggagagggtggtgacaatggtggtaaaagaaaaagtaaccaccaaacatgtacagaaccactccagcatttaattaaagcctgcagccctttgtcagccagaagctcctctcatggtgagagaggcagagagccttgtcactgtctctagaattatttgtataattcagcagctgtttccctcagatgcctaccacacgaggttggattataaagacgtatgagtagaatcgccaaggttcagacacttgtgttcactgttgagctgagagccacttaggctgttcttgtacaaatgcattagattatggttaagcagcttatggacataaaaacacattagaactttacagcactctataaattatagtttttgcagcattcacagccacaatgctaggtaattacattcattaatctactagtaagagcacataaagttgcctcccaaaccttactgtatgtgtcagtactcagctgggaaggagagtttttttcctctcctttttccccgtctttccctgttccattaagccttgtgtgggaagatttttgatgttacattgaggtgttccctaaaagaatccaataaacccattttttttttttaatggttaggctctggcaggaggccttgtaggtaatattttcatgttgagctgcacctagtaactatttttgtatgcatttattttctttttggaaatggacagatgtctcatttggaaagccagcaagttaaagcagttgaaaagagattaatgatagaatcagtggtaaatgctttttcaggacttctttttgcctctctctggtagcagttaacatgatggtccttttaattttggatctatcaggagtacaaagtattgctctcttcccatgccaaactttcctaaagtttccatctttccatatggtgataggaaatgcctccccccacagccctgtctcagaactttctcttatttgcatgtctcataaattacagaaggcagatttaggaagaaatgctggaactttatatggtgctagtatttcaaggagcaaattgtactttcttcgcattatttctcaggttaaatagaccaagtggaccaggcgtggtggctcacacctgtaatcccaacactttgggaggccgaggtgggtggatcacatgaggtcaggaatttgagaccagcctgccaacatggtgaaacctcatctctactaaaaatacaaaattagctgggagtggtggtgcacgcctgtaaccccagctactcaggaggctgaggcaggagaatcgcttgaaactgggagacggaagttgtagtgagctgaaatcaggccactgcactccagcctgggcaacaagagcgaaactctgtctcaaaaaaaaaaaaaaaaaaaaaaaaaaagaccaagtgataggctgggcgtgctggctcatgcctgtaatcccagcactttgggaggctgaggtgaaagaattgattgcttgctcaggagtttgagaccagcctgggcaacataatgagaccccatctcaatgtaataaataagtaaataatttttttaaaaagtgaaaagaaaaaataggccaagtaatacagccatcttaaaaataaaaacaaaaatggaatagagaagtatgttaacctgcaaccccaaggcaacactataagtcctgggtcatgctcagaccacattctaggcttctgctttcagttctgttcacatgaatgagaacatgaatgctagagccacgcaggtctgtgttgagtcctggtattgtcttttcatagctatgtgaccttgggaatattaattaatagtaataaaaataattaatttggactgaactcctaatacatcctaggcattacattaactaatttaatcctaatagctgcttcataagttaggtgatattattcgctccattttatatatgagaaaactgaagcttcacagggtattgtagtaattaaatgaggtattataaataaaatatccagtatgttgcttggcacattcaatgacactcattaaacacaatcttgaggatatatggagaatagatcccaccattgttcctccaatgccaaatgtaaccttttagaatgacagtttccctttttaatgacttaccagtcattaattgtatcagtcaggaagaggaattcctcacatttatttgtaatttatttactgcctgtaccaggaagtatcccaagcactttccacaaatttcattaaactttctattcctgtattccaggagaagaaatggaggctcataagggccaaggcatttgttcatgttcgtaaagccagaaggtgggaaagccagttctcggactcagatgtaaccgccaccaataaagagtagggatagcagtgaagtggtctattttcctggaatgaagcttctatggtgggaagtaatctaagcaactgattaaggagccagctttgtgcacttcaaagcagcctcagcttcggggtggagcatagagttccttttttttttttttttctttagcaggcaggaagatattcttattcccaaagaactgagaaatatttgagactatccatagtactcattggtgctgtaaggttagataactgctgagaagaaaactgattgctctgtgtaaatcagtatgctgatgagggaatgataaaactgcagggtagtaccagcgtcagcatcttgtttccaacccagctcttctctctcttgacaaaacagctgtcattttggattaatgttgaaatcaccagaatctgctggtcatcagagcagggccgatgccatctttgggatgaagtgtgctggcaacaagatagaaactggacatgggaaaaaggaaagtctccctcaaacatgctgccatccaaggcccagtttaaaccacaggctcaatttttgctcccaaactgatttcccgactaacccatctgctcatgcacacaccctcccaacctcacacagcaggcctggcctttatcatttcaggtcctgcagagctgttctctctcactgtggtactgatgccagttttaacagccgccatgtgtattgactcctctaccgattacaaatatatacgcgtttgccagtttgtttagtgagtggttttcataggctgtgatggggatttcactttcatgaatataatttgctgagcctgtggtgacatcaataaatccttctgggatggggaatggttgatttccctacatccagatgacatcctccagcccacttccttatgggaccaacagccaatgtcataacacatgcttctttgtgagagcatggaaggaaattgtttaaagtgtgtcatctgtgggcacagtttctaaggtagatacctgtgaggatgtataggcatgctttagacatggacagaatgagttatgtacttagtaactcaaaactctgctgagctcattgtggacagctcttacagataaactaaaatgcagcttcttaaaaaatgagaggacatttgcagaaagcattcttactgctttcagcaaatctatgtgccttatgtttttatatagcagtcattttctcaaatcagacatccctattgcctattagataaacacagaaagcatagattatgagtttaaaagtatcgacagcatttcaagtgctatcagagaacatttaattcagtttaattttgtgataaatctcacgtttaatcctctggttaccctgtaatcatgtctctattgatcttttctgaatgactgcctgcagtttaataaactttgccattaacccagagcttctaaaaggagagattgattccattatcaaatctgatagaaccaataagtacctaaacatcactaaatctatctataggaagctttggcctagagacaagcctgtggcttgtttaagaaactaggtaaaaatctggatatctttgcatgacctaattgcctcacagcatctgattcccttgtgcaaactgacactgcctttcatctttcaagtcaatgtagtagccaactgaaaggacagtctcttttcttgcctcaaccgtaattgtagggtctaatttattctcactgcagatatagcttgaggagtttatttggtctatgtctcaggtcagtgggtatatcttaagcacttttctgtgtctctgaaaacctgcaggatagtttgttttatttttacctatatgatgccaagggaaagaaaattctgtctggataaatcctgaaatagaagactgggggtgaagattgagagagagggaaggcaagtacagagtcatagctgtgtgaacaagctctaagacttggaaaactttccatgaaacccatatatgtttctcatgtagtgataggttatttgcaatatgtgttgaacaggaatttctactttttgtgccgcgagtatttatagctttcatcattattcattaatatttattgagtcacataggcagaacatatggaattcagggtctagagtatatttacagcttcttatttttttaaggtcagaaaggtgtcattccctgccacttttcacctcttaaataaatcggtgaaggttgtcaattttacagaaaagccaaagcttttattttctgtctagatttttattgacaatgtgaatttttcagaaggagttcggctatttgacttaggaggcatagcctttccctaattacacttcggtggggaagtggaggtgcacagaaggatttttataatgagacaatactaaactgtaatttaaaatttccttccaacaaaagaccctaatcttggcacttagaaataaatctgtaatgacgtggtgttaggcagtggaagcaggattagagccaagggactctgggtgtgttgccagttgctgattttctcactttggaaagtcacttgtttacccagccttagtttcctcatgtataaaataaaactgatggtgcctgcttagagagctattagagaattcaatgaggtgattattttaaaagatactgtaaactttttccaatgctgagttgttgtgcagacattaatggttatgaaaaagataaattagtcctcgctttatattcagaaatggtctgacctttcagtaaattatgtttagttcttaaatcaaaacccagttaggacaagagagcttgaagagtacgtatacataagagaagtctcacagagatatttgaaaggctggaaaatgtgctctggaggcaaaccctccactgaattgatgaattctaagttacatctgttgatattttttgtgtgctaaatagcctcccagtatggtaacattagagaggctgaaggaacctaagaggaggaccctacatttataggtattgaggtagattggtctctgcccttgagaagccaatcaaaattaggttgagaaaggatgtagcaattgttcgtggaatactaataggcatatatgcacttgttcatgttgattctctatgtcactgctctgtaagagaaggaatgcctgcacatcttcaataggaagttgacaacagtttctggaaagttggaagaaagttacagaattattcctttagtagtaattattccatagttctctagaaacatgacaaaacctcttgaaaaacttgagtcataaaaggactgcctcacatatatacacacacttcctgatatgctgtgtaaaactgcgtttatattcagagccacataacacaaattttgccagaagttgctttttataccactgaatagctctaaactttaaattgtctttcataaaattgtttcttgtctgctgagtggacagaatgtctctctcttccccacccttcatatcattttgttttcctaaatgggccactctgtgaagtagttctttacttctagccaccacccctgcctctagaacaatgcaaccaaccttaaccaaagtcacatatcaagagttctctgctgcctgttaatgcagatttgacttctttgtgtgtgtgtgtgtgtgtgtgtgtgtgtgtgtgtgtgtgtgtgtgtcagggtctcattctgtcaccgaggctagaatgcattggtgtgatcatggctcactgcaggctcagtcagtcctcctgcctcagcctcctgagtagctgggactacaggcatacgccaccacacccagctaatttaaaaaatatttttctggagactgggtctcactctgttgcccaggctggtcttgaactcctgggcttaagccagtccacctgccttggcctcccaaagtgttggcattaaaggcatgagccaccgtgcatagccagatttgacatcttaaaagccagagctagacatacttattgattgtcttcctggggccaggtgcagtggctcacgcctgtaatcccagcactttgggaagccgaggcgggtgggtcacttgaggtcaggagttggagaccagcctggccaacatggtgaaaccccgtctctactaaaaaatacaaaaaattagccgggcatggtgatgtatgcctgtaatcccagctacatgggaggctgagacaggagaatcatgtgaacccgggaggtggaggttgcagtgagctgagattgtgccattgcactccagcctgggtaatagagcaagacttcatcaaaaaaaaaaaaaaaaaaaaagtaatggaaactcagagaaggttgctgaagggaagctagaaggcctcctccaggacagagaagtaatcattttacacttatcacttacggtaactacaatagaatcagtgagctagttgctgaatacttctagagacattgttcacttaaagtgaaggtgtgatagtatgtgaatacctggggaagagaagaaagcgaaacatttttaggaaagaaaaggaaagtatgtgacttattactaatcaggatcaatttgaagatctgaatagattttcactggctaatcagagttattctgtggaatatctgcaacctctgcaaccacttttgatttttctgtgaatagtgaggtactgagatccagtaaattataatttggccttgatatcaagccatgaaaaagatgtttagaactaacattcattggcctctttcatttttttttctcttggggttaataaggcgatttatgttatttctaggcatctgttcatcccctctttagcatataggggaatagaaatggtttatccgggatatggatgtggtaatgtgtcttagtctgtttttgtgttgctacaaaggaatacctgaggctaggtgcagtggctcatgcctctaatcccaacacttggggaggccaaggcgggaggatcgcttgaggccagagttagagaccaacctgagaaacatagcaagaccttgtctctacaaaaaagtaaaaataaaaacaagaaaaaggaatactagatgctagtaatttataaggaaaggaggtttatttcactcatggttctgcagactgtacaagaagaatggtgctggcatctgcttggcttatggtggagttctcatgtggcttccactcatgatggacggcaaaggggagtcagtgtgtgcagaggtcgcatgatgagagaggaaacaagaggatggggggaggtaccagtctctttttaacaaccagctcgtgtgggaactaacagagtaagaacctctcttagttctattagagttcgacatgagggagggcattaatctatttatgaaggatccaatcccatgacccaaatagctcctcttaggccccacctccaacattggggatatatatatatatatatatatatatatatatgtatggttttttaaattattatttttttggagacagtctcactctgtcacccaggctggagtgcagtggtgcgatctcggctcactgcaacttctacctcctgggttcaagcgattctcctgcctcagcctcccgagtagctgggactacacctccacgcctggctaattttttgtattttagtagagacggggttttaccatattgcccaggctggtctcgaactcctgagctcaggcaatccacctgccttggcctcccaaagtgctaggattacaggcatgagccaccaggcccacccattggggatatttcaacatgagttttggaggggacaaataaactataacagaaataattagataatgtgtttgaaagtcttggatggaagtccgagaggggaagagtgatggagtagtacaattcatagcatggcccaacagcttcagaatgagaggacattcagggcatcctaatttcacaagttcattctcctttaagtttttgtttttagaaatgggctcttgctttgttgcctagggttctcaaactcctgggctcaagcagttgtctagcctcagtctcccaagtagctgggactgcagccatgcactaccaggtccagttctaattcattcttttataaacaggttactgtgtgtcctctactctgttctctgctaggaattctggcatgatgaagtcatagccattgtccttatggaggtaattctgagtattaccaggaagatccagttaccaatattttgatacactgtaataagtacattaattcttttcctatcttttgcatacagtgcttaatcaaaaaatgaataatggttgtttcaacttactttaccatcagcagtgtgcagtggttcccatttttccacaccctcactgacaagtacctcttgtctttttgataatacccgtcctaacaggtgcaagatgacatctcattgtggttttgatttgcatattccagatgactaatgagcacattttcatgtacttgttggctatttgtatgtcttcttcggaaaaatgtctagtcagattttttttaaaaagaacatattacatgtaaaaagaataatggttaattaaagcaagtatcattagaattacacatcctctcaaatgtgtgcgtgtgttactttagtggattagatttaagtgggagaaaaagcaatcgaaatttgagtgttctgcttgtctttcttcagttagcataccaggcttctgcccttggagaggcctgagaattgtgtggtgctagtttctcttctggctgccattacactatcttctgttgtatggttctttttgcctttttggactcgtcctttgtgtacgttattgccctaagccctcactgatgagattttctgcctcagtcatgctgtgctcagctttcagaatgttgttgttacggaggagttaattttttttttaaggtttccttttcgtcatgctgtatttctcagattatctggagggactgtaatccaattttaggaatccttcagggctgagagcctaaactgttttaagcaatagcatctggttgccagggactcaactactttgagcgtgttaaggtctaacggcagccaactctcaattatctgtgggaatgggagactcctgggatgttttcaattcacagagtgtgcaaaaatctcacttaaacggatagtcgtgacctcatcccacagctgagtttaggagagcttctcagtgtgtggttttgttttctttttgttttgttctcttctcacctttgacagtggcactgcagcattgacaggtgccttttatatgttgaatttatctgtacctgatctatttttttaaaccttgtccctctcatctttatttagattccatatgtgtatcattatatacattaagtatgttttaataaactgcctcaattcttttacattttaggagcagtaaaatttatttatattttctttctttgcttattggctaacgtgctcatgggaggggatgtagccaaacagtaatcaggctaccagatagaaagataagaaaactttacaaaaggttagcctctgaataataattgagaactggctgttaaaaatgaaaaaaaaaaaaaaatacgaactctaccttgtcactgaaaatgaggtgaaggccaggcagtgctcctcagtcaagacattcgtgttcacaactgagttgtctccagtggaaatttcatggctactttatggcctaaagccagtgctcccagacgtggtcatcccttggttttaggattctaaaagatgagtttcttttaatgaaaactgaatgtaatctagttgttagggataattatatgccagttgtgcatgacggcaagggcccctggtttttaaaaaccagctttatggaggtataatttacattccagtaaactgcacaaactaacaatatacaatttgatgagttttgacatgtgtatatacccatgaaaccactgccacaatcaagacagcgaacatgttcaccccaaaagtttccttatgtccctttataatcccttcttcctatctctcccaggaagccactagcctgcttgctgttgctatcaattagttcatatttcctaggattttatataaatgggatcatacataatataatcttttccgtctgatttctttcacttggcatacttattttgagacgtattcatgccacctgtatcaggaggttatttctttttattgctgagtagtattccattgattggttacaaccacagtttgtttatccattcatctattgatgtacatttgggttgtttgcagttttagaagcattgcacatctgctaggagcattcatgtgtagctcttcatgtagacatgtactttaatttctcttagggaaatacctaggagtagaacggttggatcatatggtcggtgtacttagaacttttaaagaaactactaaactttcttccaaagtggttgtgctgtttcatattctcaccagtagtgtatgtatgagcatcctctgcatccttgcccactctcggtagggtcattctttcttatttcagccattttatatgtatgtagtggtatctcattgtggttttaagttgtatttccctaatgactactgatgttaactattgttttatgtattcattcactttccagacagatatctttttttttttttttttttttttttttttttttttttgagatggagtatctctctgtcatccaggctggagtgcagtgacacaatctcggctcactgcaacctttgccctctgggttcaagcgattctcctgcctcagcctccgagtagctgggattacaggtgcatgccaccatgcccagctaatttttttgtatttttagtagagacagggtttcacccgttagtcaggatggtctcgatctcctgccttgtgatccatctgccctggcctcccaaagtgctgggattacaggcatgagctgccacacctggccccagatatcttctttagcaaagtatctgaatcttttgcttatttaaaaaattgggttgtttccttttttagttttgagaattttttttttttttttttttaagatggaatcttgctctgtcgcccaggctggagtgcagtggtgcaatctcggctcactgcaacctccacctcctgggttaaagcgattctcctgctcagcctcctgagtagctgggactataggcgcgtaccaccacacctagctaatttttgtattgaccaggctggtctcgaactcccgacctcaggcaatttgcctgccttggcctcctaaagtgctgggattacaggtgtgagccatcacacctggcccaagaatttattaaattaatatattctgtatacaaaacttatcagatacacattttaaaaaatatttttccattctgtggcttatctatttatgtatcttttactctcctggtaactcacagaacagtcactttattttcttgacagtatcttttgaagagcaaaattttaattcttgaagtgtaatttatcaatttattcttttatggattatgcctttggtgtcatagtaagaaatcttagcttaacccaagattacaagagttttctcttagaaattttatggttttaggttttacattcaggtttataatatagtttgtgttagttttttctatttagattgaagtgtggattaaaattttgcatatgattacctattctatcaccatttgtttaaaaaacttatttctctgtagaatagcttttgcctgaaaatcagttgttgatatatgtgtgggtctctttctggactattctgttcctttgatctgtttttctatctttatgccaatatagtgatgcaattttaatgtggtgtgaaagatggcactacagagcacctgacttgctcctcctctaacctactttactataatagttcactgattagcctgtttccctggataagcagcctgagtttaggaattctttcttagatatttccaacagatggcaatgtgtatgcacatagtaggtgttttgatatttgtttttaaaagatgtgaatcttagggattaatgtttgaatgccatcctggatgccttgtacattcctacagatagtagtcttctctactttctaaaaagtttaggctctgaaaatctgttcataaagtccatttgctcaaaagtccaaagttggggactgttgtgaacatatctatctagttactagttttctaatttttcatttcttatcactggagactcattattggtagaatcagtgtttgtaaaaccattcaaaaacaagtacaaatggtatacaataaaccagcaagggacttgacagaccaaaatgacaggacacagccattatgtcattgtgtcattggggacaggcaaagcacttttttctttttctcctggcttgttattttctttaaggtctctaagatcagataactaacagaagaggctcagtttaaattgcaagcccctcacatacatatacatgcatttgggtgcatgcagacacatataccacaaatactttgtaagtgatggactgccctcaggttagtttgcttggaaaaatcaggcggagactttctataacccacttcatgcaaggcagacaaattgtgccctcattttctattgtctctggcttcatctgtaatcagcaaatggagccctgcagcttacatagtgtttcatctgctatttgttactctcccttagtttgcacaacactgaaccatctcattttgaaattcaagagtggcgaggaggcctttggtggaagattgtaatttgggagaagggaaagtcaagagcaagatcgcctattttgaagaaggcggggtgttgaaggaaattgcctttgtcagtctctgagcctctccatatatgtgctactgtgaccctgccctccatcaccagtgacctaaaaatcacataatttcaactattctccaaacctattcacatctgttgtgcatggcttgtacacttaccccctctattgacagccaatatgtctaaatctttttgcctctcagccagcctcttgttggtggctccctggctttcttgccttctttcctgcttcttctatgactgtcaaatgaatgccttaaagcgttttttttttttttttttttttttttaacagatttctttcttatccttctgccctcctgcctttctctcctagtgcttgtgtaagggaggcagttttttttatctttaccctgttagggtctctagctgaggctgagtattaaattgatgtaaaatagattaacagaagaaaagcatatggattttgacacatatataggagcccccacaggaaagtgaagacccaaaaagtggcaaatcttgaatccttatttagtaggttgaacagagtggccgttgtggaaaagtaactaaaataaatgatgtggctaaaggaagataagagttagtaagatctgttggtacaaatttttctggactccccatgtctagaaacgagaaaatttcttctttcctactatagggagatcatctttcacatgagagttttttcccatctcaggtgtttctggtgataatgtttcttttctcctatctcttttgtttctatttttcaagtgcctttagctttaaaataatccttaggcctaaatagcatgttttggggtggcgtgttctgccactcttcatttgctcatgctttccttgcagaatatggactacaatcatcttattttcaaaaaattcttcaggtaattctgatggacagtttctcttgtgaaccactatcctagatcatggtagacgaatgaatcaacaggcctttgaaaattgccattcattgatcccaaaaagtttttttatataccagataatttccctccccatattatagcaatactagagactgcccaggtttccttaaggaagttcttaaattagtgctactggttggttggtggtggaggaaagcattggtgggtgtatatttacaaacaattacacaggcatgtagtcatgtacacaactcttgtgactgttgataagatgattagtttatgatcagtctttgtctttgattcttaatgcttataatggatagtttttgtcatttttctccaagacagtctgaaaaaattaaatagttattttactttataaatggtaagcagtcagtacctgtttatagagggaatgaacaaagagtggtctggtttattcaggatttgtaccaaaaaatctatatagtaatttataaataaaggtagatctttgaaaaaaataaagataatctctagtctctgaaaatataaacctgttacataataaaaagttgttatagactcttcatttcttcttacctcttaagccaccacctctagacacactttgatcctctctctctcttcttccccccccccgagtggaaaatctcaatattaattggagctaagatgattgtactactgctgctaagacttcagcaggtctcttacaagctaatgtcacggcatggggtccatttgctctgtgtagctattctgcagtgcagtgagaattccttgattaatatgctacatgaaaataaaatggatttggaaaaaattatagcatactctcataaatattaattcacatttgtatggaattacacataattttcaatatactttggaagcaccttcagtatgaaagatttggtctccaaagagaatggcataatttttttaaaagcacagtggatacattattaagcatcatttgtttattaatctgatcctctacatgcatatgatgcagggcagtaggtgggttgtgtgacaaagaaaggagctttataccctgtggggagtttttatattacacttagaagtggtacaatttaatcacattatatagaagcagcccatgatggaactcacctggctccctctgctagtgttgccattattcctgagtgtctctttatggcagctattttggttaaatgtgagactaaacacagaacatttttgagctgagcagatgcctggcatagctgactgaggttgtggacactggacaaaggaattcaattcagcagccattcattgaacatttactatgtgttaggcatagcatgcaaggctgtgaaatcaatggccatgtgcgcttgctttgatctcgacttgtcccctgaaacacttttcaccacatcctcattgcctcaggagagctacctctccgatggcagagggttaatcgtctgcagtggtagcagctggaagttaggccagaagctgcttatttgccttgtggactgttatctttgatatcttcttactcttaaggataaggcctttccccttttctggggtttcttgctgtttgctgtgatccttcgtgtataccagcagtgcacactagattccttggtttcctgcttctatcaccctttctggcttgctacactgtatgttagagacagcttagactattttaaagtcagtattgtgctttataggtttggatgttttaactagttgactcctttatttatgtatttattgactaatacattggccacctactatttgcctggtttatgtgaagtacttatgtgaagcactgggattactgagatgaactacttagtccctcccctctttcacattctttcaagagattatgcacccagctgcctcaaggcctttgcacaagctgttctctctgttcagcctttcagatctaggtcaaatagcagtcattttctcagctctaaccctctcctctggactatatcatttcccttagttttagcacccataacctatcctttagcgttgttaactcagtttgcaatgatatatttgtgtgatttgattagtatttgtcctgtaaattctaggctctatgagggtggtgacttttccccacaccattatcatcctaaacataggtcagtgctacattggtacttggcatgtactgggcacacaaaacataattgttgaatgagtgaagacctgagaatagagtactttgtattacaagaaaggtctccctgagtgggcaacactgctaagagtcactgaactagaaaagggaggagtgtgtaagagaggccttttgaggccaaggcaaatcagtgtaaaggcctgcgttagtttgtccaggctgcattagcaaaatgtcataaactgagtagcttataaacaagaaacatttatttctcacagttctggaggctgggaagtccaaggtggaggcaccagcagattctgtgtctggtgagagcttgtttctcatggatggtacctgttctcacatggtagaggggcaaatagactcccttaggccctttataagggcactaatccccttcatgagggttccaccctcatgatccagtcaactcccaaagtcccccatctcctggccaacatggtgaaaccccgtctctactaaaaatacaaaaaaaaaaaaaaacaaaaaaaatggctgggtatggtggcaggcatctgtaaccccagctactcgggaggctgaggcagggaatcgcttgaactggggaggcggaggttacagtgagccaaggtcgtgctgttgcactccaacctgggcaacaagagcgaactctgtctcagaaaaaaaatatattctggggagacacaaacattcagatcataacaaggctcaaggtctcagactaataggaatggctgatttggggagagatgtcagggagtaccatgcatgtaaagttgggagtgctgggatattgcagcagaacagtgagaaaattggatgtgaaagggaggaaagagagcggtattttaaggagaaatgagtaaaaggaaatttctattttggttttgttttatttttaaatgtacatttagatagtaaaaaatttaattgttcatttaaaaataactaaaataatataattggattgtttgaaatacaaaggatacatgtttgaggtaatggataccccatttaccctgatgtgattattacacattgcatgcttgtatcaaaacatcttatgtaagtcataaatatatatgccgactatgtaccccagaaatgaaaaaatttttaaaaagttcatttaggactgcagaaactgaggaagtgtggtaaggcttcatgagggggattttctgtgtaagaggattagatccactagtttccaaataactgagtgccaaaacattttcattttattgcttagtgtgtgcatcatttctcacagggcagaggatatttgcatgtatgtggtttgtttgatgttctgagagcccattttgcacgtggtctcagagttgtagtgacttactccacttctgataatgaataatgtcagtgtccggacactaaaagcccagtctgttggaaccttggtgtgtactgagctgcctggaggcacagaactcttatcaggtcatgtggcctgaaatgcttacctgtagtttctacagatgcagttccccattcaaggacattgatttcccatttcctacccacctcccctcatccccaaccacacacaggaataaattaaaagttgctgttgatcttggtgataatattgttgttacattttgcaaagaaaatggaaataaaggatgcttagaggaacatgtaaaaaaatataatgcattaaggaaacattttaatcatatgaatagacagttctttcttgctggctcacatccacctggacctgataaattcagttgggtgctatttcttttgaattgagcatgcacttagtgctcattttctgaaacataattgatgtaccaacttgggaaatgagtgtattgcacttccttggggaaggtcattgtgtgctggacccagcaccaaatcgaacagaaagctgctatcccagggagcagtgaaatcacttttgatgcatatacttgtgttttgtttagttttctgcccagtaataatagaaaggatatatatatttgtgatggcattaaggattcaggaaaattgagaagccatgtttcttagttttgggtcttctcatatcccactttcctatccctctcccacttagtagtaacaccctttagtatttagcctatattttgggtgtgaccctagatacctttgtaaccaccacttccctttccttctcttcttttctacagaaagatgtagcacttaagcctcaggaacgtgtggagaaacgccagacgcccctgaccaagaagaaacgagaagcacttaccaatggcttgtcctttcattcaaagaagagcagactcagccacccacaccactacagctcagatcgagaaaatgaccgcaatctctgccagcaccttgggaagagaaagaaaatgccgaaggcactcagacaggtgaggaagcttgggttcgctctttcctgtggcggcaaaatcccttccttaggtgcttcctccactgtggtttttcgtaacaggtggagaagatatccttggtgggatgctgaagtggttgtccaacaaagctgtgtgcgtgcctttaaaagaatctaaaacccaatctcagctctttctatgaggatttgaaacttcagcatggtgccctttcagtcagatgtgctttatgcaacaaagcttgatgctaagtggtactggtatttagggcagacctgtcttaacagttgtcaagatggactggcttgcaggggagagatctttgcaattaggataaatggaacaggtggatttcatcacatacattgtgcatctcatggttctaaggtgctaaaatgattgcctgtgtgtgagaaatgccttgctaagatttatattttccggggaagctcagatattgtggcatctgggagggcaatggcaaaaaatgaatttgccttttggtgtcttagttgttctccataggctataattcaagactatctttgtgatctgttgattgtatgaacgtctgataatgaggcttactggcctgttaataattaggtttcaatgatccacaagaaagtatggctcttggcatttgggaagcctttctgcctgtggaaatccccacatgagatggattaataatgagatatgaagctgtttatagcagtttttctgcacaaatccagaggcttcagtgcctgtcaagttagttacctgtgtcctgggtgtgttttatttatttttggcaggaccattgggtaggattgactatcactgaagaaagcagaggaaggaattgtggtgtacagagcaggtgctgctaattagaggtggaataggtaatttttggtttgcagatgtttctctgcagaggcagggagatctgggatcaaacaaaacaatggttcccaaaccacacagatcttgagaatcatataatgagagctactaaacctaaatttctggcccctctttaggacctaatgacatttgtagttttagaaagtttcctatttgaaaacagtcagcctggttggaagtcactcttacaaagaatcaagagtgtatttgggtgatggtttttagttaaaagattggaaagatcaaaagcctcaatatgatgtagtgggcagtttggtgtcagaattctgccttatacgtagtgaagcatataatcctggtaaaacatctggggtgatgggtttcagatggacccagaaggcttccaaggtaatgcctaaatctgacaaccagcacagtgtttccaaaggtacacttgtgtcctgaaacgccagactggagttataatagtaattattaacatttacctaatgcatactatgctacattcagtgagggagtttttatagtataacctataatttgtacaacaaccctgcctagtaggtaatatcatggttacttaacagctatggaaacgagggctcaaagagataaagtgacttgtctgaggccttgtcaatgagggaaggagccagggtttagacccagatatctctagttccgtggtttgttctgttttccatatttagatgaagttttatttatttttttcttgatagggagttggggagagggaggaaagcctaagttctataaaaggtgatgttcctgtggtatttgtgactcctaactcatgcctctgtgtgagatatgtgagaaaagtaattaatctcagtggagagagattgcaatgtaaccacccccctctccctcaggcccccgccccagcagggtaagaaggaagccttcttactctgagttaacaccaagctgcggatcctcatccttgaatctttttcttctagacgtgatctgacttttctattctgtgtcctcagaattattctttgtatttctttctacttcttcgagactttcaaggtcctctggtgacagagttttatgatcggaaaagaagactaagacgtaacacatcttaaatttgagtagcttttggtcttaatggccaactctcttgtactaatggtatttgaaatcaaagctatctttgttttaggtaacatatttgaaaagcaagtattttgactctttatgaatcatggagaaggaaagcatgaattgtatctttggccctatgtaaaacttttaaaaacaaggagtattttcttaccttcagtgttgatgccaaaatatgttatccaatcaagtgttatatttctagtaagaaggaatgcagaaggtgataattgagataaggccataatacttctcatttttaatattcttagaatcacttgtgctattatgaaatcccaaacaagtcaccatctggtaacagcccatctggaaaatgaagggcttggacttgaatgtttcttaggctcctccctctgggtcccatagttttttaaatttatgaataacacaaatacagtgttgtaaaggtctgtaaaggagtctgtaggtctgaaggtaatgccgttttggagtcagtctgtaactgataggctctgtgaagacatttatttatttttaatgtttttttttctttaaaattttgttttcatgtaatatgaagacatttaaaggagaagggtaagatgcatttatagtaggagggaggggagtggtccattgtgtgtcagtccagacaactgccatctgttatgtgatcattggtaaaaggtgacacatgagtgtttaatgaccatagtagatgttcaaaaagcttgtctgaagaatactcgtgattgctttcctatcatcctagatgcctgtaaatatcacaattactttatcgcctgcgtttgcctcttatcaggtaaagaaactgaatctgaccatcttagctgggaggggaccttgagatgagagtgagctttgaggagcatttctacattaatggattgtcatttagtgcctgttattgagaactacagatgaaatagggaagaggcgagaacttagtctttatttctgacttggttagaatgaattaggtttgcatcttattaggaaatggtacttcctgagcagacaacttaatgcacagctttcctgtaattatgggaagatgttactccttagtagagaggaaagaataggatttttttttctgagactccgttgaaggcaactgatctttttactcggagggtgcaattataatacttttataggaaagatgtatagttctaaaaccaaactgcttattctttcacttgcctggttgtaaaacccaagttcttgtgatgtttttccatactaccaaaagaaagcttttaaactgacacttatttgttggattatgtttttaagtataaatacatactgccttagaagatgctgaggtggcacctgtcttggcaaatggttgcactttttgatatgagaaatttgaatacttttcttacttcccaaaggggttaaaattatgaagaaatcaataaattacctcttatacaactcttatacaaaatagcgcatgtctttctgacctctgtaaatgaactatttgttcatgatgtaagcacttagacatgatataaaaaaagttttatcatttacttacaaggacatggtactttttttttctcaatggagatttgggggtgggaaaagcaaaagaggttgcacatggcctctccttaaggagctttattctctaattgggagaccaagtcacaatgaaaccactcaggaacacaaggaagtcaggtgtcgctaaaccgataagccaaattataacttcctgagaagcactttgggaaaacttaacccttcccagggcattgagtttaatttcagtatatctgacttctagaccatggagaattcttaaaaaatttaggactttgtagtttaaaacacacagagagcaaaagggttttaaaaatagagtaccaatgatgaaaagttgatgagcattcagagaactctcagatttggctctgactggatttctaaatctccatttagtccattagtctgtcctttctctgtagtatcaactgagccagaggaaataggcttaagtgagctagaaggcatttttaggttatatgaactcttctaacagacaccaagatgaatcatcaaaataaatcctgtggtctccctccttaactgaattttaggtgccaaaaagccattcatcttagggcagaatttcctaaagaaagaggcaacctgttgagattgctttagtcacaggagaacatcattttagaggaaaatggaggaatttgtgaatatttcaggagcctgttagtagactctaaccttgctggtaaggatggcttatgtgggaatgtcttatgtggtttaaaaatctttatacaagttgatctgggtaggtatttctttttaggaataaaaatttgctcttctctctctgaaaatccagtatggtgggagatttgtagttgacattgtaaactgtagacaccaaaagtgtctactgctttctaggaagaagaggaatccatcccagtgccaggcatttaaaattagagtgattactagaactctgcatggttgcatctgcttcatgtattgacattgtaccttggtcttccttggagtaagtgatagtggtgctatagacttaagagcccaggtgactgagccaccctctcttcccacctgtcctgatggaacagtctatcccagcccatgctctttcctgttgagagtgtttgctaccagaggctggtcccttatttcagcacgacttagacttactgcttttgtctgaagagctttctctaaatttgttactagtagaaattaacttgcaaaggaggatttataatggaaaactttgattaaacggatccagttcaagtctcgtttctgaagatctgctaattagttttggatggaaatctaggccaaaaatcacacaggtatttatccagcttgactctagagcctacaggtttctggaaatcagagcatttgagacacgaatgtaatttgggattttactgtcataatgaaaagacatgaactttgctatgtgctctttcatacatacttttgttataatatttagatgtctgctggtaccttgaactagtattaagaatgtcagttaaaccgtttctacctcatacttcaaaatttcaagtttaccatgttaattgggatttcatttgctttcgaaaaattttgtagtcatgtgaaggttacaagctaaggtatcaaataaaattctttatatttttttcctttttatgaatttaagttgcatactactttttccccttgcctaaagtatagaaataagaaaaactgtaaggaaagatggagggaataaaagattggcttatgatctctctttggaatattgattgacttgaataagagtgagatgctagttttaacatcaggtaattgaagaaccccaatctaggcttgtctgtgttcaggaattactcacgtattgtattggaagtattggtttgtaactgggattggtaaacctgacactaatataataatgagttatatgaaaggtgttttgcttttgttttatcttgagcatttggaaacaggtttattcgtgtttttcattttgtgtcttttgactctatactttgttgctgtgagccctgaatgttgggaatagtgagcataaacatcacttaacttcagtgagatacatctttggaatgttatgaccagtaataattttatcctaaatgacatttgtaattttaaataaaaatttagtaaaaattgactatgaaaaggacatagcatatgtattaggattctctggagagcaagtaccagtagaatatatatgtgggtagataagaggggattcattcggggaatttgttcacatgattatgggggctgagaggtcccataacaagccatctgcaagatggagaccctgggattcacagtatggctcagaccaagtctgaaggcctgagactggggtagtcctcaagtccaaagcctagagagcctagagtttagatgatcaagggcaggaaattatatcccagctctaggagagagagagagaccatttcgcctttcctctgtttttgttttatctggacacccggctgattgcatggtgcctgcccacatggagggcagatccttccctacttagttcactgagactcacatgccaatctcctctggaaacaccctcacaaacacacccaaaggtaatgctgtaccagttctctaggtattctttaatccagtcaagttgataccctaaattaaccaacacagcacattaactaccacctcataaaataaaacctgcagagagaaaataagctgaatgggaaaaggaactgcaatgaaaagaatgggccataattcagcttgggtgatcctgatacctacaggagttgttccataaaacagtgaccttttatatttcccaaagtaagaaaattttatatgtgtatttgtgcatgcagaactttattaagggccatttaaatcccatatattgatagaggagttaagaaagataaagtgacaggagtgattctcaactctggctcccataaatttctacaatgtcagtgattgaagaatgagggagcacatctttcctttaataaggcctagccagtacacttttggtagttgatgagggtaggacagaactccctttctttatttgaaactgtgtatttttgtgctgattaaattttacatttttccctcttgtgatgatataaagttatctgcatgtggccagatctcagctaaagaacatgaaataagcctctgtacattctgcattctaatctctgttcacagcaatcttgtatccacacaagtctgtacatgacaggtaatgagtgggaagtgggaggagatgggtgtctgtgtggtttgcactggtggtggtggggaactgagcagatggttgtgatagccacatgctgcgtgattcccgtgggagttgatggtggtgacaggcgactcacaatgtgctatttacagtttgggtttgcagtctttcggtgacatctgaatgctctttagcaactgctttcattactgcctttcgaggagctgttaattgaaaatgaaattgtgggtgggctttaagacaggcagacgcaggcaattctgtgtggtaaatgttgcttgagaactgttggatgtcttcatgcccaatttgtaattcattttctaagactgtaaaagccaaaggtgcatttggagattcagttatgtatatacataggcagagttgaatgtcacaccttgcccaaagggtcaaacatacagttattggtatgggtgctgtggttcacgcctgtaatctcagcactttgggaggctaaggtgggaggattgctttgagcacaggaattcaagaccagcctgggcaatatgatgagaccttgtctctagagaaataaaaaaattagctgggcatggtgacgcatgcctgttgtcccagtttcttgggatgctgaagtgggaggattgcaagggcccaggaagttaaggctgcagtgagccatgttcacgcaactgcaccccagcctgggcaacagagcgaggtcctgtctccaaaaaagaaaaccacacaaaacacctatttgtctggaaaccaacctaggggaatgcttggcaatcccagctgcctgctcatgtcttacctttgtgtagttctctttaaatgtatacaactgtgtgaggttcttatgtaaaatctgctgacatcttgtagtgttctctgtgagtttatcgtaggacttcatcctcctttcttcctttagctcttcataaagttactatgcaggagtaaatggttatttgttctcttgaactttgggatacatttttccttccgtatccaaggaggattctttccaggactccccatggatactaaaagctgtggatgttcaagttccttaaataaaatgttatagtatttttatgtaaccaacacacatcctctcacaaactttaaatcatctctaaattatttataatacctagtacagtgtaaaagctatgcaatttgttattatattgcattgtttaggcaataattacaagacaaagagcctgtgcatgttcagtatataagcaaccattgtaggccacatttttggtctgccattggttggatccatggatacagagggccaactgtatcatattcaagttcttacatataactttgtttcttgtaaacattttcatatgatacaactctgttaaaggcagttggagcccagaggcaaacaagagaagaaggaagagagagggtggattttattggactttgacagtggttgatgatcttgattctcttatggctgcccccagctgcaggattgtgatttgtttcttatcttcagagttgtttgctaaagcattagtagcattactgaaatggtagcttttgtaaatgtttatatgttgaattgttttattgcccatagctttgcacagaaatcttgtgctgaacaaggaatgacctccctcttggaagtgctgttaactctctttttaattaaatatgaatatagatacaatataactgcatttttttagttttcccttgaacatttcagtgaatactatctgggacaaaaccgtgctgaattatacgctttcactactatcactctttgctcttagagagcccccgaggcttggggtgaggagacacaccccttgctgtacttaaccctcagtcccattagacctgctttgccacaggaacccagctgttttaatgcatttgagttgctgttgggtcctaatgatgtttaaaagaacctgtcttggtattctaaatgaactctggagcattgcctattgatgcaagtgttgatgattttatatcaggcagatataactttgttatttactctggggctttttacacctaggggtgtgcatcctcacaccagtgctcacaaagacacacacaggagcagaaaccaaaatagctcacaaatgtgggcaagtcctgtgggggaccaccttatgtctctcaggaggcctgatgagctgtgccatgtggccttctggaacattatacctgcattcattgatcacagctctgcagaagctgccacttctcctatgtgcctgcctgcagtgacgctgatgtagcaggtcattctgtaatcactgtttgcacctgcatttgctcaggaagtgtttgctcatacatcttgaaatcatgtattacaaacctggacaggtcctaattgctggtgatggttctgagaggttgagattggctataattagatggagaagcaattagctacatattctgagtagggaacatacagaataatgtttctcaaagggtggtctttgaacccctatgtcagagcaactgtggatcttttgttaaaatgcagattcccaggtaatcaccttggcatagtccattgggtgggggtcagggtgtggcaacaaggaactggagttccttcagtgactccagtacaggtgctgcaggagccatatttttaaataaactgtacttattttttattttcaattaaaaattgcaatattgttagcaaaacttgggaagaatcataaaattgtaacaacatatcttgcggaaattaattttatcaataattggatcatatttttgttctgtacatttactaattgagttatcttccaaaatgtattggcaagaaagaaatgtttctgccagatgatgtagacattatataacaaaaaatgatgttttcaaaatagctactttttctaggtgtttactagaatggacctgatagaataattgtattctagtattctctccttaggcccactggctcactcaaataatagctgtttataaagatgctaaccggagttttttatttttcatttttttaaagttctaatttcttgttttttcccatctgtagacaatgatgatgagctcttaaggtttatacattttttgaacccttcaaattacaaaagttggtgatatttggtactgggggtcaagtgtgaaagaaatctgaaaatattgcccatatcagtggagactaaaggccatttgttattttcttcattaccagcaaagcttcagtttaataaaaatattataattgaatttacgattttgattccacaaattcaaaaagaaatattttcctttctaaagccaaacagaataaaaattctcataagaatttttgtttaaatagcaaaacctattcttaggatttaacaattgcctgaggtttgtcaacagtaggtagcattctttttttatatattgctatgaggccaaaaatgctattttcctggagattagtgcaaaataatctaccgaatagttgctaatgaaattatcatatgagaaagattattaataatgacttttgattttaaaaaatactatcatcaaattttcctaagaaatgatgatgagaaaagcagttttgaaatacaaagctgggtggtagtgggcctggtgtgcactgctggaaggttgcatggtactttgtgaaacttcagcagcccacttgcataatttatcattacctgtcccctacctctctctacttaattctgaatctgtatttctcagataaacatggcagtaggaaggatagggaaaggtgttgaggggatgtgattatatggatgtttttgaaggggagtatattggtgtcatgggatccttgggatgtcatcttgccagctggaatcctctgtggcaggggtaccttctctctgagtattgctcatgctcactgggcactgggcttgttctgcccagttggcccagcaggctgcacttggctcatgctactggcccagatcccacacctgccaagggcgagccaggcgtagagtggcaaggggtgtgtgggtgagtatattagttcttttccacgctgccaatagacacatacccaagactgggcaatttataaaaaaagaggtttaatggacttacacttccacatggctggggaggcctcacaatcatggcagaaggcaatgagtagcaggtcacatcttacgtggatggtggcaggcaaatagagcatttgtgcagggaaacacctgtttttattttattattttattttttatttctttgagacggagtcttgctatgtcacccaggctggagtgtagtggtgtgatctcagctcactgcaacctctgcctcctggtttaagcgatcctcctgcctcagcctaccaagtagctgggactacaggcacctgccaccacgcccagcgaatttttgtatttttagtagaggcagggtttcactttgttgaccaggctagtcttgaactcctgacctcgtgatccgcccgcctcggcctctcaaagtgctgggattacaggcgtgagccactgcacctggcctgaaactcctgtttttaaaaccatcagatctcttgagagttactcattatcacgagaacagcatgggaaagacccccatgattcatttgcctcccactgggttcttcccatgacatgtgggaattctgggagttacaattcaagatcagatttgggtggggctacagccaagccatatcagtgagtgagcctggggtatggccactgctcacagccaggcatgcctgctgctgcggcagggtgggcagccccaggcaccagaacaggtgctggctccatgcaaggctgtggctggacaagatgtactgcatgtggcttccactgtgggcacccctgtctggatgagggcaacaaggtggcacccagaagcttggagataccaggaaccacagagccccaaagagggtgtcacagccctgcctcagggagcccctaggtctgggctccctaaagggccgcagctcttctctccttctcattaactgcaacgtggcgagcaggggggaaagtgtgtttcagccctgtttgtgttacagctcatcagtgctgccattcaacaggtctcgagttcatgtcccatgcctaggaagaatgaggtacagcagacaactggagtgtgagcaaggcagagaggagctttatttgatccacagaacagctcccaggagacctcaagtgggtaactcctttccacaggcaggtcatccctatgagtgtccagctctcagtggagaggcgagccgcagtggtagctcctttctgcagctggtagtccgatgtctgtttgagcctggctgagtctcgggtttttatgtgcttagaagggaagaagtacatgttgattggtccatgggcaggcctggaaaaagcaccatccgattggccaaatggtcatcaatgaagtcttcactctgggcggcagactccaccgggaactggcaccctggccgctaggcttcaggttgtccctggcttgaaggtggaatttcactggggacctgtccctttctgccctgaaacctgtctgcctcccaccatcaatgtgccatccatggcactcaggctgttgatgccaagggacacctgtaggcccacgctgagccaccttcagtcctaccttggcctccctcttgtgctcatgggtgcccaaaatctggagggggtgctgaggtggcagggggctggcgtgtcaatgccacccgagtgcatgcatgcctggccaggttgtgacagcactcaggcttagcctcaattttcctctgaaatcagagtgggctccaggtatggggagaagccaggtatggggagaggccaggtagcgagagtaggcacttccaagactgctcgggcaggggcacttccccaggcgcctgagagctcagggatgcctgggtctggagccacagctgggcagctgcatgtgtgcccaggagcatgaatctccctctctgccaactcagtggagggtggggctcctgcctgttcctggccccagccggctcctcagagcatacagccccggctgcagccagcatcttggcagcggctgctccagacaggctgccactgccatcactgggaccatgtagggagtatattagggctgccccatggttctccagatagactaaggagacaaattgacatagtacagtattagaaggaaagaatatggagtttaaaaaccgttttcatggtcattctgcccctgctcttctcttccccctttcaaactgagcagacccatatttctcctttcatctctgtccttgagcctaccttcagctctttggctttcattttactccctccttccacccagtgtcttttgctagcttcttgacccagccaggattgcatgggacatcacttagatctgctctcagagtcacaaaatgcctttgcttcctgtttccttgttccttttactgtgctggttcttttcggtaaacttttagatttatcatctctagattagtgcagcattatttagctcattgctattgtactctggtttaaaaaatttcagtgaccatccacagccatctaaataagattgaagcctcttagtataggacattttaggccctgactaatcctgctgcaatgtaccttcccagttgcctttcccactctctgtaaacaccaagctgcaactacaactgctatttggatgaaccctgtgttttctccacattcctgtgcctgtgctttggctattttctttgtttagaatattcttttttgacatatttgtcttccattgactagttcagacccacttcttccttgaagtttttatgatctttttccttgtaagtaattgcattgtcttcccaactcttatgatcctttgtttataacaagggtcaccccagaatttatcagctaatttaggacattactgggaatgaaagggggaaccattaataattaccttggaacaataagcattaatcaggacttcctgaaaaactgggatatatagtcactctgtaattcacttttggcctttttcataccatactctgttttgagttggaggtatacattttcttctttccactgaaatgttgagctcctcgaggacctcactgtgtgacacagcaaggggcctaggcttatgtcacatattgggaaacaacacccttaaaaccactgctatcctttactcgaggatacccttctcatatttatagtttccattcatgtctctttccagtcttttctccatatgctagccagagtgatcttttaaaaatatacatatgatcatattattcccacaagtaaatcctctcaactgcttctcagggtattcagattgaaaatcagactcccatcatctgcagtgcccagttatccagtgctgtttcttcagcttcatgtcatgcttcccttgcttactggctccagctcccgaccttccattccctcccacatgccaagttccttcgtaccctggacaccttatgctatcctctttggaagaaatggttccccctctgttttttgaatgatgagatccttctagtcctttaggcttgaactgaaatgtcatctttcataggggcttttctcgaccatatggtttatttaactcaggatctgccatttgtcttctgtgttttgcactcacctttttaacttcctaacaccacatttataattatagatttttctttctatgtccttccttatgtctgcaccttctgctgcactccaagctctactgaggagagatatcacctccaccacagtgtttgtagcacattgcctggcacacagaaggtggcactcaataattaaagttgagtggtttgaataatttttgcaatggatgacattgctaattccacactcctgttacattccaactttaattggctacaaaaaaaagcacacacacagacacagacacacacacacagacacacacacacacacacacacacacacacacacacacaaacaatccagaccccaatacagtatgactgttgtcttctctctctggggatatgcaatgtaaaataagatactgatgagcgcatgctgcacaccaagcaaaaatttatcccaagcaacccctgcgccctgcgtggaccgtgtctgctgttctcccatggaatctatcagcagtttgtcttcccagggttgtagcctgtcaggatggtagaattgctagtgcagccaggaaaagctgacctaggaaaaccatagccttccatctttttagaggtaatccaaaagagactagacaagcagaaagacggagaggaaagttggtgggagtgaggtgaaattcactgagtactcttttatatgcaaatatttgtgtggggctctacttttttaccatgagtacaaactctttttagtatcaatgcatgaatagcgtgtcttttcactgaaaaattattgtcccacgtgccctcggtttaaaatgttttgatcttagaaaacagtttatttccttttaaagtggcccaattaattcattttccacatatttgctcattgagcaaacatcaactgaacatcgtttgtgtgcaaaccttatacaagaaactctgacataacagggaggatatgtttaatgataactctgcccatgatgtgtttatggcttgctagatccattctgacccacctattgtgaagagttcatggagagctcttaacaacaagtgaggctgaggctggcagattaaatgcagttcaaagggagacaaggttgaacatctcctagagagggaataccttcagagatacatattaaagttctttaaaattgtttctttcttattgtgccatttttgttgacctcccttctgtccttttaagaaacttttgagaaaaatgcattattctaccgaaagcatcggcaaatgttggaaatagtattttgtgtatcagttttcttggctgcttatttttaaaaataaaggcttaaataaggttcgcacatttttcactcaggtgcaatttactgggaattacctggcgcattggttttatgcttaatatttacagattattaaaatctcagtggctttcaaactgcatggaccaagaaaataggtgtattttctagaaatggttttgcttatggacactgacccactttgaaacgacttactcttggaactcttagtacaggaaagtcttatgtttctgtctagaggtggaactgtttatgataaatagaaatagctttccttttctatcatttctgttttcttggaagtagattatttttgatgcaagtagaccttcagaatttgaatagaaatttttatttatttatttatttattgagacggagtctcactctatcaccaaggctggtgtgcagtggtgtgatcttggctcactgtaccctctgccccccgggcttaagtgatccttccacctcagcctcctgagtagctgggactacaggcgcacaccaccacacctagctaattttttgaagagatggggttttgccgtggtgcccaggctggtctcgagctcttgagctcaagcaattctcttgccttggcctcccaaagtgctgggattacaggcgtgagccaccgtgcctggccttttgaataaaaatttagacttcagatttatatagtgagtatactgatgggagattgaacaattacgtgatctcaggagtagattatagagctgtttctaatttactatcaagttatttttttcccaaaagataatttataaactgcttttttgtttgtggaaatcctgtttgttaggaagtgttacaaatggtagtttcccagtgaatttatcaaaatgctgtttattcaataacattcactcctccaaggatactactcactgtcccttgacattcattcattaaatatttattgttcatgtactgctatggacagacataattttgggtgcttatattagtgaacaaaataatgaatacatctgccctagtggaagttacattctcttcatatattaaattctcttagtagtatacagcttccatttaaatgtttaacccagacctttcttctcaacttctagattcataaactcagctccttatcagagttttgctgcctagatcattcacaaacatttcaaactcagcatatctcactttgaaatctataatggtggtccccaaattgctcttcctcctcaatttccttccttactgtgtgcaccatctgctaagcatccaagccataaatctgttcatactagaaacctgcaagtcaaactcctcttcccctcttccccccattcttacatcctatagatttttatcctatgtatttcttatctgaccctctctcttcaatgttttctatccttcctgcgagtgcagtagttcaggttctctttctcttggaggtgtgatgactagcttctcatctgacttctcagcctctaatcttgccactgttaaattctgctcctcaaattcctccattattgtgttcttgacagcatgcaaattgaatcgtgtcatttgtttcaagagttttcattgactttacttataggttaatttcaactttctttatatggtatagaagcccacacatttttttgttttgttttgttttagagaggatctcactctcttgcccaggctggagtgtagtggtgtgatcatagctcactgcagcctccacctcatgggttcaaaatgtccttctgcctcagcctcccaagtagctgggactaaaggcatgtgccaccacacctggctaattgtgtgggtttttttttctttctttctttagagatggaggactcactgtgttttctaggctggtgcccacacattttaatgcctttcagagcattccctttttttttctttttttttttttttggtgcttcctaatcccatgcccctatcacatcagacttaatctattttctataatgtcttccttcacccactcctacaaatctgaattttttttttccttcagtgagtctgatcttagttacatgtgagaaatgtagtcctactaaatcagaaatggactatactacctcttagaataacatctcttgaaagggatcccctatagctttaaggggcctgctggttttttgttaacatgggtgaattgtatagtggtaaaatctgagattttagtgcacccatcacctagtaatgtaggttataactacatattgtagtagttacaatatattgttttttgtccctcactcccctctcactctgccctcttctgagtctccagtgtctgttatactactctgtatgcctttgcatacccatagcttagctcccacttataagtgagaacatagggtatttggttttacattcctgagtcacttcacttagaataatggtcttcatttccaaggacacctttgttgttgttgttgttgttgttgttgttgttgttgttgcgacggagtctcgctctgtcgcccaggctggagtgcagtggcgcgatctcggctcactgcaacctccacctcctgggttcaaacgattcttctgcctcagcctccctagtagctgggactacaggtgcccgccaccacacctggctaatttttgtatttttagtagagacagggtttcaccatgttggccaggatggtcttgatttcctgacctcgtgatccacctgcctcggcctcccaaagtgctgggattacaggcttgagccaccatgcccagccccaaggacacatttttaaactaagaaaatgttcagtttgttagaatttaatgtggcatagggaaaggaaaatgaattttagaggaccagtcttttacaaaagattactgcaaattttggtggtttcgttcaaaaacgtaaaaaagatcaatttcttttttcataatggtagttgctggacccttgtattggtgtggccattggagattacagaagccttttgttactggaaataattttcaggcctcagagttgtaagtcaagaattgcctatactgaaccctttggagtcttttcattgttacgaggtaactttgcttatgtgtgaattaatgcttaggctttcaaagcaagaaaaactagacatgatatgaactttgtcattctgctaagttaatactgaaatgaaaacttttactgatacaaagacatttctgttaccagtaaattgtgtagactttgtgaggattttgagatgtgatttatattggcttattttttaaaaagctggcttaaaaagtgaccacaagtgtgctaaaaggtttatttgaggtaaccacagtattatagttcccctggcataattattccgtattttgtttccatgagtcaaggcacaaagcaaggataatcataatgattgtaggaaacagcgcttagagctgggatcctaggattttaatactaggatcttttacttgttgcagcttccacattcctttttgaaaagctttttttaaacaatattttttagggcacaggcgaactattttagcagaatgaagcagtaatttaagaaaaatctttatattcctgtccatttccacattctttctgaaaggctactcttgggggtagaaatacagctgtggatgaaaagattgaggtaaggaatacttttctcttaaattcttgtagcttgggtcattaactattgtcatatatgtcgacctagttcatggcagccagaggagacaaggtataaaattgactgggttgtgattcagagggggaaacaatggaaaatatattgaacacttttacattactgagaccccttctacacttttttcctctttggttttagactgtataaagtattgtgttggtactgtagatacagcgtgtggctattgatattgatataagaaaatctgttaaggttcctctttcagcagttatggggatcttcattcagagcaataagatcatttctcctaggtgttacatgttggcagactgaagaagacaaagacgtcttgtcttcacattgttttatggccacgactttgaattcatttgatcacttaagaggtatcgcagacactgtagctaattagaaggaagggggcagttttattgtgaatatgttcagtgaagaagatagcagtgtttgtattgcacaggctgtatgaacgtgtattttgttggggagagagagactgagaatctggattcttgggttaaagtttctaccttgctgctggcactttgtccttaaccaagttattgctgctctttgaccctcagtttctgtgattgtaccagaatgcagatgttgtattcttctaacactgtgaagatgttatacatgctggagtacttaaaattccctcttccttaaaattgagaaaaaaaagtagattaaaaaaactaggaactacctggactttgataatattaatattttagataaaccagcactgaagtatgtgatacctacaaagaacaacacctcaagagtttctgctttgtggtaatgactcactttggtaaaattatgctgtgcacatggttattagactactgtagataccagtgggtacattagattgaaaaacgtaaatgaagtggtcttatgtatacaattttttgcagttgccttttgttgggaagagattaatatgagatagtgtaacttttttgtttggggtgggcgggggtgggcatgcctattggtggtgatctgaggattgtaactttagatcttttacattgaaattatagaaatttgattgttatggataattcatggtgaaggaatgtaatgaaattattattattattatttttaatgactaacccatgttcctagatgtattcatttttggcttagctctcctctcctctcctctcctgtcctctctctttctttcttttatttttttttagagagggggtcttgctttgtcactcaggttgaagtgcagtggtacaatctcactgcagtctgaacctcctggctcaagcaatcctcccgtttcagtcccctaagcagctggtactacaggtatgcaccaccatgcccggctgtttttgtattttcgggggaggcagggtttttccatgtttcccaggcttgtctcaaactcctgagctcagagaatctacctgccatggcctcccaaagtgcttggattacaggtgtaagccactgtacctggcctgcttttcagtttttcagtaagtaaattgtgaggcatatatgttgattcttctggctttggaaaatccttccctataccctatttatgtagactgaatgaaattgataagatacagtattttcttcctagactgttcaacactggcgtgaaatggttcttgtgtaggactccttgccctcttccaggtagctctctttattcagtacatgttttacatgcattctctgtgtttcaaacctgagagatgtcagaggaatataagagatggtccctattttccagggcttcacctctgggttaattactttgggacagtttaaagtaaataaactgtaaaaaaatactcttggaaaagttggtgaatgatacgtgcttaatttttcactaatctccctcgtggtttttataatgccatgtgtttttcttgggagggtttccttacagctgtatttgtgatcttgggctagaatttatgagctgccaccatgaaggtctgcctctggctttggcatcagagatggcgagttgtgtggtttgttttcttattgttaatgtgagaatttttcctaatcaaaataaatgcctatgtgtttttcctgactttcttgttggattgactaaggaagttgtgtgaattataaaaatttcttcctgaaatgaaggacaaaatttccaaagcaggatgcattgagattgtctgaagaaatgtatgtcttctggttttagtatttagacttgaagtttttttttttttttttttttttttaaccgtaataactaggaaaagtagaaaagttaaaagaaacaaaaaacatcacggtgggaaatagaaggagaaaaccagacatttatgaaaaccattctggatctcacagatgctattaagattagtaaacgttggccgagcatggtggctcacgcctgtaattccagcactttgagaggcagaggcaggcagatcacctgaggtcagaagtttgagaccagcctggccaacatggtaaaactccccatctctactaaaaaatacaaaaattagccaggcttggtggtgtgtgcctataatcccagctacttgggaggcctaggcaggagaattgcttgaacccaggaggcagtgagccgagatcacaccactgcactgtagcctgtgcaacagagcgagactctgtctttaaaaaaaaaaaaaaaaaaaaaggccgggcatggtaggtcatgcctgtaatcccagcattttgggaggctgaggcaggcagatcacctgagggcaggagtttgagaccagcctgaccattatggagaaaccccgtctctactaaaaatacaaaattagtgggcatggtggcacatgcctgtaatcccagctgcttgggaggctgaggcaggagaatctcttgaacctgggaggcagaggttgcagtgagccgagatcacgccattgcactccagcctgggcaacaagagtgaaactctgtctcaaaaaaagaaaaaagaaaaaaaaattagtaaatgttgactagtctcagggatatttgagctgcactcagtaggctactttgcatttgtaaaattctcacacatcaaattgcatcatctttggctttttgatttcatgcacgcagtctgtgaaaggctaagccaggtatgtggttacatataaacttactaccaactagcgctgtcctttttctactccttaagaggtttattggggcaataaactgttggcattattactcacctagcataagctgatcctttctttgactgtttttaaggaagatgttgttttatctgctaaaacaggtagcacgagattgacttcaccaaagcctcttctaagactttagaaatggcttaagcttcgctgctttcttagcacttttactgtataggccctggtatgtggtattgatacatacagtaagtataaatgtgagaagagaaaccacattttcatgctcttaagtgatccatgctgttttcacttctcagggtgatttttggttgtagccaactcagaaactctcaatttaatttgagattgtgtgaattgctttcctagtctgtacaccagaaagaatgcttctctccttacacatttcgacacttcttagtgaagatcatttacttatagagtgtatgcattatattagcatatggcctgggtaacttcagacttgttaacatagcgtgggaaaggttactgaaagcatgaggaggcagtatattatctctcagttgattttgtacaccattttgaatattttctgtacattccctttcctctagtgttggtttcttatacttatagtaaagggaaactgatgttgatattgttcaaaaaagaaatgaagtgaatttttgtatttttaaagaataaattaacatgctttaaagtgcttaaccagttgttacaatatcagttatcacagattggtatgcgttggtccatgttatgtatttgcctgaatcaaccctaagactggttggcttatttctgccttttcttttccaaaaggtatacttgacatgaagtagactgtgcctgtttgattttaagttttgaatatggtgggaggtatagattaaagttaatttcttttgcatatggatattcaatttttctgaaggcatttttgaaaaagctgtccattctccacctttgcattgcctttgtacttttgtaaacaatcagttgtccatgtatgtgtgagtttatttctatactctctattctgttcctttgatctatttgtctatctttatgcctatactatactgtctttattactgtagcttgctttgtagtaagttttgaagtgagataatgttacatagttttggctttttaagattcttttcactagcgtatgacttttagaatcagcttgtcaggttctataaagaatctggccaagatgttggttgagattatattgatcgtgtgatcaatttggggagaattgacagtttaaaatattgagttttcaactctcgaacaaggtctatctctctatttagatcttacttatttccttcagcaatattttgtacttttcagtatataagcctttcatatattttgtcagatttattcctatgtgtttcatatttttgatgcagtattaaatggtggtgttttttaactttagtttccagttcactatcaatatgtagaaattcactgatttttgtatattcacttgcattctgcaaccttgctaaactcacttattagttctagtagttttttttgtaggtcttactggattttctacatggatgatcatatttttagtgaatagaagcagcttatttctttcctcctaatctgggtatcttctctgtctttttcttgtctgatttctctgtcaggaacttacaggatcatgtttaatagaagagacaagactggacactcctgcccttttcctgattttagggggaaagacagaatcttttgccattaattctgagcttagctatacgtttttcatagtgccctttattaggttgagaatgttccattctaagtttgtcagaattttaatcaagaatgcatgttatattttgtcaaacaccttttttttgtctatcaagatgatcatatgatttttctttttttgtttattaatatagtaatacattgattggtttttaaatgtgaaaccaaaatgctttccttggtaaactctatttagtcatgatatattaacttctaaatagattgttggatttgatttgttaaaaatgttttaaagaatttttacacctgtgttcatgaataaaaattggtctgtagttttcttttgatctatttgtctggttttattatcagagtgatgctggcctcataggaaaggtagggaaatattcccttttcctcagtttcttagaagagtttgtgtagaattgttattatttcttttgtcttttcttttctttctttctttcttttcttttttttttttctttttttgagacagagttttgctcttgttgcccaggctgaagtgcaatggcgcaaactcagctcactgcaacctctgcttcctgggttcaagcgattctcctacctcagcctcctgagtagctgggattataggcatgcgccaccacgcccagctaattttgtatttttagtagagatgaggtttctccctgttggtcaggctggtctcaaactcctgacctcaggtgatccgtctgcctctgcctcccaaagtgctgggattacaggcatgagccaccaggcccggcctgttatttctttcttaaatgataggtagaatttgtcagtgaatccatctgggcctagagttttctttctgtggaaaggttttaaatgaaatattcatgttctttactaaatattgaactatttatgttatccatttcttcttgagtcagctttggtaatttatgtcttttcaaggaattttttcattttatcaaagttgttgaatttattggcataaaattcatataatattccttcattatccttttatatctatagaatctatggcaattctatatctgttgatagcctcctttcctcccctcttctctctctgtcatatcagtatgactgggagtttattaattttattgatcttcttgaagaacaagctttattttcattgatttttctctgttgttttatatttcattgatttccttctttctgcttactttagttttactttgcttatttttctggcttttaaaagtaggagctgagtttgttgatttaagatctttcttctcttctaatatagccttttgatgctataaatttacccccaaatattactttagcagcaccccaaatattctgatctgtggtattttcattttcattcagtttagagtactttctgatttcccttgtgacttctaattgaaacactccaaatattttaggggttttccagggatctttctagtattggtttattacattaaatcagtcaattaattaattaagagacaggatctcaccctgtcatccaggctggagtgcagtggcgtgatcatagctcattgcacccttgaattcctggtttcaagtgatcctctcatatcagcctggcttttaaaaatcttttgtagagatagtgtcttactatgttgcccagcatggtcttgaatccttgctctcaagcagttttccctccttggcctcccaaagtgttgggataacaggtatgagctactgaacctggcctggaattggtttcttatttaactccattgtgatttaagacagacaaacactttaactgggtatggtggtgcgcctatagtcccagctgcttaggagatggaggtaggaggatcacttgagctagtagctgagtttagcctgggcaacatagtgagaccttgtctctctaaaaacaaaaaacaaaacacacctagaaacaacattgcttgtatgacttgtatccttttaaatttattggcacaattttatggcccagaatatggtctttctttgtagatgttccctgagcacttgagaggaacgtaattttcttctgtagttggtaggaatgttctataaatgccagtcagcccaagttggtttatagtgttgctcagttttattatatccttacggattttttgcctgcttgttctatcaagagaggtatattgatgtctctggctataattgtggttttgtttctttgttcctattgtcctgtgctattttgaggctttgttatttggtacataaacatttagggttatgtggtattgattgattgatccctttattattatgagatgaccacctctatccctggtaatagtctttgctctgaaatctatctgtctgtctgtctgtctatctatctatctatctatctatctatctatctatctatctatctgcctgcctacctacctacctatatctgtcagtcatgtatctcactttattatctcttttaattggagtattttccattcaaatgttaggtttgagactttcatgttgccatttgttttttgttagtcgcattttttttccttaccctctttccctgcagccttgagaatgaataaagtatttaagatttcattttatgtcttttgttcccatattagctacaattattttcctcttttttttgtggttgcattagggaaatactatatatacactatatataataaagatatataaatatatataaaatatatataaagatatataagatatatagtatatataagatatatcatgtatatatagtatatacatataaagatatatataaagatatgtaagatatatagcatatataatatatagtatatatctatcatatctttatatatataaagatatataacatatatattatatatatacagtattttccctaaagcaccacgaaaaacaaggaaataaaaaattgtagctaataagggagcaaaagagataaaatgatatgttaaatactttattcgtccacaaggccgcaagaaagagggtaaggaaaaaaatgcaactaatgaaaaacaaatggcaacatgaaagtctcaaacttaacatttgaatggaaaatactccaatatatttatatatatatatatatatacatactatatatatctttaatttacagtggtctaccttcacatgatgttatatcacttcatgaataatacaagaatattatatttactcttctatttacttacatttacgcctttatagcctttatactgtcgatgacatgagttttacttttgtatttgttaaaaaggctacaaaacattgttactatttctgcttaaacagtgaattatcttttaaggatattttaaataattaaaaaaaaaatcttgtatatatccccatgttttcacaggatccttagggtgtcacttcgtcagccagaaacctctgtggccagcgttgcctctgcttcagtttttctcattcctgctgggctcattccacccactctgcccgacaggctgcgctcagcttgtgctaccaacctcggtcctacgccaagggtgagccacatgcagagtggcaaggattgtgtgagcaagtgagcgcagggtctggccactgcacacagccaggcttaacggctgctgcagtggggagggcagctccaggtgcccgcacaggtaccggccccatgtgaggctgtggctggaccagatgtaccacaagtggcttccactgtgggcaccaatgtctctggatgaggggaatgcagtggcacctgaaagtgcagagaccgccaggaaccacagagccccaaagaggggtattaccgggctacctgaagggctgcaggtcttctctccttttcattgcctgtggtggtggggtgttatcccatttgtgttacagctgtcttagtcttgccatctggcaggtcccaagttcttgtctcacatccaggaagaatgggttatgtggacaattgtagggtgatcaaggcagaaaggaactttattgagtgacagaccagctctcagtggagacctgaagtgagtagctcctatctgcaggcaggtagtcccagtgagtccctgagtctggctgagtccagggtttttatgggctcagaatttaggaagtgtgtgctgattggtccatgggcagccatgggtgggcctggaaaaagcaccattctagtggccaaaaggcatcaaggaacttctcactcggggttatggactccactcagaactggcagcccagcccacagacttcatgccatccctgccttgaaggtgggatttcactgcggacccaccctttcctgccttgggacctgtctgcctcctgccgtgatcaacatgctgtccacagtaaggctgtctgtgccaggaggcacctgcaggcctatactgagctgccctcagcagctccagcctccctcctgtgcttacacccaatgtctggaggggcctgaggtagcagggggctggtataccagcatgaccctgagtgtgcacatatgccgctaagtcataacagtgcccagattggccacaactttgctccatgctgcattaggcaccgagagagcagggagaggccagagaagcaggagcaggcacttctgagcctgcagggcttcccgagcccccaagaacacatggatgcttgggtctgtagccacatctaggcagctgcagctgcagctgcacctgggagtgtgggttcctgtcccgccaactctgtaaggtgcagggctcctgctaggatcacctgttcctggcccttgctggttctaagtgaacaggccttccccactgcagcgggtgtcctcgcagtggccaatccagacgggccaccattgccaccatcaatgtggttaccatttcttatgcccttcatttctctgggtagatcctatttacatctgagcgtttttcttttgcctgaaggccttcttttaacatttcttactgagagaatttactgatgatgaaatcattcagcttttgtatgcctgaaaacatcttcactttgcctttgttttcaaaatttttttctgggaatataattttagttggacagttactttttcttttagtaatttaaaagtgttgctctactgttttctcttagtgtttgccatgacaaaatttgtgtcactcttagtttctggtaatgtaacttgtctttttttttgactgcttttaagtgttttctctctagtgctgcttttgagcatttggttacattgtgccttaccctagtttccttcatgtttcttgtgctttaggtttgttgagcttctttgatctaggattcatcatttttatgaagtttggaaattttgggttattatttctttaaggttttttccccttctcttctgctttaccttttcagggactccaattaaccagatactagatagtttgaactcttcctagagtttcctgtgctactttgatttttcttcattcttttttctctttgcatttcagtttggatagttgctgtgtctcaggttcaccagtcttttcttctgctatgtcaaatctgttgttagtcctattcaatgtgtttttcatctccgacagcagtttcatttctaaagatttggttacagtgtttttaaaaatacttacaagtctctatttaactgtttgaacttttggaatacaggtacaatgattgtttcagtgtccttgtttgcaattaacctcagtgccacttctgggttgttttcactttattgattattctactcattatgggtcatgcttttctgcctcattgtgtaactggtgatctttggatgccagacattgtgaattttaccttgttggatgctaggtattttggtatttctataagtcgccttgagctttgttctgggatgcagtaaagttacttagaaaaactttgatcacctggagttttgttattggcatttgttaagggaaatctggaaaagagcttagtctaggccttggttattcctcattacttttgcaagacctttttgagtattcaatctaatcatctgtgaagtatgagttttttagtctctctcatgggaacaggcactgttcagagtcctgtgcgagtcccaagaaatgttctctataattcttttgggtgtttctttccccagccttgagtagcgtccccctgctttcgagccagtctgtactgtgttgcaggtgaaccctctgtagatctccagggctctctctctgtgtaattctcttctctctagtcctctatcctatgaaccccagctgccttgatgtcctcagactcaactctgtctcctcaattcatcgagttggcctggttctgccccagtttcatctcctggtattgcaccctggaaactctccagacaataaggtgggtcagttatagggctctcatttgtttcctgcatctcagagattactgtcattagttacttcatgtctggtatcttgaaaaccattgttcatatatttttctgagtattttttgttgtttcaggcaggagactgtatctagtcactgtttctccatcttgaccagaagtggttctcccatatttcatttaacaacatcatgaaatctctttcagccaagctcaagaccataatttgtccttctctgccttctcttttgacccaatgccttgttctttcagtcttgtcagttcttacttcctagtatatttgacattcttttgtacttaatggtaaaaatctttaggtaaacatcatcattattaacttacactaaaaaatagtaaaatcattggaatggagggaatattgtcagaatagttataagttttggtgccctatcccagtgccatctttaaggtgagtattcagggaatatttcttatacatcttaattcagtgtaaaatttgcatgttttatatgttgatagagcagaattatttcaggatgagtatatttgtttagatcttttaaaaaatgtatctttagggaggtttgtgcttttccagactgagccagaatgctcgtactgcattttggatttacacacacacacacacacacacacacacacacacactacttttttactttccagtttcccctgttacttggtgtgctgcttgaaaccagacttgccattcttacatctccagaacctcataccatgcctggcatagtggcactcaattaaggtctgatgatttgtactgagtaagctatagttttaggcttggagcattgttaaggctttgcatagaatctctgcattatacagaatcttaactgtctctacattacagtataatccacatctgcatctttgcagcttgctattatacatctttggtttgctgtgaaagagctgtcagagaatgagctctttattgcttagaattactagttaactattgttttgccattgatcagaatgtctcctttttctgttctgctgtattcattgtggtattttgttgtaatcagagatagtcttggaggtgcaagacttattggatctccgtttgtgccattgtcgcaacatcactgacttggtgaggatcagtcaggggtttcttccttctgtttttgtcatggcagtcttactttttgaaacatttgtcaccttctctgatcctgcctcctgcttttccccatctgcactctgacctatactgttttagaaggaaaagataataaaggtcagattttataaaactctgttcaagaaatactgcataaagggctcttcaagataaaagactaccccgcttgtcaggcagcctgctaatttgagagtgctgacgacttaccttgatgaggcaatcttcgaattgatgactctttttaattaattgtcttttcattgataaaacagaattgctttgttttccttttactgcccatctcttcctcacaaaatatgtttcctctccgaacacacaaactgtgttttcagaatctcccctgagtctggaggtctggacagtagtgtgtttgtgtgcttgtgtgtgtatatgtgtgcacacacatgcacagcttgtgtgcatggtatctgtgatttctgtgtgtgcttatatttttcactattttggattcatccagttctataaagacatacttgcttgctttgcatggttctggctccctctgcagccccaaatggaaaagtgctttgttgtcttttgttgctgaaaaatccagctctcggccttctttctttgagtagagcatcccagctggtatacaagtatagattggatttcagatttagcaatgcattgtgttttgacaaagcttattgaagatggaagtcatttttcaggagcgctctaagaggtgagaaaatggcaagggagggtggggaggaaagggagaaaatgcagaagaggcagacacaattgcaacattgatttggtaaatagaaagttaatgtagctacaggtattgacagtaaactttggctaagatattggagaattgcagattggaaggctagagctatttcagaatttccagggccattttattggattatacaccttagaaccttaacacacagcttctgttgattagtacagtttggcctccagtgtgagtttggctttgaacactcagtgtgactttggctagggcttggcacctgtggacttcagcttctactttagtaaaatgaatgagttagaacaaataattgttacattcaaatccagatttatgagtgtacgatagtggcttcacattatttgttttaagttaccgttgagaatttggttctcagtaatctagagctactattttagcagaattatacatgggatgcagaatagaagcttttaagcaacagtcaaccagattggtctataataactccaggataaatacaagaagaatttctggacacattttgccccagtgaagtaaaattatttacattcaaggatggatttggaaatgcaggtatttttctgttgatctgcacgttggttacactggtgtgttcagtgtgtaattacacttccatgcagttatttttgtttttgtgttagatttcaataaactattattttttctaacagatcttaaactttaatgcttctttagagtactaatcaaagtactgttacataagtaatggctcatgtgtgcgcacaggtgtctgctctgtgaagtagtccatttcaaattataccacattaaattgtgtctgctttaaagggttaaaataagtacatgtatatatttagatatataagatgacttctatttaatagataattagaatgtttatgtaatagatttatgctttcagagatttcatattcacaaagtaagttttggaaccttgaaacatggataggtcagtgtcatttggtttcttttttcttcgtttaatccttttcaggacttcggctccctgtgagttgttaatgtatagtgtttatgaatccaaataacattcattaactttcttggaaggtcacagttatgttggttctgttcgaaataagtactataaattttttagaataaaaaaggaaagtattacagtgagttttgctatccacttgccactttcctttcccttcctttttttgttttttgttttttgttttttggtagggagggaggtctccctgtgttgtttaggttggtctcaaactcttggcctcaagcagtcctcccacctcagcctcccaaaatgttgggattacaggtgtgagccattgcacttggccctttcccatttttgtgcttgactagtataagtgtcatttttgttttcttgaaacctttgttctttcccatgtgaatacacataggatgacaatagtcacaaaactctttccgtacttagaagactaaaaccagaaattgttgcttgaacatgtaatggataattgttaaaattctgcactggtttgtactgttctcgaatttttatgtaaaggtctagtttagagatttattatttttattgtttagacttaaaaggaaaacagttagctgcggaatctagtttttatcctggagcgaaactcatataaccttgttgattttagtgggaattagaaagttcagactctttttttagaggtctcccaaaattgtttccactctatgttgaaaggaactctaatctacagaagtggaggtgacagtaaggagggcaggggatgctcttcccaaaggagtttctacaatgcagctgagttagagtgcagtagaaagagcgagatctcatagtggcatgttcctgtcacagcatgtgtatagcagtcacagactctgaacccaaagactgtatttctagttggagcagacattgactcctttttctgggctgaaaacagtgaagtgtattggttttggtagcttgggttataagaaacctaaattagtttgaagtggaattatcctgatgaaagggcagttgaaagcccttgacactggacagaggattgtctagtgtctaatcttggctcaaaatgcaccagacataatgagagtcattatgaactgctgatctcctacccctcccctcagcagaccctattagacttgcaaaaatagcaaacactgtgtgtgtttggcatggtgcctgctgtgtagtagaggaagaaagcgtaccttgtttgcaccacaaccagatactggtgcatcatgttacagctctgcttggttctgagctcctctgttcaatctcgtcttgacagatgctgtcgttgccaccccttagcaagacaaatgcagccactctgcaggagttggcttttgcccagctgtgcttgccagggccccaaactgatgtgcgtgtgtacctgtggaaaggtaacaggctgtgggtgtgttatcctctgccattatgtgcattaccttttgagtttttgccattcccgaaggaaaagttacggttttgtttgttcagataaatctgaaccctcaatttctcttactgcttttttcacaacagatgttgttaggcacccactaaagatccccaggaagggtccctgccccatataagctcactttctctgtaggtagaaagaaatgcaaacagtcacataatcacaaccttaatagctatgtgtataaaggactctgggaaaaaaggacggaggggatctttggaggtgcatgccaggagagagttgtctcatacgagctatgaaggttaagtattgcttaggaggtgtagatatatgtgttgccagggtccaaggtgaaaaaggagaagtggtttgaaatgagcttggtgaacctaggtttgggcctggttttgaaggctactggcaatagggaatcatcatagaattttaaactaggtgagtagccttttcaaaatttttttaggaagcattattctggtttcagtctggagaataagattatataaaaagtgctgagagttggaaaagtgccagcctattatgttgggagaaggaagcatggagaggttttagatgtgaccattagttcagatagagtagtgaagggagataggacttaaccaacaggaagagaaattaaagagagtaagaaaggaaggtctaaggttttcagctaatactccccaggcatagtatttatagggaaacagggaaggtagatttcagtttggggcagactggatttaaaatacctgcggaatatgtaggtattaatgagtaaatttcagtgtgaagtttgtacccagagttgagaatagagcaggctgggcacatagggttctgggataattgatgttacaaattagagtctggtttagcggttagagccatgagaccctctaatccaagtttgatgtcccatggcagtttgatgcaggatgggaccaacattatagacctactgttacctgctaaaaaaggcatttagtatatttcactcctgagtccagaaagccatttaccaagagcatatctgaatttgtgcggcagggaataatataacaatgagttctgtgtattcacaatttaggaattaatttcacaagaccacaggttggaaattcttgtcctctaatgggattgagcctttgtggaaagagtgtcacctgtattttcctcatctcagtagatgaagtagttactgtttctttcccacattcagccaatagcatacattttgtagaaagcaactaaagtttttcctccaaagctttaggcctcttctctttcagttcctcttggtaagacctggcctgtattggtcagtctgcctgttctttctacttggcttacaccatctgcccattgggacctacagattttttttgttttgttttgttttgtttttgagacagagtctctctctgtcgcccaggctggagtgcagtggcgtgatctcggctcattgcaagctccacctcctgggttcacgccattctcctgcctcagcctcccgagtagctgggactacaggtgcccgccaccacacccggctaattttttgtatttttggtagagatggggtttcaccctgttagccaggatggtctcgatctcctgacctcgtaatccaccagcctaggcctcccaaagtgctgggattacaggcgtgagccactgtgcctggctgggacatacagatattttttggctgcttataagtttttgttctcctaggggatttctgggacacttaaatatgattatatccatcagtgaatgaacaatccatagagttgacatcagtggtaaatacagtaatgtgagagtctaaaacgtgagccaaagttccatttaaaagatctaaatgcaaattatctcactaaacttgagaattattgatcatctctgtccctttctcctttttctctcccttttctttccgtcgttcctccctctcttttccctttaccctcttctcttcctttccccgctccctgttctctcttctctttcccccttttttcttcccctccatcttactttcccttctctctcttctcatttgatataactgacagatttgagcagaactgtgaggctcttaggagctgtgtgtgatgtggagtggccagatgactttatgtgagtatgcacgagggactgtaaagaggctgtccagaggccagcctccctccaggttgttcctaaccctggagagtcatcatatgttatttctcatctcagactgccacagaattgaggagggagattgaaggcagctcattaaaccactttggccacagataagagtgttaagagattaagaagtagatttatctgggggaggggtttggtcccggatgaagccttttcctgccgtcggaaaccaaagatttccttgtctcttttgttctgatccatggaatggtgtggcttagctgcctctaaatctgttttggcaaggttgtttgtaaggagacatggcagggtctgtctggagggaacagaaaagagagtacatattgaatgtagatgcttgaaactagatcatagtttacctaattgcagaccttgaagaaactcttggggccacttggatgggggtgcttctggaagtttgtctctgggggtatgtgagtatggacctcttccacactgagaagagggcagagcccagtcatcagttttcatgtccctgagtacaatattaggcttctttttattattatcattatttcaactggtaacaatgtttcccctcaggaaatgtctttacctctctgaagagaagaccgtgatgccagctgttagtttgagaaatgctgcagggtcctctcctacctgctgtttctgtgctctttccatgtgttgtggtgaagcccctacctctccagccatggggccttgttcttcatcatttgttcctatcttcagtttgggatgtggcaaggagaggcagagtgcactagagaaatctgatactgtaatgtgctaggagacagcatgatgagaggttttgggtgggaagtccatgctaaacatcttaaatgcttcagaaacttctttacagaattctctgcctttaggattctcctgttcaataaatatatttttcaccactttagaaataatcttcttaaagcccttccttgaactcatgcatctgtaatgactgcccatgaccagcagtactacattgtggaatgcaagacctaattagtctaagcatgaaagaccttttagtttcatcagctaagcccccttgtcctcccaggcattcctctttccaggtgctgtctccttctgcagcttcccgtaggcctcttcccactgctctttctgctcttctataaaactccacatttaatgcctacaccttaccaaactccaggaaacttccttgactcttgcgggctatatggatctctacttattttagtttttgctgttgcaggaggaaagtatgatttttaaaatacaataatccttttgtatgtctacagaagaatgtggtttggtgagttttacatttgatgcatgattgtatccaccattgtgagattataaataaatctcaagacatgaccttgccctgaacccaaaactaaacatgaatgaaactatagaaataactggataacctctggtacatagagggtcggtgttacagggagataagcagtacaccctaacctagggaagtgcaatgagcagagaggggatggagtatgtaggtggagaagtggctaagtgtcttagatagacaaggtggaaccaaagtacatagagcctggaagctgcagaaaagaacgtaggctaagaaacaagatcaattataggtggttgagtaggtgagtaagacagaaatgtgtgaggtgattggaagggactgctacgataagccagctgtgcttacaatggtgaagataaggaatggtgacttgggaagatgtattggagaaaaatgatagggcctgctgactgagcagctcaagctttatgggaactgctgatcatgtttttaactgctatagatatatttgatttaagtaaatcaatttgtaaagatttagatttcataatgatatcttagaccatatttgcacagcaagtgaaacttaaatactcttgtatccctatcacatcatgttatctttaacatgtgtatcaactttcttacctataaatgctggtgacacctcccagttttctaggcttaatttgtagagggctcaacatgtgaacaatgaatttggtgcaccattcaagaagtaaaattcaatcatttttttctcctattcatttctaaggataggaatctttgccttatagaaatattttaaaggagcccccttaaatgtcacactctctttaggcttaaactattcttatttccaaaatgtaacatcagaagttcagaaattctttctacttaggttctctgtgccccacacaacctcacatttttgcctgagtctccccagtcttgctgcaggagctggggtagcttcagcccacttacatcctgccaggggataaacttgataccttttgctttcatgaaacactatctgtgtgaagtgagctctttgatccacagtcttttatgctgaagctaagggaggattaaggaacacctctgagttgatgaatatttgatgaggtttatataatttaaaattacactcttgttaaccctttcactcaatggagagagaagagaaacttgtataatcgtggttcctacttaggcataaggtactgtgtcttctctgggtgcatcctccttatctatgtagagcagagcatgggaacttagtaaatgtcaattgatgattggcattttttacagcttcatagagagaaatatctctttgcttcattataaccatactgagtgagatgctgaagtggaattgggatcacacagtatctgtgtatttgacattgcatgtataatggtgaacaaggcagatattccactcatcataacaacaacagtagtaatcataccaccaggaagcattctttcagtgcttactgtatgcaaggctctattctaaactcttttcatccattttaattcttagaacaaacttataaggtagatgctattattatcatttctattttataggtaacacaacccaggcacaaagagactaactcccacaaggtttcacaacttacaaatagcagagtcaggatttgaacctgggcaggcagttctcagagcctgcgttcctaacttctggctggacccctcatggtgagaagggcagagagttgacaaatcctctgaagtatggtgagttctgtaggagtctgcaacagggcgaattaacctagggaagaggaaggctgggaaggctttcctgagaaaatgtcttttgggatgaaacatgaaggatgagtaggtgctctctaggtgagggctcatggacaaaactattccaacatgtgtagtggccacaggctggacagaataaaataggtgatttggaggaacaacagagagaagcccattaggggtagagaaagtgagagagtgtgtgtcatggagtgatgccacaggggccaaatcatgaagtcctccgtaggtcccacttccaggatgtgggtcatggaaatataaagggctaaggacaaacggagcattcaaggggtagaaccatgggtataacatgatgagatgtaagctttaacgtgtttctcactagtgatgtgtctaagtcatagagggagacagtagaggacaagagtgcagtcaggcagctgatgctgtaatccaggtgaaggaggatggcagcctggaccaaggtagtagaggtaaggatggatagaagcttaggagcttattaggatgcagataataggagttctggatgtgggagatgagggtgagggaggaaccagtaacaatgcctatgttaacagtcagaagaaggttacaatgtaaccagactggaacatgaacaaattatctgcagtggagcttatttgctcaaaagaaggatcctgcaagagaacatggatggcttgtgtcatccaaatatggatggctttgcccagttagagaataattcctgctgagagaatacacatgcacgcaagcatgtacacacgcacacacatttgttgtagagggttataccctcccaagttaaggtaatttcataattgaggtcgaccctctcgatgtggtaccattgataagccccagcactacagttcagctaccaacactgagtttctcattgagtcaaagcgtgggatgatctgacagcgtcagcagcactgcacaacagtgggagggacggatgaatgccacatctataaggaattgccacttggattcaagaggaaaaggggtaattatccacatgggtaacaatttcagtttcatttctcccttgagctaactctattcacctcaaacgtctttcctgtctagagaaccaccaaaagtgtcattctgattaccatttgtaactaggtgttttctgcttaacatttggaactgggtggggtgagataaattccaagaagatgggaagtttttatattgcagtttatactacagcagcagctccagtctgccctacagaccttctagattttttttttttttttggctgtgtgacaggtgcctgtggagtttatattttgatatttgatcaaactttttaaacctgagcttgtagtaaccattatagtcgtcatgcttgagaatgtgtatttgctagtagtatagagttaacctcagtttatgggggcagggattactttgtgaggaattaaatgtggtgtttgaaaaactgggaagtgaagatcttctgcaacacaggagtttctaaaggaaaaacaattgggccagactggatgaactggttagattaaatgctatcttcctgactcagggttattatttttggttgcttattttatttttaattgttgaagatttattgtaccatgctttgctcaggacagtgtgtaaggtatttagggaaagacctgaaagagacaggaagcatgagcccttccatcaggcacctgaataactgatggtggacatattgagaatacgtagaaaatttgtatcttatggtcatattgcacttcagacttttcacaatgcccttgtatctctgttacttgattctagttttcttggctcagcatgcacagttgttttctttacttgtttatggtctgtctctcccacttaaatatcaggtccttgagagcagatacttgttctcagctacagcccagcacctagatcaatacctgacatattgtgggcactcagtaaatcttaggaggataaatgaacaaaaaacctatcttctgaatatcagtgataatcatataaaacaggcttggtatgctaccatttatgtacttctgattttgtgttttgacaggttttcacctaaggtttgtagtagttggttttcctcagagaagtttttgggctatttttctttttaagaaagggtgagtgatgtcattatgaagttgaagctataggactaatcatatacttgccctgcatctatggtgacttttttttctactggaaagaaagcccgctattaaataattattacttccaggtctgagggagactgtccagcatctgcaagagttttgctaggatgcagggctttgttcccccactgggctgtgattccatccatggagtaagctgcattgtggtagcaagtcatcttgacagtggcaagtatagcatatttcaactggtgatttctgcatgatttgcatgaatttctgtatgacaggagtcacaacaaaactgttacgtgacttgtgtctaaagctatcagtcagctggagctgtgaaaatcagtttgcatgtgtcaacaatttaatcttctaatatgcttgccaatagaaaactgacactagaattatttttctgtatttactgactagaaagatatggttatcaagtgcactgattgaaaaatctttaaattccagtctttaaatcgggaccatatgtgtgttctttccctagccaaatctatttgtgcattcacccacacatgtgtatacatatacacacacagtacagttacattgatatgtgtttgcgttatatatgtatgtattcacacagagcatgcatatgcctcatgcatattcatgagctttaaatgtgcttatagattaagatataaggatgttggggaagtttccctatctgttaactgagaataatactactgcctaccttccaagcaccttgtaagaattaaattagttaatataagtaaagttcttagaacaaggcctggaacatagtatgtttcctataaatattagcttttattattttagagtatgtcttcattctgtcagcttcaaatgggcttcaaaatttagcttcagaggcagtatggcaaagcctcagaattattgcataattcatttgatgaatttactgttattctaaaatgcctgcaaacaatttatatgtcatgcaggaaatattggtatttgtatttctaaatcaaagccatttattaaataccttagtcatattgattcctgttatagtaaattacttctctttctatgtcatcattatctcctagggtctatcagggagatattttcagtgaatttgtctttcattatcagactaaaactaacttcactgaaaacatcttcatttgggatttgaaagagaacaaattttccatttactaagaaaaaaataggtgtttgtgtattggtataaaaataggtatgtatgtaagtgatcaaatagaaaataatgcaaagggacatagaagaatttgggaatggaggtaacatacacctagaaaaacagtgacaagggcacatactattttgaagcaggttttagcaggtaatgatggtactcactgtgggaggaaggtgtgaatcatcagtcaaaacgagtgtacaaactggtgatatgaaatgctgcttaacagttgttttaaataattagatttttgttggggataaatagttcattccagacaaaagtactagggactctatagctcatctaacttcatagattaaaatgaaggcccagataattaaagtgaagacctcagagttagttaatggaagtgcaagtttcaaaaccaggctgcgatgtgggggagacagtgtcctccatgacagctctttaacagatggcatagaaactcgacttgtgaccttgaggggctcacttcagctctctaagaataattccagcccagagctacaccatatatagagtctgtagactattcctaataaaatggttttcttgtcttagagaagagaaactcagcacatacctactttgagtcaggtttgggcatgctcgaaaagggggcagcgtttttagatggagactgctggagtagactcagggtctctttcagcatggctgcctgtgtgatttgattcatgtgcactttaaaaacctgttttatctaagtgtaagactgtagaagacatatatatttagggtattgcattgatttttggaaaccatttgtgtagggtacagtatctttgaatttcactatagtaaccgagttacaaaatgggccactgggtctgctgggctgagaaccatcaaactgaatggtcagcaactttgttcatgcttcatctactttttcttttcaatcatttggggacagataatcttttggtcgctttttagactaactttgagattcagaggggcagtgtattcttggctaaaactttttgtacgaggcacactttcttttaaggtttgtgattttacccttacgtatcagatttcatggtatccaaatgcaaacatgtatttaacagttggtagggatgggagagtttgaggacagcaaagcagcctactttgatgaaagggtcagatagattttaggatctgcaccctttcttagcatcctaagcattttgagaagcagttgtatgtaggtaaaaacaaacaaacaaacaacttggtagttggtgtcagctgaactgctttttactgaatctctgctgtactagctgtgtggctctgaggcttacttccctagtctgcaaagtaaaggtaatgatacctgtttcacaatttaaaaaatagatttattgaaatatatttcacataccataaaattccactaatttaaaatatatagttcagtgattttagtatattcacagagatgcagccatcaccacaagcaattttagaacattttatcacccatgaaagaaatcctgaacccaaaagggccatttcctccctaacttccctaactctaggcaaccactgatctactttctgtctgtgtggattcacctgttttggacatttcatataaatggaattatataatatgttgtgttttatgactgccttcattcacttagcataatgttttcaatattcatgttgtagcatgtatcagtacttcattctcctcaccccccagctttatattaaagtataattggcaaaaaagtacatatttaagatgtataatgtgatgatttgatatatgtatatattgtgaaataattagcataatcaggttaattaaacaccttaatccaaatccattgccttgcatagttaccattttttgttgttgttgtttgtttttttgggtttttttttggtgatgggaacactaagaatctactcttctagtaaatatcaggaatacaatacaacattattaacagtaatcaccgtgactgtacattagatcttgagaaagtacttattttcacaaagtttgtaccctttgatcacatcttcccatttcccttgtccttgcccttggcaaccaccattctactctctgtttttatgagttggatttttttgttttgttttgttttcaagatgggctcttactctgtcacccaggctggagtgctgtggctcacggcagccttgacttcctgggctcaagcaatcttcccacctcagcctcctgagtagctgggattataggctcgtgcccaccatgtctggctggctgattttttattcttatttttattagtgacagggtcacactatattggttaggctggtctcaaactccaggcctcaagtgatcctctcatctctgcctcccaaagtgctgggattataggcgtgagctaccacacacagccgaatttgatttttttgaattctacatgtaaatgagatcatacagtgtttgtatttttatgtctgacttctttcacttagcatatgtcttccaggttcacccaagttgttacaaactgcagggtttccaatggtgtgtagtaaaggggatccttgtatcgtgttgataggaatataaattgggacagcattatggagaaccgtgtagaagttcctcaaaaaattaaatatagaactgccgtaggctttatcaaatctgcttctcagtatatatctaaaggaaatgtagtccatgtctcaaatagctatctgcactaccatgttcattatggcattattcataatagtcaagacgtggaaacaaccttaagtgtccattgatggatgaatggataaagaaaatgtgatgtgatacacacacacacacacacacacacacacacacacacacacacacacacacgcacgcacacagagacaccctctgttatatgtgtgtattgtattatggaatattatttagccataaataatgaagttcactaatttttattgccaaatcatactccattttatgaatatatcacattttgtttatccattcatcagttgatgggcatcatatttttgtgacagtgaaataagacgaagtatataaagtgctttatgatgtcttgaatatagaagcaacgtgtgttttgttgtttcttttcgtctggttggtagatttctggtgaattatcagccgcccctcttgccttgtgaggcaaggaaagcagtcttattgagtagaccatctgtctgccagttctctcatgttagtcctcaactcatggaaaatcctggtgggcactcgtttgatactagaattcacactgcttttttcagcagccagaagtgtttgagtgttaccagcagtgcttgttgtcgttacagatgctccgtacaaaactgtaaatgctgggtttaaagggattgagggagggagccattgcggcttacacagatgtcaactaatctagtgttgatcctcattctgaacctgagcattgacaccaatatcaagctgtggggtagttatgttgtgtgcaaggcttggagggaaatagtgctttggcagttcagtgcttgccgacttcacaaaacacagaaaattgctgagggcttatgtgacagaaagttcatgttacacatatgggcatcttggcgagaaaagccactgatcgtctcagtgtaaggatttggaatttcaaaatcctaaatgattactaaatgacaagtaaaatcttgattgagatagatcgttgctaacgtccaaagagattatctaaaagcattgatttttattttgttggctgtggaaataccgtggaattcatttattaaaagtagtatgtctaagtttctacttattttagatactgtaatataaaattataaacaaggcccaattgttgttacccactaggcagatttttttattatccaagtttctgtttcgggccatgaaacaagttaaaatcaaaactttcgctggttgccattttaaagataaatttgttatataggctttctaagcttggttgccttgctccacaaagacaaaacattaataatagcttacatgtattgagcagtgaatctgtgctaggctttgtgttaaccactgtatatttggattatctcattgatctaaggtaggtacggttgttattcccttcttataggttaggaaactgaggctcagagagattaagtaacttgcccaatgttacacagcttgtaagtggcatttctgtttaaagcttcccattttataaagttttgtgtttttaaatatgctttagaattttaagtttttactctgttattatttcgcgaagtcctatgtctacatacacatcaaagcaattctgtggttcttagggaattatttaataaatgaaatagccatagactgtaattacattatgagtggcatcttttagctgtgcccagcggtagcccagttgctaatctttatcccttgagtagtcaagtagataagaagtggataagcaagtggagtggtggccactcaagcaggcctccaccagaataattccaaataacttcacacagtgaattgcaacccactcaatccacttcactggatagcattgctcaaaagatattcttttactcttttatctaccttgttggcaagcatccccaagaggtcttatgcctgtggcctacagatcaaagatattttctcaaatactgggaactttgctgctagttagaattaagcaaataaaaacatacacctccagaatgtaagcaaactagtttaaaacactccagccattgtattacttatgctttaaaagtttccccacaaaacctcattaatcatataaatattttgacaaacagaaaggggacagagcagacttattattttccatcttgtatgaatggctagacttttcatctgtgctcttatcctaacatgtctttaactcttctgtgctaagatttttatttaaaaacaaggaaattgagactcagtgagatgaactgctttatatcactgtggtaagatgtgttaatagcatttgaaaaggaaaagccaaaattttctttcatttatttatttatttatttatttatttatttatttatttatttattttgagacagagtttcactcttgtcacccaggctggagtgcaatggcatgatcttggctcactgcaacctccacctcccgggttcaagtgattctcttgcctcagcctcccaagtagctgggactacaggcatgtgccaccacacctggctaatttttgtaatttttagtagagattgggtttcaccatgttggccaggctggtctcgagctcctgaccttaagtaatccgcctgccttggcctcccaaaatgctagaattacagacatgagccaccacgcccagcctatttcttgatttttattagtcacctagccttattgtaatttgcacttatctaccattagaacatcataaacccaagtgatgaacagaatggatgtaacttagtgcgtgtatgtaatgcatatgatgtaacatacataaagacaaatggaaaatgcctgcaagatagtttccctgttgtctcatgcctcagcagtaatgaaacatatactgagtgcttattgtgggtcagttactgtgttaaatgtttgtcacgaatcatcccatccagttctcacaatcaacctgtcatgtaggtgctatttttgtccacatttttatagataaggtggctgagacttagaaaaagctaacaccacttgcctgtggtcatagagctagcaattagcaaagccattgcttctaaccagtgtgcattttgccttgcacaataaactacattaaaagatttactttagtttttctacctcccaattgaagccactatcagatatatagtctaaacttagatttgattctgtttagaaacacttaatgttcctaatgttatcaggaaatttgctgttcattttttcaagatctgagtagaatgtcacattctccatgaactttccatgatgctcttcttccaaatgtttctgtagcacctggttgtagcctggctcttaggattcccctgtctgtgctctggacttctttagaagcaccttgtctggttcagttactgcctttgtttgtattgctggcacattcctttgtgcttggtgcatagtagataattaatagatatttgttaaattgaactggatgcttaataaatgtttggatctaattatgatcttaactctggtgtgtacttcaggtacttcaggaaggtcattgcagcattagatgactatggagaccctcagtgttttagactgagatgacttgccattcctacaagagatcaattgaatgaataattggggctgatttttccctaagtattgcttagaacatatactgttttttttctcctcaaaaattgccagttatattgccatactggacaaaataaaactgttagctatatatctatatctatacctatataaattttaaaaacgtagcacaaagtttctgcaccatactttgtgagcagctctgtgtattccaaggctcagaaaatcagactttcaaagctaaattttaccaatatatatcccattgaaatttgcatgagcaagcagaaataatgtggatgttggagttaggtaaatgaatcaaatcctggttcagccactttctaggtatgtgattttgggcaagatatttaatttttttcaacatagtttttttatttttaaaatggaaaagttatgcactggcagatttggaggatgaaataatatgttgggagacagtgtgttaagttacttctcaaaaagttctattataattataggttgctaatttttggcatattttcattttaaaacttttattctaatttcattcttaaacagtgtaagcatattcacagtagcttttctgatcaccttatacccaagcactgccacatgacttctggtccagtgttccaagtgaaggccaagtaatgtcaaggtatgctgtatacggattttctaggagtgtgaataaagaagaggaatggagccatccatggatggcaaagtcatgccgttgcaataagtactacatttacatatttagtacagatcccatcttagaaagggtggatttggtcgggtgcggtggcttacgtctgtgtgatttcagcactttgggaggctgaggtgagcagatcgcttgagcccaggagtttgagaccagccaggacaacatagcaagacctgtctctctctttctctctttttttttaaaggctccctgctcatgaggaatggggagagggaagaaagggtggatttggagaaggttatagcagtgagtatggctgtaaatttgcaaggaataactttttttatttccaacagtgattgctttagataaatattttattgtagatttcaatattgttgcaattgtatttgactcagcaaaaatagtttttataatttgtcaacagaacttctttaaaatggcttcctaagttgtttcagctaattatgaggtatggtgatctcaacctccttccaaccactggtccactcttgagtcttcaggcttttttttttgcttcaagagtagcattgtaagtttttagtcttcagagaacaggaagaattctagtttctcagttcttgttctgatcaggattgtattttcttttcgtcagtttgtgctctgaaactgcagggccaggcagagtccatgctacctgataaagcatctggaaccatggaaaactgagggtggatatgatgagcctctctaataccagagatagtggacagaagccatccgttttgcatttggcttttttgaggactcagtaaatccacacagagaattagctaaggctgtttgagaaacagcctgtgggataatgaacacttttatgctttttaaaatgaccacggggagcctcatcagaagaggcgattccaggattccaagatggcagctgggtttttcattgttcctgtgggacttgcactgtgaagtgtgattgtagctgatttttcctttcaacaggaattcattaggggtatccattagctaatgaactattgatataagaaaaaaggtcagttattttagagaggaaaaatgtggctttaactctcgattatttgtgtgttgggtccatttgaaggcttcttcccctggctcaaaatctggaaaactgatttgaaagaccttcagttttatttagaaagaaggaaaaacagattatttcagttactttatgttttgtgatttttactcgatttacctaaagagaaagtgctcagatttaaattctaggtaccttcgttgctaattattttttactgcacttttatggccattttttatttctaaggattgaacccttttttttgtagttttctctcaagggctaatatttatatttttttgcttccaaaaactgttaaagtctgaaagtgtaaatttatatttgtggtgtttactttgtcctttaaatgtttttgtgtacccatactttttgtcataaagatggaaaaatgatattaaattaaccaaatgaaagtaattaatgctgaacattcactaaattattaagatgttaatgtgattccaaatgcagatagttcatgggcagcagcatgtgtcctgggactccccctcaaaggttggcaaggtttgggcaattttgagggagggagttaattcttaagtagtaagctttttcgtttacctctactatttataagctaatatgcaggatcattgtaaattagtgaaaagtgcattccattgaactagtagttgtaatactgggttaaatatctaagttgtgtgactttgggcatgagtttctgcctctgtgggtcttatttttccctgttatcagaactgtagcattggactagatcatgtttccttgtgtgttttttggaaaatgtgacaatatactaggacctacatgaagtcacagtataaacacccaagggacacaacaggcatatcttcctgcctttcatatctattcacttgaggcttttggtaagacattaattttatacttaagcaaacatattaaagactgaaaggaactcatatatcttcatatagtgttaaagatattaacacaaaaatgaaagaaatattgtccatacagcaggccacagatagatatcccttgttttgtgatcagtcttttctgctatggagggcactttggacacatttgaggatcactgcattagatgacaggaaatgtgtttcttcctatgctcaagttgtgtagccatgacatttgaggatatttacattttgaatttccctcctccctcccctaaattagtggcatgttctagagaagggttcatgtgctttatttacataaaacctatctcaatgttgtttgataagaatctgttaagagatcttgtcctaaaaggatggcacttagtgttggaactggagaatggtggggtgtgaggagttaaagtaattccctaagcacactagacacgcctgatgcccctttcaagccagtctgcttccacgtggtgattctttctgattcccattatcactgtgtccccctcacccctgccatttagcctagattctggcagaatggaaatccacgtttctgaatttagtatgatttttttttctttccttctattctcagcaacaataagtactcttgatggcagctgctgtattaagcccaagagcttaaaagattaaagaaaccactaacagcagtaaggaggaagtttaagggcctgtttttctgaaggtttgtgttttcattctgatggttgagtagaaaattacaaacaggttgtgttcggcagctggaatgctctccaacatctggggagacccagccttctgtttatttcccattcattggaagggtggccagccagtagcagaaactgcaggcagagatactagaactctttgggtacataagccgttagaaattctttttttgtagaaatttcttcatagaaataccttgttctctattttttcataagcttgactgagcacttaacttcaggtcagttgctgaggaagaggtctgaaggtaatattagtacccccccaactactttcagctggaaacaagagttgtttgggcccttactgagttcctactttagagtcaagggctggccttcccctgcatctgtctgcatatacctcacagctgagcagataacatatttgtgcagctattcccttatgatttcctctctattagagagaggtggagcctatgacagactgcagagtgtttgctccattcttccccaccccgtagctttactgaggtatagttgataattaaagtatttacatatatttaaggtatatagcttgattatgagatatataagtatacattgtgaatattcaaaatcaaactaatcaatcactccacatagttaccgcttttctttttatagtgagaatacttagtatctaccttcttagcaaattttatttatgccacatagtgactatagttaacaatattatatactcaaacccagttattttaatttttaatttttttagagctaggatctcgctctgttgctcaggttagagtgcagtggtgctatcatagctcactgcaacctcaaactcctgggctcaagcagtcccgccatctcagcctcccaagtagttaggactacaggtatataccgccatgcctggcctaatttttatttttagagatgaagtctagctttgttgcccagactggaatgcagtggcatgatcatagctcactgtaggctcgaactcctgggcttaagtgattctcctgccttggccccccagttgctgcgagaatggtgccttgttctcaaaaccattttgtaaaaagtaatgtgctggccaaataaaacagaacgccagtttgttatttttggacagcttcattattttgtacatgggaaaagagaagttcgaagttttgccttatgcaaggtcataaagctggtcagtggcccaaccaggtttagaacctttatctttggggctatttgagaaattcaagtgatcccagttcaatcattagtggcatttgtggtcttcagtctgcactgagcaagggtttcatgtttggtgtctaatattttaggattattagagctaatctagcctttggagaagccaaatggattttgggggttgtctgtaagaacccatcatgatggctggaacagctcttaagtggaacttctacataaatcaacttgcatttgttctgtaacaccatgtgaattttcctgaatttccaagtaaatatattttgcatattgcttacaaattgcttaggctgtcttcatgaataatgaaagctgtgctgtaggaagctggatattaagaaggggtgtttttaaaaacagtatttcatttcttttgcttatattttctgtagcctcaagggtgtgttcagaggtggtagggagggagggtgctgttaaggtttctcaacacctgtgttcctttacagaccattatctcttctgctatcaaagaggacttgccagttaggtcaggatgcataaacctctggacagtgccttctcctatgcttatctttgctatatgtcttgttgtgtgtttagcttccataacaaggttctctacttctccagtttaagaagaaatcatctgttgtgctgaacctctattcatctcagtagggaaggcaccagcttcaagaggctgagaagagacccagagccagcaaatgagacatggggttttattaggggcttacatacaggggagagagtccagtggtggcagactggacaacatactggcaccgctcagtggcagagggctgggcaggaaaactgcagccgctttgcaaacagcatgcagtttatatagcattttcaattaacaccctccccttaacaactttcacctggcaacttgcatgccaacccaaagtttagggcctcaattccctgtatggcccatgttccgtggcatgggcagggggctcagatgttcctcctagacaaggaatgaatctctggattggccactgtgggactccctagctcgacacacacattcaggtgcatctgccatacagtgtcattttaagggtatgctcaagttattgctctcagaggtgtttaccctactattatcatttgacaataatacctatatgtgacgtacattgtctagtgacagtcctgatttccagtagctcccacaacaacttcataagtatcatagccccactttttaggtaaagaaagcagaggtttggggattgtgtcttccctagtcgacacaccttgacagtgtagaaccagcattcagaggcaaatctcacttaggcctggtgttctttccaacatgcctcagctgctgctttgccttctctttctcccttcacctggcattttgaccacactaattgtgctggcatctcattccagggagtatgggatgagatgccagcactagagtatggctttcaaaacattttttgtcccagctcacagttacaaatacagtttatgtcatcaagtatacatacatatgcacatgctcaaatgcacatacatacctgtgcttacatgtactcatataaaactgaaagtttaattatatatgcagtaaactctaatatttccttttctgttttacactgttaatacatactcacctgtaaccgttattactcactaaattggttttacaatcaagatcacctgcggttgaaacagtgctatagagtggaaatctttacggtgagttatgtgctctctcccctcaaccccttacgagatttttaggataatccatgggagcacgaaaaaaacggttgaaattatattttgatttatttccatcttaaggaagagattaaatgttgctgttacttaatatccgagttgacagtgcagcatcactcgggctgtgaaacagtcagtccagtgctctgtagagtgtggcaggtcctgaaggaagagtgggagttcctaaagtggcacactccttcagcctttcgttgtgtgatgtgctccagtttgtatggctcataaagcatgttagtaggttatattatttacttttggcaaagagaacaagtggttttatttttatttttcttttgagacagggtctcattccattgtccaggctgtaatgcagtggtgtgatcacaactcactgcagcctcaacctcctgggcacaggtgatcctcctacctcagccttccaagtagctggaaatataggtgtggatcaccacgcctgactaagttttttctttttgttctttctttttttttttttttttggagagacggggttttgccaggctggcctcaaactcctgctgaagcaattcgcctgccttggcccccagaagttctggtattacatgtgggagccaccgcaactggcagagagcaagtgatttttaagagtttcatcaaagaaactgtggaatgagagaacataaacacagggcaacagcaggaaaatgacagagttgacttttttgttttaatgagctccttatcaaccgcatcgctgggtacaaacagcgactatatagtcatatctagtagggagtcagacaaaaaattgaagctattttaacaagtgagaacttaggtttatatccatgattgttaatgatttaccttgtcctgaatggatgttgtaccctgagatattagctaatatcattatgttggataaaatattaaaagttgtattcattttatctttgtgtcattccttatgtttatttgtatattttatgatatatgtgatatatctgtgccttatagttacatatatattggggaatatgttagaatttttttgtactgataaagattcctaattaaaaacatttggagaccatttctattctggaggactaagtaattattaatgggtatcttggggtctagatgaagagaaggaaaaggtgaggacacaggaagggagtgaaacagggagggtgtttgtgtacaaattagataacaaccctcccaagtggattcagttccaggggcacatggtttggtgagtggcctgtgccttcgtgcaggttataaaaagtctcccctttctcctggcatagcagctctacactagggcacatggtttggcaaatgggttgtgggctggaattcagcaccctttcagcccttcatccttctgcaagtgtagcctacacaagtaagtatatgtaacagccctggtggtgaggtactgaaaataaataaataaaagggcgaaggacaggcattcatggatgtagtgagcagcaacagctagtcctcactcttttattcattcattcattccttcaccagagtatttatagaacacctgctgtgtgccagccatcttcaacagcaggagttggcaaactatagcccaccggccaatcccgacctggtatctttttttgtaaatcgggttttattggaacatacctgtaccccttggtttatgtatcttctgtggctgcttcttagctataatggcatagttgaataattatgacagagactgtatggcctgcaaaacctaaagtatttactttctggccctttactgaaaacaggcgtgaacctctactctagaatataaatcaggacttgcttctggtgccactgcatgataacttagccatggactgtttggcttctatctcatgttccctacttgcaagaaaatacttccatcagggccaagtggaggtgcagtagagcaggggcagagctaaaagcaacacagctgggcacatttacttcttaggtctctacacaaaccatgtagtgtaaggaggagacaaagggctaggagtccagagactgacactgtgtggccttctctctgggcctgtttcagatagtcactctgcaactacaagatggcactggattagtgattctcagacgtttttctgcaccaaaatcacctaaaaggctggtttaaccgactgctaggctccacctccaaggtgtctgagtcggtaggcctgaggaaggcctgagaatgtacatttttaacaagtcctcaggtaatgcaggtaggcagtatgactggattgtttttgtggttgcctgcctctttttggcattggaaaggggaaagccagagtattccttgaggaatgacatttggagagaaccaaattttagatgcttctgtgatatgtacaccagagctattctggactagattgtaaattctcacatttcacctatgcaaaaggaaatactttctggtctcctattagtaatcagttgtctcaaattttgcccgttacctctggaaattctggaccctcaagtgatcagtcttttaaggcagtgtggaagaacagcacctattatggcagttgatttttcatggtctctaccctgtccttcctaatataactgctattctttaccttcctgtttttcaaaactctcgtattgttcctgttgtgttttttctaaatattttcttggttacaataaagtgctaatatttaaagagcttttgggagcctgctggtgccagaaactattcaagttacttacagaatactctcattcagttctctcaaaaatccttggggaagttttatttttctcattttacaaatgagcagtaattacaaatttggagtcagagaagctaagtaatatgtgatctggacaatttcaatatctatgtatatcaaaaaccaagcttcctaggtctttgacctcctctccagtatccctcaccttcacctgctaagtatccattctcattttggatctcggactttgttatcacctaggattcgcccaggatttcactttctcggatcatgaccttccacatcatactgtcactgcatctcaggagtctgtttcttggaaaagctttacgtctcttatcctttttcttttccaacagaaatacctttctgaactatttctctctcttaaacctcttttaaaatctgcacacttcatactaaattgtattgattatgcttctagttccctagtacataataacctttggaaaaattgttttgtcttactaattgtttctatagaactctgtactgcacctggtgtatagaaggcactccataaataatggtttaactgagctagagaatatatggccagggtctgagtccgagtctgtcttgcttcacagtatggctgctatagtcaggtctgccacagctctaggcctatttttttttaatctgtctggatgaagaaggaattgtttagtaggtgatgtcatttgtgggatgctttgtctatttctgcgtatccagcatgcttttagtgatttttcattttgtcagactgcattttctcttttcaactagagttcaaacaaaataattttagataacatcctaagaacatttggaaacatgacatttcaggtctattttccctctttgccttaaaaaagtatatacagctataattactaattgctgcgctctaagtagagacagatgatacatatgtttgtgacaattttccagagggagagctaagtaaccaggctcatttttccataatgtgaatgttattcacaaactattaccataattgatgcaccaaaccactgtagagtaaataatgtgttgtgtgtgggaagcaagctagtagtcaatgaatattaaagaacaaaacctcattttaaaagagaaactgtaattaaaatcattctgaattcatgctgcacaaccagttaaaataacttggctgccatttatctgtgtaattctgtgtataaagggagtaggtatatgatttgttatatagaagtaagtatttacatgcacatttttatgaaaagacacaatatcgaacttcagaatcagtcgttttccaaaaacatttgttggagagatgaacatgcagagttaatcagtgaaatatatattgacaggaaagatcaccatttccgttatcttatcttttgcttttctaggtgttttatgtctacctggaatgtcgtgtccctttccgtggacctaatcagcttctgtattttctccaaagcttccttttcatcagaagttgttcttgtccacttttaatccctcttactgctttctaggtgctcatcaacttctgtgtgtggtatattgatttgcacttttgggatttgttgttttataagaggaggtcataagtcatttcttgtgtgtatcattagtcttctcaacgagactgcctaggatttcagtctcagattattctatgtgtgtgttgggcgtgtatgtatgtgtatcattccttccggtgtaccttgtggagaatggtttgctgtccatgtgttcgctaactcctcagtatgtattgttggttacctgttttcatgcaccagatactgcattatttttgtaaaatctttacattttgtgtttggctaccagtgtctccacagagtcttgaatgtaactggtaaggatcagatctgttggtgtagagtttttgatggaacactcaatcagcaatctgtagtatggcttatgtaaaatgtataactccctctatctctgataagttctgaagtctaaggggaaagtgcttccctgtctcttgaatttgagtgttttgggtgagtccattttatagatagacaaggtgattgtatcagagcttacttttatattttaaaatggatcatagtgtacctattcttaggaaccttttaggaaaatctctttaacattgatcctgttgttagttgtaatctcagtatattctgataatttcctttgaatatgtaactgttcctttcatactgtgggcatctgttgtcttctctttttatagcaatgaaagtatgaacagattccaatgtgggttcttagctcaaaattctctggctctaatgtcaggccaatttatttagctagtttatacaactggacatatttctataatagaaaaatgactaaatgtttcttaacatattgtttacagagatagagcccatgttgtaaggctatgtaactcttcctctcaaaagaagattattggttttagcatgttttcctccctttaatttaatcttaagcaggtgaacctttttgagggctttttggaaagctctgaggaaaaaaaataagaaaactcatacaacctcaaggaattctaagtatcaaggagcacctctgtgaaggtgattggttcaagcattgaacactattttctatccttccacacatggcagggcattattcatgtatccagctctgtgatagcttgtttttgcttgccctgatgatacgtatggcaagggaggaatattatccaggagtggacactgtagagaggggaaggaaccttggaactgacctttatagaggcggttctcatcctcaactcttcttccttacaagatggcttggtatcccttgagatcattctcccaccttcaaaatcctggatgggcctcttgcctggttcccttaaggactctaaaccacttagcttggagctggtgccatttaattctgttcttggcagtgggccctggcttctttcctgctaggccctgtacctcttaggagcagagaagaggtcagatgcagataatacaggcatgatttctgcctcctgaaatgctcagatgatatgcacttctccgtccccctaaagatttaaggaagtacacatttatcatgggatgtaatgagtaggaaagagcatggggctttctttttctgctgaatagcagattgtaagatagaaacagttttgtttacaattcagctctatctttgtactttgcattgcagttgaagttatttttagctttactgttaagctaaacgtctgagttgtttcatttgcaaattctttctttgagggtcaggggaggcttttgtaaaatgttcaggtctgagagaattttgagttaggtaaaggtgagtgtgtgcatgcatgcatgtatgtgtatgtgtgtgtgtgtgtgtgcacagctcgtgcataaatgcctgtgtgcttgcttgggtagggactaggagggctgaaaaagagagagaaagtcattcttagcagaagaaaagcacgtacaaagggtggaagacgtacggtttttgacagatgaatgaatccttctaaaggttttgtaagagctgtgaccagctctgtttgctgagaaaagggaaagtccttgagcacccatcatacctcttcagactctcttaaaaagcattcagatgttctgccagaggaaatgatgtgttccaactacagctgcagtggagggttctttttgtgcagctgaagcaattcctccacatagattgtcccattttaacagtaaactgtctgtttaaaacaaaacaaaaaaggtgggtgggaaatggaaggagaaggagtttatgccaggaaatgaaaataagttgctgcagaagcctgttttggttgtggtttcagagttaaggataagttattaataataataataagagcccacttgatagtttgttatatctctgtgtgtgtttttatgaacttttaattttccagaaaacattaaagataaattagagaacacactcctgttggaggaggtgaccatcttgcagctaccaaaccatagaatctttcaccacttaacaccttccaaggaaccgggtagacttctggtgtcctctctggtcctcttcccttccttataggatgtcaggctttggacttaatcagaggataattaaggctctatcatagcaggtgaagtttctgagtggaagtctaagaagtgatgtttctataagtgtctttagctgactgagctactaagcagaggttaggaggttgtgatgtaatttaaagtgacattgtggttaccttttatcaagctcaattgtgagcctggagctatgttaactgcttcacagctatgagcctatttaattcttacaggaatcctcattttaagataggtttgattaccctccgtttacagatggggaacttgaggtagagagataagtggttagtttgcaattacacccagcatttggcatggctgggattggaaccaggggccttcagtcttcaaagctcttacatgtaaccactgagtgatgcattgtactctctcctgtaaagtagccttttctccctgctgccactggttcatttccttttccttttttaagatgctttaaaaagaacaaaaaccaataacgtacctcctaaattgaggttgatctccctccttcctatccaataagtaatgttctagactcatgcaaatattagatatttgggagaaaaaatgaatagaacatgtccctcctctctttagctctaagaaaatttgtgtgttcttattaattcctactgttccactatcctaccatattacctgatacatataatacagttacagtcttctcagggagactcttctatgcagtggcatgctggagccaggaaagcttgtaaacccagctcagacatggaccagctgtgagaccttggtgaagtcactttaccctccgggctttacttcttttatcactgtagtgtttgatccaggtcagttcgcagcctggaaggcacagccttttccaggacactaaatagggcacatgtgctacccatttgcgtgcacactatccttaggcatttgttgaagagatggttaataaaatataaactcattaaaaagcattactaaattcttacattttgtgtttctttgatcagtgaatgactgctaaaatttagtacgttatcaatggggaatttgttatctctttttgcataaaaggggtcctcggttttcgtgaagtttaaagtccctccccaggtagaatatccataaagcctatgaatgagtcttaactacttgattacccagattctagctttttggaatctttcattaccttacttttttcccttctcggtgagcttttggacttaggacaaacggggaacgatcacaaggaaatggattgacatctctactctttcacaatctttcctgaagacatgatttttttttgctatcatgtctctaagtacagttggtcagttgtcactctgtcaccttaccttccaaccccataattcctgtgaaaccctggacacctcactctttttgcagaccatgagctcctctggcctcactcctttccttgtccagcttgcagtacttgagtaatcccctcacccctcaccaccttccttattagtacccccagttccctgaagctcttgtcctgcccatttcctcccagcagcatgtcactcatctgccctcatgagcctgtgttccccttacaagaatcacatctctatctgtactgttattatagatcagtgaacttcaacatctgatagctttttcagtgttgcccatcagtgcatttaccgagttgctttttctatccttttggtgatagttccaaatgctccccactgtccccacggctataatgataggaaacattaatacaaaacttggttgtgttggagaaagtgtgctaagaactttacatgcattgtctcatctccgttcttgctaaaggatctaacttttccttccaaccatccagcaactactagcgaggcatcaactgtgtctatgcatggtgccaagccacagactgtagctatgattgatgcagattgggtgcttgctctcaagagacctctaattcagagggagatgcacagaagtaaacaggcagcaataacattgtccgataagtgctaatgaggggagaagttcaatacgctatagatgcccccaacccagacttagggttgaggataaggaaaacttgcaggaagttacagctcagtgccaatctaaaggacgagagactatgagggaggaacataagggcattctggacaaaaagaatacctggctgctggaaagatttcagggaattgagaggggccagtaggaacagagccattcttctcagagaaattagaggtcttatttttggtgtgaattccatagactctcttttctacctcctctgtgatctgtatcctcacttggttactaactggaattagaatcccctgcaatccttcactgtatgcagatctcgtaagacacactttctgtcaatctcagtgtgaagttttactatgcacttgtatagctgctccactgaaatactattagactgttaaggtgagtgtagaggacaatgcttcttcaaaattattacagggaagtttataataatggtgactgacttgaggtaggggtagggtttttcaggagggtctttcagtggtaatcacgcctaaaattttgaatgcttaaatgaagctgctgcttagctcaatgataagtaatagcagcttctttttccatgaggacatttattaaatgatgttttaggtctcagcaaatgttacgccttcagacaccttggctcaggaaagcctgatgtgcctccagtgaaggatttgtaggtccacatcttcgatgcttctgcaacacagagttagggaaatgaaacagtgggtcatacatgctcctgatccattgccaacagcaaagggacttgagcccccacataccttttgacccttctggtcatgataaagccacccactagctataatgctatagtcagcagtagaaataagagggagcacaaagcaactgaatggtaaaatatttcagacctttttggaccactttggaagatggaagctgataacatcatacatccaaattcctctgcattgctgtctctctctttacaggtggggaatagtttacagcaatcagtagaatctacttttgattccaaatgggtcttaattattttgtatttgggaaatattttttacttggcaatagagatgtgccataatattatttaatattttggaaatcactgtttcccatgtgcctgaacatctcgagcacatttaccctgagcgtggcagtgcctgggtgtctcacatccatgtatgctcaaaccatgctccttgatttcacccctttctctctgtttctttcatctcgtaaactgagtgctgatgccatttcacactttttcttggaagtttaatgagttagtagtagtataacaaaaataaaaatattttctttacgtttctgaaaagaaatatgtctataaagcgtcaatcatttttccaagctgttagttcctgctgctgagtactaggagctgttctgtcagcaagaccacgtaagggggaatagtaagagaaagctgtcccaattttctttctctggtacaaaaggttagaagatgttgtttcagctggagaacttaagatggattcttattcactatttgctaaagagactggactgtttttagtgtgataattttctgtaggcgtggagaaaggtcacctcctgatcttgttttggagatcatggggttaaatctgtggcagtgtccttttcctagacacagcctcttgtcaaaataatgtttggccaggtgttaatctgtgtcctgaggggagtgctggaattcattattcatcccgtgggagtaggggtcagaggagaaggttgtccttctgggaggtaccaggggacatagcctgcctcctgcctttactgacatgtgccatttgtgaggagggcagttgaagtccatttgaggaattctcttgtcagccggccaacacagaaacacagagggagtgggagggagggagaggcaggcagcttggcaaggcagtcctggagtgcagtttccggagcaagatcacacacagtgttttaggagctcagggaaggtgtgcaggaacataaaggggaagggggccaggtttgaaagagtggatttttcctattttttccaccttttattcctcctgtctttgaatacttgtcatcctttggaaaactcagcatcggaaagaagcctttgctgacacactgctttttctccagcgctatattgtgggttttttgtttttgctcttttcatttttcttttcctctgagggcaggaggtgagacaatgatcaagtcaagctggttctatgttaagttcaagtatgcagagaaggtaagtcaatatggtttcttttcccaggggaaacctgccacctccctccagtcttgtcatgttgatgggctcctctggccacttggggaagtgaatgaagctgagaagttgtatttgtgaatgtatttcctttggcttaatgatccttggatgaagcacaagctctttgcttgcaatctgacgttgccgctgaccaagtggaagcaatcttcagactctgttccggaggcatgatttagagtttaaagaggggaaataatgaaactacaataacaggaaaggcaggatattctgctttagattgaatagagaattttcaaggtattatttgttacaaaggtagatatatttttggttctgaaacaaattgacagtcacttcctattacctgttggcttagaatttttttcctctttcagttaactaactgcttactcatttgtagtcttacttggttgtagaaagaatccccataaggttgtctgaccatatatgagatgatctctttactgtctgtcaggggattatattttatgaatgaattttggttgtacctaaaattttgatgttaaacagttccactgtattttaacataccatttctggacttttaggggaaaagtgtactttctaatacatcttcacttaccggggctgtttgacatctttttggttccacatccatatgtgtcacttactctgttgggaatttacaggattagaaatgaggtttccaggagaggatatagctcagaggtagagcattggactgcagatcaagaaatgagatttccaggaggatcctaacgtgtgcctcccttttgaaatcttccctccttgatttgattgttgaaaacgttggcatattgattgtagagttaagctgaggctctatagaatggaactgtgatgtggcaagatggaaaattgtgcgactgtctttatactccttatgattatatgcataagcacattaaatatgcctcttccattcacctagtttaaaaaaaaagttagaacattttcaactcctttttactgcattttttttttctgtgtggacttgtttctgctgtgtttttaagacagcaaaattactctttctttacccatgttgaaattacaggatttttatttaaaatatccattttttattttaaactcacttgcattgttaactattaaagctattataagtaaaatattatctattcatgcacaggattgggaaagattgtggtttgggatttttttttctcagtagattactttcctttgagaagccgaccatccattgtttgctgttatgaattttgataactgaaaactgtactctgccttcttatgctttcccttttatcttgaatgttctgtcatgggaacctgaaactcaagagttaaggcacgtaaataaactaatgtgaaaaggggaaaagcatttccagaaatgattgtcataaaaagaaaaagaaggagaacgttaagttaattgcttcatttgaattaccatgctgctattcctttagcaaccaaacaagcagagaatgcttccatatggcaaggcacaagtgtaatgtaaagctaagtaatgtaaggctctatacctaattgaaggatattcgtcttgattttatgaggatagaagaaaaagagaaatctcattcttgttcttggcatggttatggtgctcaagatctcagtgattctctgcagaacttttgttctttcacaatgattcaatttaaaaattttcattggagatttttgttttccaaaactcatcaagatggattgagttttaacctagagagataataagtcttagtgtaaacacagggacagcattgataacaaaacaaactaaaaccatcttttttgtattcctctaaaaagccattcttacaaaggctttttgatttggaatttccctcactatctttaaaaggacaaaaaaagaaattcctctcttgattgtcaactactgaccattttgatttgatataagcttgtaattgttggaaagatatttctgctgtgatgtttgtccaaaactataagaaaatacatcacacaatctcttcaatatccatctcctagtttatcatttaggaagatgatttaatcagtcttcagtagtgagaaagaaaaattaagaatggcaagtaacgcatgaccaaaaacattggcataagagaatactgttcacttgtgatcactggaatcatgatccctttcaaaaattaaaatatataataaaacaaacactgtttttttaaccaccaccacactaacacacatgttcctctgtaagaatttccatctaaattatttatgagttgtctctttcttgaattagattggtgcctagctatctttctttctaaaagagtgcttacttcaattaatttcatcctataccccctttctctttttattctacatattctccctgagcaatttcctttttggtgtgtttttctatgtcctataagtgatgattccaaaagctctatatctagcataatatctttcttgagtttctgaggtatatatttaattggttaggtagatatctgtcctgaagttcaacagattcctcaaatgcagcatttctaaagtatagttaatttcttcttccttaaccaaggattttcttcctcttacatctcctagcacagctaaggcatccctatccagccagtcatctttgttcccaaaggagctgttttagttctgttcttatcatctcccttctggcttattagaggagcctcctaatcgatctccctgccacattcatggtgcttccagtgctccaaaaccctgctagaggtatcttaaaaggtcagtctgagtctgttttgctgcttgttaatggttcccctctcccatctaagcattctcactacatctccctcaacagtgctagcccttgaccttgtatatacataatacaccttattgtaatttcttattcacctgcgtcttctatagtaacatatgatcctagagatacagaattacattgtgtttttgattttgatttttctatccagaatccctgcacgtaatagatatttattccctgttgggtgttgtggctcatccttataatcccagcactttgggaggccaaggcgggagaatcccttgatcccaggagttcaagacaaacctgagcaacatagcaagacctcattatctgcaaaattaaaaattaaaaaattagctggtgtggtagcgtgtgtctgtggtctcagctacttgggaggctgaggtgggaggttcacctgagcctgggaggtcgaggctgcagtgggctatgatcccaccactgcactttagcttgggcgacagagcaagaccctgtctcaaaaaaccatttttcccccctaaatgctactgagtaaatctgtgactttttcccaggagtctggccgacctgagtttgaattctgcttctgccatttactggtagtatatgaccttgggcaatatattgaaactcaattgaattgttttctcatctattaaatgaggagtattatcacctaatgtatttttcagttaaacttcttattttgagataatggtagtacgtaataatagtacaatatgcagttttaagaaataaaatgtaaagatcccatatgccctttacctagtttcctcaatggtaacatattgtaaaaccatagtaaaatatcacaacaaggatattgacatcagtacagtgaaaatacagaacaaccacatcaccaaaagtctctctcctgatggcctttgatagccatgcctctttccttctaccttcacaacccccatcattaactcctgatatgcaatcacttttctccatttttataattttgtcgtctcaagaatgttatataaatggaatcatacaggatgcagctttttggaattttctgtttttactcagcataatgttttagagattcgttcaagttgtatgctattagtttctgagtagtattctatggtatgggtgtaccatagtttatttaatcattcttctgttgatggacatctgagttgttttcctagaagtactatgaacatttgtttataggttttgttgtgaacataagttttcttttctctaggataattgtccaagagtgcagttgctgggtagtatgtatagtatttgcgtggttaatttttaagaagccaccaaactgtcttcctggctgactctactattgcatattctctttagtgcactgtattagcgattccgtttacttgcgcattcaccagcatgcaatgatgttggtggtgtttctggttttttattttagccattctattggtgtgtactgatggtgtccagtgatgggttttaatttgcgtttccctaatggctaataatgttgaacatcttttcatttgcttatttgtcatttgagtatcttcttttgttaaatgtctcttgctctttaaatgtcttttgcccattttctaattggatttaaaaatttttactgttgagtttttcacagttcctaatattttctagacagtaagtctttattgggtatgtggtttgcacatattttcttctaatttatagcttgtctattcatcctctttcagagtcttcctcagagtagaagttttaaactttgatgcagtccagtgtatggatcctttcctttatattcttgcttttattgtcaagtcttaaaactctttgcttatcctttgatcctgaagatttttcttttccttttttcctaaaagctttatatttcatatttaagtccatgatccattttgagataaattttttataagatatgaaacttaggtcaaagtttttctttgtgtgtgtgtgcgtgcatgtgtgtgtgtgtgtgtgtgtgtgtgtgtgcacgttcctgtatatgtccagttgttttagcaccacttatggaaaagactattctttctccattaaattgttcttgtacctttgtccaaaatcagtttactgtacttaaatgggtctgttttgggtttctctattcctcaattgatttaatgtctgttcctctaccaagatcaaaaagtcttgattactgtagctattctttttcaaaattgcttaagataaaatagtacctgtgttttttcatataaattttataataacctcatctgtgtttacagaaaatctttccggtgttttgataagaattgtgttaaaccaggatattggttttgggaattttttttttaagtactttgttgagtctttctcttcatgaagaggtttgtctctccgtttatttagatcttgtttgatctcttttatcattttgtagttttcagcatacaagtcctatatgaattagatttataactatcacttttggggggcacttgaaatggtattgtatttctaatttagattttacatgcatattgttagtatacagaatacaacttattttcaaatgttgttttttgtatcctgtaaccttgataaatggagttattagtttgaggaacttatttgtagttctttgaaattttctgtatagacaattatgtcatttgcaaatgaggacagatttatttcttcctatctgatatctatgctttttaaatttccttttcttggctaattgcactgagtagaacttctcatgcggtgtgaactaagagtggtgagagtgaatatccttgtcttgttcctgatatttggggaaaaatgcattcagtcttttgctgtttagtacaatgttagctgtaggatttttctctatgttctttatcaaattgaagtagttcctttctattcctagttttctgagattttttttatcatgaatggatgtagaattttgccaaatgctttttctgtgttaattgatataattattaggtttttcttttatagcctattaatacggtagagtacattgcttgattttcagatattgaaccattcttgcaagcctggaaaaagttctatttagtcaatgtgtataattctttgtatgtatcgctcaattttatttacttatattttgttaaggacttttgcatctgtacttacgagaaatactggtctgtaattttctttttgtaatggttttattatgaggatattactggctccataaaatgatttaaaagtgttcactccttatttgtttgctggaagagattatgtataattggttttcattcttctttaaacattgtgtggaattctgtagtggaaacccatctgggtctggaaacgtcttttttagatattgttaatttaagaaattaaattttcttaatttaagttattgggctacttaaattactgtttttcatatttggtgggttctggtagtttttctttgtaaggaagtggtccacttcatctaagttgtcaaatttaagtgtgcagaactgttgatagtattctttattgacttcttgatgtctgtatagttatattccttgtttcatccctgatattgataataatgtctgtgtcttttttctgtgtcagtcatactagatgtttgtcaattttattgatttttttcaaagaacaagttttgtgttccattgatttttctctcttgttttcctgttttcaacttatttttttctattctgttatcttaattatttcttccatctgcaagctagaaaaccaggaaagctggagagtgtagttcagtctgactctgaaggcctgagaatgaggggtccagtggcgtaaatctcttttcaagactgaaggcctgagaaccacaagggctgatgttccatctccaagggcaggagatttggatgtcccagctcaaacagagagtaaatttctccttcctctgcctttttgttctgtttgggtctcaatggattgaatgaggtccacgtgcccaaatagggcatcttctttaataagtctaccaattcaaatgctattctcttccagaaacatactcacagacataccaaaaaataatgttttaccagctctttaagttgacacataaatttaacaatcacatgtatctttttttaatttttgctgcctatattgttttatttaaagagagtttcttatggatagcatagagttgattcatttttacaagttactgtatcattgctctttcttctgtcctagtgacttaagatcctttcttttagctatttttttttaaaaatagaacttcctttagccattcttttagggtagttctcccagtaactatttatttatttatttatttttatatgaggttgtcttgattacctgttgcttactgaggaatgtttgcacttgatgtagaattttggttgacagtttcttttgtctttttctttctttcttttctttttctttcaagccattgaaaaatgttgttctctttcttctggccttcagggtttctcatgagacatccactatccttcttttgtctagatgtcatgacttctttctccctggctgcttccagatttttttgctatctttagcaaagtttaactatgatgtgtcttggtgtgggtatctttgagcttattctgttttgtattatcatagctttttgaatctgtaggtgttgtttttgccaaatttgagaattttcacccatcatttcttcatgtacttttaaagccctattttccttttcctctctctctgggactctgaagacacaattgttagatctttggttataatcccacagatacctgatactctgttttttgttgttgttttgtttgtttgttttgtttttcagtctctttttttctcttttgtttagatgagtaattttagttgttctttcagttcactgattctttactctcctccacctggtcttgagcccatccgttgaatttttttaattgttttttttttatttttatttttttgaggtggagtctgctcggtcccccaggctggagtacagtggcatgatctcggctcactgcaacctctgcctcctgggttcaagcaattctcgggtctcagcctcccaagtagctgggattacatgcgtgcgctaccatgcccagctaatttttgtatttttagtagagacagggtttcaccatgttggccaggctggtcttgaactcctgacctcaggtgatccgcccaccaaagtgctctgattacaggcttgaaccatctcgcccagctgatttttaaaaaaaatgcattttactctggtaaagatgtatttaatgaaatttaccatgttaacggttattaagtatacagttcaatactgttaaatatattcacattgctgtgaaacacatatccagaagttttccatcttgcaaatctgaaactctttacccattgaacaactccattttccttgctcctctcagcccctggtagccaccagtctactttctgtttctctgaatttgactactgtggataccttatgaatatggaatatacagtatttatctttttggcactggcttatttcacttcataatatcctcaagtttcatccatgttgtagcatgtgacaagattccttcctttctaaggctatataatattccattgtatgaatatacggcatactgtttgtccattcatccattggacatttgagttgcttccacctcttggctattgtgaatagtgatgctataagaccctgcttttagttctttttggtatgtatgtagaagtgggattgttggatcatatggtagttctgtgttaaattttttgaggaacctccatagtgttttctatagcagttgcaccattttacaatcccaccattagtgcacaagtgttctaatttctccacatcctcttcaatacttgttctctgtttttcttgatagtagcaatctcaatagatctgaggggataatgcatttctctaatgattagtgatgttgagaatctttgttggctacctgtgtattatctttggagaaatttctattcaaactttttttcattttttaatcagttatttgtttttcattgtttggttgcagaagttctttacatattctggattttaaccttttttcgggcatatggtttggaaacattttttcccattccataggtttctttttcactctgttgattgtgtcctttgatgaacaaaagtttttaagtttgatgtagttccatctgtctgtttttgcttttgttacctgtgcttttgttgtcacatccaagaaagattgtcaaatccaatgtcatgaagcttttcctcaatgttttcttctagcagttttgtgattttatacttttatgtcttacatttaggtctttatccatgttgagttaatttttgtatatggtgtaaagggtccagttttattcttttgcatgtgagcgtccagttttcccacaccatttgttgaataaactatctttctccattgaacggctttgacacctttgtcaaagattgtttaaccatgtatgtgaaggtttatttctgggcttgatattatattccattggtctgtttatctgtcttcgtgccagtaccacactgttttggttaccacagttttgtaatatattttgaaatcagaaagtttaagtcctttaactttgttctttttctaaattgtttggtgatttggagtcctttgagattacatatgaattttaggatgcatttttctatttctgctaaaattgccattgggattttgatagagattgtatttatggatcatttgtggtactatggacattttaacaacagtaggtataacaatattaaagcccatggtcaaccacaaacatggaatgcctttccatttatttgtagctcttttatttcagcagtgttttgtattttgggagcagtgttggaagtctggactccagtacttgtctttacagtttccctcttttctgattctttggctaaagacaacaaacttttctaggggcttgttttggtatgtgtcattgacattactgggtttctgttttttcaactccaaatctgatgacatcatatatcatatcggatatatgagacctataaaatgaaaactcctggagaactcaccaccatgtcatttttgggggcccccaggttttaagccagtacgtcatcttcttttcacttttcagagtctgtttatatttattttatgtataatgttgagggattttagttgtacttagtgtggataatagggaaaagtatgtctactccattttcttggaagcagaagttccctaagatgcttttaaaacagtggttaaataacataatgttgagagtatttgcatggtgcaaggcctgagtgctcaatagagggtgataattgccttttattatcttcatctttctcctatttgaagtatcagtcacactttgctatagaggcagctccagtttaagtttaccttgctttagataaattgtattatcactaacacatacatttgcatcttcataccctttattgcaattccatcaagatgtagattccagaaacaacattgtcttttcagtatttttctttttccaggcaattttgacaatgcatttttgtaataagactggaattactaattctggttttattgaaaaactgttagccatttcagccagaagaagatcatggaggaaacaataaattttcttcatgagctattcaatccaacgagatactgaattaagtgcaggaaatcagtacactttttgtttgataagaagtgttcctctgaaaaaccattcttagatcattataaatattattggttggatgcagtggctcatgcctgtaatcccagcactttgggaggccaaggcaggatgattgcttgagctcaggagtttgacaccagcctaggcaacatggtgaaaccctgtctttataaaaaataaaaaaataaaaatttagctgggtgtagtggtatgtgtctatggtcccagctaattgggaggctaaagtgggaggatctcatgagctcaggagattgaggctgcaatgagccatgattgcacctctgtattccagcctggacggacagggcaagaccctgtctgtctcaaagaaacaacacacacacacacacacacacacacacacacacacacacacgcacacacgcacacacacacgcacacacacccattaccagtcttcctgggaattttattctatatctgtctataagtttaaagttatgtactctagcttagcctttaacttcagagttaatttgaaatttatttaaaaactatttttggaaatttacataatcatgatgactgcatgtaaactgttagtaatattttatagagtttccttgggttttctgttagaatgaagtaataaatttgtgtcagaaaactatttgggaaatttagaagaaatttaagctaaggaacataagctgtggagcatggccctaagaatccttttattctcatttgataaacagtagaatccagacagggaagaaccttattttctctgcctttgctagttggtggaggaaaacttgctgtttgagacaagtaggacttgatctttctatcctgtacttttttcatcatcctcaaagagggcttatttcagtggatagaccattcatagttttgacagctcaaataacccttaaggatgagcaacaactgaaaagttccaagggctttatttccaatggaaggatttcaattacagtcattttttcaagttagtacaaggaggtaaatggaatcacagtttcaaatgttaaatttgaagactacaccattaccagtgtattttggaaataaaagatgcagccaatctaaatcaaagacatgattccagattacctcataagagtatgaggaagactacaggcagcaattgagccacttgatatggaagagtatgcagtgcatcaaatgtgactttcattaagccgtgttacccttgtttgctactgagggcaggaggcatccttttcaacagcctgtaatagcttcttgttgaaaggctgcctgctatacagatgcagcagcagagagagaaaagagggatacagattcacatattcgccttgttttttaaatgccatttttgccatttttggagttggtttccagtgcttagaatagctgtaagtatatagtagttatttactgtatgtttttgtgtgagtaagtaagagaaggaattaatgaattaggctttataaactggaagtttttgttgtgcacacattaagctaagcttctatcccttctcttctccacatggtaccaccagacttttccccacttcaccccctcatctaccattttttgttttgtgtttttgtttgtttgttttttgagatggagtctctcactctgtcgcccaggctggaatgcagtgatgccactgggttccagtgatcctccagcctcagcctcctgagcagctgggattacaggcacctgccaccatgcccagctaattacatcaaccttttaaaacttatttttctctctagaatttgtttgtgtgcacttaaagagtaagtgggaggatctcaagacagtacagaaagagttggacatctagttcagttttgcagagggagtgcagagaaacttccttggagttatataattgatttttggaacctcatttgtaggatagttgtgtggagaaaggcattcaaattgcattcactgtacttcttaggccaaggtagatctggttatgtacatacttgttatttggtagaatactgcttatgttggcattatcttttccatactacatttatgaactggaaacagttaaagcttgaaactgttaaaaaaaaaaagtgtacgcttacattgtatgtattagaagtcatatgattacacatcctcatcctctcaccagtcctttcatgtagagcagcggtttgcatctttggctatacattggaactaccttgggaattaaaaaaaaaattgatgtccaagtatcaactctggagattctgattcagttgatctgggatgaagccttggcgtcaatttttttaaaaagatccccaggagtttacaatgtgcagtgagggctcgttttagaatggtatattgatttgtgttccaattgttctttcttgcataaatcacatctgtaattcattgaccacagttgtctatgaggcttattaaaaatggtataacaacttacacatacatgaataattggaatgcagaatcattttaacttccctttcccagtctttctatagtcagtttgtatttaattcaacaattgttttttgagaggcccacatttattaaatgtttatcttgtccagcttaatttctctagaaacaaaatctcaccttcattttgtacttatcactggtttacatgtggtaaataaaattagcagaaacaggtttgggtatggtccactgtggtacacgggtgtcttatagagatgagtattcattggctatgaaatgttcagtaagttttacaaaggaaacgaagatcatcagttgatctagctggtcagttggggtcagttaaaagagcattattgtaaaagatttgtggtttgcctgattttagatcagttaacattcacccatgagaaggtaggatgtatgtcatttttattttataagtgaatatgtaactgtatttttttattttgtatttaaatttttattcaatatttcaaattaattaatttctaatgttaatacctaatatacatagatataatcaatatgatcactgttatctctagagtgaagacagtttcttgccaacaatttttatatcccattataaccatccagatgagttcattatgggctttcagtacacactatcagcgcttaagagtcttgagttcattctggtctttgattatcacatgtcttgaaatacacaccacattagatttgtaaataaattgtagaaaaatcttaagactgaaatttagatattaacaaacattatttcctcttgagatatgctaacagacatcagagcattagtaggtcactaaagagtgaagatgagtcagacccatcaaaatacatatactcgttctaccacttgatatgtacacacttcgagttggtaatttattcccagttgtttgtgacggttgcatttgtgcttatcttctcttagtttcacaagggtagctaatcatgagtttttgtctgtttttgctgaactttacctactgtcttattaatcttgtttatatcagtgtgagtttcttaaggacaaggactcgtaggcaccaacacagaaagcaattttaggaatatactgtctgaattaaatgtattaaatcagtcaacaaataggaaccttttgagaaatggtcctgaaaacatttttgtttgctttttttcctagagaggaaataaacgggtttataagctgctgagtgcaagtatcatggtctgtgccttttcttcttgactgctctgctatattctctttcagaaagctgagtagctcagcacagtgaatactaaagggaatgcattccttctctctcaggggactgaagcagtgtttaacaccactgtaaaatcctcagctgtggctttctctggtgtagaatttgtctaagaaagattaaaagaacaaggaaagctttgtgtgctgtttctctttcttttcttcacccctcctgctccaggctatcctgaggggggaaaaaaaacgtggagtattttccttggacctctggagtatgcatgttatgtatgtgtgagtcttagagaaaaataaaggcaaatgcaaggcatgcctgctagtgggagtcatcacccatgggtgaaatgaagaaaactacatgagtgcgtttgcgtttatacggccactttttccattgaatgacccaaacaagatgccagtgacaaagcattggtcctacatgtgataaaacagcggcctggccatttgcttaattggtggagaactcaggtgtgttactcttggcagaggtgaaagccttcatagagaattagaaggggtataatttgggcactgtactcagaatctttcttggtatattgtttaagagcttcattgcagtgactgccattcagcaagaaataagagatgacttttaaatatttggccagattttatagtggcaaggacagagttttagagctgaagagccatttagttcaatcccatcaatctgcaaatgtgaacagtaagcccagaatcacatttagtgttagtggccagaagggagaccttggctatgaacatttaccctaccggaaactaatggcgtaaccagatttgaaccttttcttccattctgtactaggttgtcttttctttgttaggaaaagcctattataaacggaacattgacatgaattttaatttttgcatattttcttacaacatttgcccttactgcattttataactaattgtatatacttttatattttcctttttgtactcatgattctaatgtttctatgtggcatttctcacaatctctgtggggttttattataatttgctaaattattcccttgtttgggggcatttatataaactttttttttttttgccatgaaagagaaagccacagcaaacaatgtatatatgtagctctttattctctcaagttattgtttttgttctcatcatctgagttattgggggtgacttcattacagcagtggaaaacacatggtaacctgccagcatcagaaggtgtcgctttgtactgtgtgtgtgtgtgtgtgtgaaggttatgtgggtatgactgtgtaggaaagaaaaaaagtgctactctttgtagatcaaacaattgatgagtcttaatgtaggattacgtgttgcctgttaaattgctatttctgctgagaaagataaaggcatttttattagtgtagttgattagctttattaatgttggacaaaatcaatgttatgaaaatgaaatctatagttttggggtaaaataaaatttaataggtaggtgacccattcatacacttatgtgaagtaatttttgaaatgataacatgcatgaaaatttactatctatactaaatgtatattcaaagatattcttcctctagggttctagttataaacccttataaacccttataaaatactatgattcacatatacaacttataaaatactgtgattcatcagacagctctagtttcattttatctattgactctgatttaaattatcactcttttttatgcaggaatatgtggtaacaagttatatggtaagaaatttaaatgtaaagattttgacctaacgttgattcagattgtagagctgtcagttgaaaagggaaacttcatgtttagaaatttgagttctgctgggcgcagtggctcacgcttgtaatcccagcactttgggaggccaaggcgggcggatcacgaggtcaggagatcgagaccacggtgaaaccccgtctctactaaaaatacaaaaaaaattagccgggcatggtggcaggcgcctgtagtcccagctacttgggaggctgaggcaggagaatggcgtgaactcaggaggtggagcttgcagtgagccaagatcacgccactgcactccagcctgggcgacagagtgagactctgtctcaaaaaaaaaaaaaaaaaaaaattgagttctaaaatgtttgtgaaaaatttgataggttctttaataaatgtttatttccaacaaaaattttcctggtggaggagttattaggaccagtgagcatgcatttttttttaccgtcttgattgtattatcatattagcttcaagaaatgtttgtttcacgttacttatctttgtttgtcaatgaggtcagacactttcccccacgctgagaacagtatccactgcctctgaggtggatagtctctagaaatcctttccctgtcctggagcagtttgcctgaaagtgccatagttggtagcaaattcccttccactcctcttcctgcctgttaacactttctggaaacccaggtccccatgtgctttagcactctctgtaatcatttgtgggcctctgcagatgagcagtctgggagctgtggatgaggggctgggcaacttctgtcatgtgccattgctgtgagatcttttcttcaccagaatctgggggtgatttagaataatggttagttagtgacatgaagttttggaaagttttttgttgacatttttaagaagaagaaaaactgatgatgaactaaaataaagctgttctttcagccatgtctctgaaaccattgagaaggtttccaggtacattttgggcagtaaagaagatgtggactgggcattcctgtaatcccagcgctgtgggagcctgaggcaggaggatcacttgaacccaggaggtctaggccacagtgagctatggtcatgccactgcactctagcctgagcaacagaggaagactctctaaaaaaaaaaaaaaaaaaaagaaaggaaaagaaaacgtgccctgtttttctgttgttgagccttatttattttccttgctctcagcagctctgtggttccatcacttggctgccttcacggtgcctctgactagttttggaaatagaagtggtggtacaaacaacggggtggagttgcaggatacattgtggtgatatagtcttttcattctctatatttcagccaatatgatcttttcaaaacacaggttacattatagcattctcctgcttaagatcctctagggcttcttattacgctaagaataaaatccaaatacttggtcatggcctatgaagccgtatgtggctccctgcccacttccattcccactgtccatctaggtcctcaggattcccttatcaaactttcttcagttgctctaccacacatccccatgtggtgggttccattctgtactgtagctcttaactcaaacattagctctttagtgtggtcttatcttaccaaccatctaagtttgccccctttacttttttttttttttgagacagggtcttgctctgtggcccaggctgaagtacaatgaagaatatgattcactgcagcctcgagctcctcggttcaagtgatcctccagcctcggcttcccgagtagctaagactacaggcacgtgccaccatgcttagctaattcttaaaaaaagttttttttgtagagtcagggtcttactatgttgcccaggctggtcctgaacttctgggcttaagcgatcctcccgcctcgacctctcaaagtgctgggattttaggcatgagccaccgtgcccagccgctttacttatgtcttactctgttattgtttcctctgtatcttcttaataccacttataaacatctgaaattacccctttgtaaatgtatttgcttatttattattattttcttctgacttctttcattgaatgaaagtaagttccatgagagcaggaccttagggatgttattaactgttacatccccagcacctagtgctatgcctagcagtgagtaagaacattaatatttgttgaatgaatgcttgaatggccaaaacaagcccctgttatgtggcaggagctgtgctagcagtaaaaaatttagataagttgaattcagtctctgcaaacaatgttttccataatctggaattgttgtttggaattctttacagaaattcacatccaggctcacttggaaaaataatcttgctgattgtaatttttctcgttatggttgttcttggcagtaaagtcagtttccaggtgagaatgttactgctcttggccaaaggccactgtaaactttccagtattcctgagggtcttcaggccttactccttgaataagacagtgctccttgcttgaagaactaagttttctgagagtagaagggaacaatagaaagtgtacacatcagcattaccagtttattgttttctggacagttatccaaatttgcttaaggacttaattattaccagatcaaataatgttcccctcactttttagtctagtatatgctgtatgctaccctgtctgtgattctgatttcaaagtgagaaacaaattagcaagcagttgtttggtgaattttaaatgcagtggtgacccttgcccaatctttcataaaaattattttatatttaatgagttatatcttggggttccacaaatagtaggttcgatatttaggattaggtgcataatacctggagttaagctttgcagagctggaatttggactgtgtgtcttggccagaccctggaagcacaaggacaatgttgagatgaaaagattgagaatttaaaatctgtaagaatttaaagccattttacatcacaccataatttctcttcgctggattaagacatttcacagctatttataaaggagtgatttgctactataatttaattcacttgacaatcgtaggacattggatccatagttatgtcaagctagattagatgcaaaattggtaggaagacttttgtagattaaagacatatgacagtgaaatgcagaatttgagcttctattgaatcctagttcgagggaaatgctgtgaaggtcatttggggacaactggggaaatctgaaagttggactgcattagatagtattgaataaatattaaataacctcttgagtgtgttaatgatattgtaattatggaggacaatatgttccctttcttgttctttttgctttctgatagggtcttgctatatttcccaggcttttatagagcagtggtgtcatcatagctcactgcattcttgaactcctgggctcaagggtcctcctgcctcagtgtctctgtagccgggactacaggtgtgcgccactatgccctgtaaatttttttaaaatattttaatagagaccaggtcttgtgatgttgcccatgctggtctcaaatttctgtcctcaagtgatacccctgccttggcttcccaaagtgctaggattacagggatgagccaccatgtccggactttaaaaacattgttttccaatacgtcatgactattttgactatttgattggttttaaaatatctagttcattttcatgttgttccagatgaattcacttttatattgtatcagttgatgccatttcaaacttgaaaggtaaaagtagtcactgttcttcaaaccaaaatgactactaagaggtgtgcgtgtgtatgtcaggggaggtggagggaaattgtggatatgaatgaaaataatgagtgtaactttgatcacacagataatacatctacagcctttactaaagctgcctttacagtttctggcttcagagatgtggtaagtgcctcttgaaaggttgatatattacttttaacaacataaaaatgatatttgccttttttagagtctcttttttgttcactcagatttaaatgtatcatctaacagtcttctctttgtgcccatgttcttccatgagacacttagaatgtctaaaaagatgagtttggtattgttctagccttccctttgtttttaagggggactttgagtctatcaagagtgtgtgtgtcagctaagattgtatagctggctggtgcaggagctggaatttaatgttgtttttttctggcctctcagtacatcacattgtcacttaagtgagatggcaagcatttcaggtgctcttacatatatctgcaagcatggataacatttaatgccagctctcataattatgcatcacttgttgaattatttattgtacataccctactataaattgtaaactcctcaagggcaggatttttgtctgttttatgcattgcttttttttgtggtatgtagaactctgtctggaaggtgataggcactcaacaaatatttattgaatgaatgagtgaatcaaaatagaatgaactaggaatagattaatggctgctcactttgcaggatttcagggaaataattggtcagctttaacaacacatccccctctaactagctgatctaaactgaaaaattagacactggcttcctgtttaatttcccgtactcgtgggagtgataatacattaagctcacttaggtcagtgatttgacaacttagagtgaatgatttcaacaacccctttcctaggagcactttttgttgggggcagggaggacgggtggagtgctactaagttgaagaaaagtacagatggaaaggggcaggaaaaaagaaagacaaggagatgcaaagacaaactttgagcgtatcatgattttgagcaggacaactttgctggtatgtgggttaagaaatactttggaataaatggcatggtctgatctgtcaaacttgttcatggtcctgtggtcccaagaatctgtaccatgtaatttgtaactccagatagtcaagacttgaatttggtaactcttgtaattcttggtattgtgtatggatgctcatgtacagtttcaggagagtaagctgttgttcccatcttatgtgtggcttattatatcatgagttattactgtttgtcagttattcctgggtaacgctgttaagaaaatgctggcacttcaaggggtttgaggaaatgttgaggatcagatttatttaatatgtgcaaaattctagattaggtagaaagttgttgaaatcatggatctaaagtgaaaaattgagctttttagagcacctattagagatcagacaatttctagtgtagagcctgacacataagagttacgtaataaatatttggtgtgtgggatgagagggaaggagagaggaggaatgttgtgagcagctactcattgaagttgtgaatgcagccaagctgatggttccatagattgtttttctctatgttgaggctttaaatggtatccttaatttactgctacctttcagatgaatgcaactggacatcaagtagactaggggaagaagagtacatctgttttccctagagaacagggaccccccgccccgggccatggaactggtacctgtccatagcccattgggaactgggccacagagcaggaggtgagcagcaggctaacaaacattaaggcctgagctcctgtcagatcagcggcggcattagactctcataggagtgctaactctattgtgaactgtgcgtttgagggatctaggttgcctgcttccatgagaatctaatgcctgatgatctgaggtggaacaggtgcatcccaacaccatcgccctcccatccccaggtctgtgggaaaaattgtgttccatgaaaccggtgcctgatgccaaaatggttggggaccgctgacatacaagaagagtaattcaaaaaacagaaatagcaatacaaagttgcagtctgaatttgtgcatgctattttacctcttggtgcctcaatttccttatctgtaaaatagggttactaatgtatatttcattgggttttttgggtaggagtaaatgaggtaattggtaaaaaggagtttagatacagcatctactgaaatatcagccagtagaagtattttgcggtcaatttgttttgtatgtgcccagagggaagggaaatatgcttaccaattttgttcattgttaccgtctgtatagaattttgactatttgattggttttaaaatatctagttcattttcatgttgttccagatgaattcgcttttatattgtatcaggtgaggccatttcacacttgaaaggtaaaagtagtcactgttcttcaaaccaaaatgactactaagaggtgtgcgtgtgtgtttgtgtgtgtgtatgtcaggggaggtggagggaaaatgtggatacaaatgaaaatatgagtgtaactttgatcatacagataatatatctacagcctttactaaagctgcctttacatagtttctggcttcagagatgtagtaaatatccactggaatgttagctcttaaagctggtggtcatatttatataggttgggtatcccttatctgaagtgcttttgacagaagtgttttgggtttgggataattttggattttggaatatctgcattatacttataagttgagcatcccaaatatgaaatgctgcagtgagcatttctttggagtgtcatgttggtgttcaaaaactgtttggattttggagcattttggattttcgattttcagatttgtgttcctcaatctctgtggtttaaggctgagagaatagatctaatcagcagtcagtagagctcattagtagaggagagaggagagttttcttttaagaaggctatggggtcttgtgaagagacgagatagcttgtatttaattcacctgacagtcattagctagtaaaaatgaaagagagtctgggaactggaacagagagctggaaattcagctccttccaggcagatctgccttgaaattccggggaaatcagaacaggaacctcttcatttcttcatttcccttcactgcgtagtagtttattttgtgcttttggtaaaatgattcaaggtccaggagacatcctgaggtgatgcagtgtaggaaagcatttcagaaaggtaagatggaagacagatctgggcacagcaatgtgaattggacatttcgttcatcctttgggcttcctagaattagctgtgatccataggactgtcctgtccatcctggtgttctctcagaatcaggagcagctcactgtgcgaaaacccatctgaggaaaacaagaatgagctgatggtcactgtatcccaaattgacacactagttaggtagcccttgggtgtgaacttccttaaaatatttaaggaaagagactgctgttaacatactcagggaacaattatatgttgtttaccacatgacaagagaagaaataaacgttagacatatttctgggagcttagataagttgaaatatggaggaattaaatgctatatggtatgataatataaatcatttgaaagttgaaagttttgttagagctaagaaaggccttgaaaccatccgatctcaatcctgtaccttaaaaattgggaaactgaagctgaaagatgggcagtgatttctcccaaagttttgttgcaaaatacagggcttgtcttgatatcggaatactttctattctaagacattttttttgtctttaagataaccagatatgtatctgagggtagaacatacctcctctgtactatacctttgaagtttttgtttatatatatggtttgtgcatacttatgtaagtgttgccctcaaaatggaaaagattcaattaggcaagaatatcaggtgttgaagtcattttatccaagagctatgaagtctcatattagtcagttgggcatatcgtcttcatgacctttttgctagtgttcccatctgttgtatcattgctgattgtgtccatgtgagacggaaaaggagcattggactcttagcctaggaaccatataacaactataatttaaagcagatgttattaacctagcataaaagatgtgagaagtctgaagtgttagagccagagaaaaggtgagattaaactcaaatcttctgaatctaaaagccttgttccttccaaaataaagataagcatatccttctactggaaactttacagactggcaagagtaagaataaaaagagcaggtgatatatgattgattgtgccattattgatagttactgatctgttgcatagtaatggagagcttgattggatggtgatcctccctgtgtgcctcctgagtgtatttggaacatcatccaggaaggccttttaaagaagacaatacttggagaaggttttgaatgtttgaaaagaagcatgggccaggtgtagtggctcatgtccataatcccagcactttgggaagccgaggattataggagtttaccagtcctccagtgggaggatcccttgaggccaggagtttgagaccagcctgggcaacgtagcaagacttcgtctctacagaaaaatgaaaacataagccagacatggtggtgtgcgcctgtagtcccagctacttaggaggctgtggcgagaggatcgcttgagcccaggagttgaaggctgcagtaagctgtgatcgcaccactgcactccagcctgggttacaaagtgagacccatctcagaaggagaagaaaagaaatgtggtttcactagagttatggaatcaggttaaaagacagtattacctttaatgtaaattggtggcacatctctgcatcttagcctcaactcagaatattattggtttaagagtcagagagcttaggggtaaaaggctctaaaagcctctgaatttcaggaggttggtactttcagcggtctgtctccatctctcagcactacttcctctatgggcttcttgtggttcagagacaaagacgatgactgttctgcctgctcagcagtcctgggagagagcaaggctcatcgtttctgtgtccaacaacaatcttgcagcttccactttacagtcctcctttggttatgtggctattcttgactgattgactggatatatgtatagtcatcccactataccctttagtggggcgactctcatggccctctcagcattcccgaaactgctgggaccctgaggcaggtggggttaattcttcaaaagagacttcagctactgttaccaaagagtgaataaaagggctgaggtggcaaaaacaataatgggtttttgaatatatgttactaggctaggcacagtggctcataattccagcactttgggaggccaaggaggaaggattacttgagcccaggactttgaggccagcctgggcaacacagtaagaccttttaaacaaaaattagccaggtatagtggtgtgtacctgtggtaccagctacttaggaggctgaggtaggaggatcgcttgagcctgtgatgtacagtctacagtgagccgtgatcatattactgcactttagcctgggcaatagtgagaccctgtcttcctgtctctctgtctctgtctctgtctgtctgtctctctccctctctctctctgtatatatataatcccagtatgtttttatttctttctacagataggggaaggtgatctatttgaaagtctaatgcagaataaagtagtagtagttatcccctggcagagtaaaaagataagcaaaacttgggacgtcaacttacagcaagagctgtatggaagagaacagtgtggtgtgtagagagaaatcataaagctggctgctttgggccccaagaaagtctcgcttgtgatggttgtatacatggccgtgtggagcttcagatataagaaaagaattaagagatatgtattaataaggctgggcatggtgcatgtgcctgttgtcccagctacttgggaggctgagtcaggaggatcgcttgagcccagaagtttgaggttacgatgagctatgattgtaccattgcaccccagcctgggcaatagagtgagacattttttccatcagctcagtgtattaaattggttttctaagttaaaggttcacaacttcattatcgttactatgcagaattgcacttggtcctgaaatctgtctgaatttctgaataatagtttcttgtcctcaacttgtgtggtctcaggttttaaaacaaactaaggttgttactgccaatttctaaccactgttgcatttgtagtaattgagtgccagtggttggaggtttagagaaggtttaagattaactgattccaaaaatatctgtgtgtgtgtttgtgtgtgtttccatgttgtctgtgtgaatatgttagaataggaatagcatatgttttgattaggcatttttctttgttcaacatacactttggaaaacctagagaatttcagtgggattatagtatataatgactatattctgataaaatcgtggagtcttaacatttcgggtaacagattatctgctatttactggtatgttgattcgtggacagatgcttctctgtcttcaggtaggctccccaggtacactttcttgcagtcccttctaccaggtagacatgcaagaattaacaataaatgccacacatgtgtgttttctcttttttctgcttgtgagaggtgtttaaactttgtggaaatttattagaaaagatccattgtttggtagttctgatagcatcaactcgccctttatctttcatgatgcattgagacttccattactttgtagcgcctgactgctagaattgttcccagagttcaggggcttccaaatgacaatgggctgtaccgggctttgtggccttaataagccctctgttactggaattttaaatattggcatacctatcagagtctggccgtgtgtcaggagaatgttggctttagagccaccactgatggatcacatgtttttttctcaagagagcaaacaagcactttttgtttaggcttactaatgtttggcaaagaaatatagctgtaattatatatcctcgttcttgttactctctccccatctaaattttactctccctacccctaactttatataaaagcaactagggttggatctgaaataaatgtcatgaatgaataataatttctttcatttacacagtaattcaacctgttgaatgctgacttaatgctttactacactctaatttgactggaagatttggccttcgtgaatgcaaagaagaggtaaaaaatagaaattaaataccgactgactatgaaggaggacatttttcagaagggttctccctccttctatttctcatcttcttgtgtttgccccctgctttctgtgatacttaatacttaggagttgttccacaaatcattctttactttgtgtacccagcagtatcccagcagcaggattctccagggacaaggcctaggtctgccactgagggtagtctgcttccttcatcagaattgccgctgctggccttctggaccattagagttctttctggttgttatccacttttcattccttctcaacccatagaattccaggtggtgagtcagtttttctgtatgatcatgcttgacaccccaaaatctacctgaaagtttgacagatgcatggaagccaggagcattttaggaagctgtactgctcttctgagattttctgcctacttactgtctgagcattcaacctgtctctctcaaattttctctttctctaaggtgggtccagtaatgcgagtcggcagcccactttgctgttcttggaagcgaagtactttccaatagaagtcagttttaatcttctttcaccgtgaggaatgaatgaccattttaataaataattcattcctacagttcactccgtaaggagcttctaagctccctccatgatggtttctgatcctgccagggtactgctattttatctgtcaaatgtgggttgttagaggtactgtgtcataagaggcagtgcagttcggaaccctggaacccccttcataaatttgcaaaacacagtgcatggggcctgctatggcaaggtatgctacatggagcctcagctgtctgctccctctcttctgtcagcacagctagcagtcagagacaaatggctaaccctctttgagtctcttggagtaaagcctggttgtgttctgcgtggattgcatcctgtgcagattgtggatagcaagggcttccttgcaggcctgttgggagcattgattgagatcatgggtgtagaaagcctggactatagccagagtcaataattattagttctttatcttgagacaaagggaagtgttaaaatatttttatatcaaggaatctcctacaaacactgtcctccccactgcccactgccagtatttacatgaattaattttctccttatcttcttactctcgcccacccgcttccctttccttccgttccaaagttatactacacttattcaggatagaaatttcctttataaaaagttgtaaaaacttcaaagtgcctgttgtagtatatatctttaataaatactcccctgctatatttgttaaactataattatgagcatacatttcataaaaataaagcccatttactcataaactgtatgtttacatgaaaaaatacacattttataacccactccagacctactaaatctgggcgttagaatctcaatcttgggttttccaacctggctcctttttcgaaataacctggaacacttaaaaaaaaaaaaaaaaaagcaaactccaggctcaatcccagatgatttacatcagcatattttcagggttggccctgggcatcatttgtttaagcttctctggtgattataaatgtgcagccagggttgagatttaacggtctatcctaagtgcttcttaaggtctgaaactataactattaagtgagctggcttaatttatttaatctttgcagcaaccttatgaggcacagctggcattatccctattttcagatgagaaattatagaggcttggagaagtgtgaggtaataataccaagaatgagagttacttgttctcctatgtcttataatcaaatagtatatatagtattaacatctacttggggatgcaataccttttcacgtgatggtcacaatctatgtattacacattggttttggcatgaaattaaactgaccatctcaatatgccttggaaccaagtgtttgtgtgctgaatccttttgaaatatagacacctggtgtgttagtccatttgtgttcctataaacgaatacctgagactgggtaatttataaagaaaggaagtttatttggctcacagttctgcatgctatacaagcatagcaccagcatctgcttgccttctcgtgaaggcctcaggaagtgtttactaatggcagaagggaagggggatccaatgtgtcagaaggagcaagagagatgccaggctcttttaaacaaccagctctcacgtgtgaactcacagagggataactcactcattccccctggagaacaccaagccattcatgaagggcccacccccatggcccaaacacctccctatgcccagcttcaacattggttgtcatatttcaacatgagatttggagaggacaaaacatccaaatcgtattacctgcaggttgacattataaattcattttgttaaactcagtggaaatgagaatcaggttgaaactcggggtttattactgacttataaacccaggtgtgctttgaatgcattggaaagcaggagcaatttaacattctgtgatttttagaggtttggcagtgaaaccctttggtatttatttaataaatcctgccttcacagtcatggattctttttgaatacacccaatttctcctgcttcccaactcttttttcaagtgactttgttaccaggtaccgttgttgcagaggagtgatttgattattctttctctgtagaaatggtgatgatgtggggcaaatctacctcaaactgtaaactatactcactttttccacagatggggtcttgttatgttgcctaggctagacttgaattcctggacccgggtgaccctcctgcctcagcctcccaagtagctgggactacaggcacatgccaccacacacccagctatattcacattaaaaaaaaaaaatcatctgtaattctaagagctccctgtgtggagccttccaagtggcccacctgtgtgggaaagctgccctgcaatatgggcccaaaaattttccttggttttcatgtatctgagcaagttgcttaaaggtgcctggttctgtgtgtttgagattatttattccatttttactaatagtttagagaaccatgattgtgcatacatgcacctgtttgtttagtaaatatttattgagctcctaacatatgtcatgcattgttgtaagtagtattgaagttacagcatccaaaccaaatagacaaaatctctgcattcgtgaagctttatttaatggggaatatagaaaaaagtataaacacataaatcttaaaagtattttggaaggtgagggatactatttagaaaaagaaaacatgtaaagaagaaatcccccttaccatatttggggaatggtaaaatttttaataaggtggttagggtagacctcactgagaagatgacgttaagcaaatggttgctggaggtaagggtgtaagctatgtggatgtctaggaagaacactgcagacagaaagcactgccagtgtcaagttcctggagtgtttgaggctttagcgaggaggtctgagtgctatgtgatatgtttactacctacctataagagttttatggatttggagaagttttctctgcaatatgaatatatagtctcacaaatgaggataaagtttatagcaaattatcatggatttgattatgtcatggcacttgaaggaaagagagggtgggctgtgaaactcccttaaaaataacccatttttgaactcgacataaattttcagggtcctataattttcttatcaggagtgtctcacactgattgctaggtgtagaaaaatgtatgttgcctgaatctgaaggcatggattgtaggcctggttataccacagttacttgtgggactttaggaaacatgcttcatctggtcctgcttctgtttctgctatcttacaatgaagataattttccccctactttttaaacttatttgcagtgaagactagataaaaaaggatatgactaacacattaaattctgaagtaccacataaatatgacttatttttgcaaaatttaagagcacagaatgttggttatcaaagagtgtttaaaatgacctttctctgttttttgtaagtgttgtttgagagcacagtgatgaccacttaattcctttcctggagcaagacatgtttcttgtgggtttgatttgtacattatcactgaaaaacttcatcagtgacaacaacaaaaaagcccaaaaggaacctaatgaaaatagtagtgaagttttacacattacatagttacccccctgccacacacacacacaaagaacgaaaaaaagaaaagaacttggtgaaatatggtactttatattttaaaaggcctaaatcttgcttgtggaagtgggctttagaaagtttgcagcttttgagttatggagaggtggtggaagatggattatctggaactggatggaaagttgttctaccaggagtggctcataatgcacttggcaaaccgaagtagctgtggtggatgtttgaggtgtgtgcacatgtgcattttgtgtatccctacacagcttaattcgactggatgcagttttctgaattcacctgtttcttgcaggtgaaagtgcacacaaacatgcaagattcacattgtgctcaaagtgttcctgctatgtcaagcacattgaaacaaatttatgttttcaaagtaagctttataacagagctgtctgtacaggggatgattcagtccgatacagtcagggaaccgtacatagaatagaatgactagagtataatctgcaaaggatggaatggcagaagtagtcagaagaggtatgcaatggttggatcaaaaagagctttgtatccagcgtcacagggcctcaaattgtactgtaatcatatgtcttttacctgttctctggcatttaaatattcttgtaaagagctaagccattactgataaaatgtctgttgtgtacagttgtacaaattaaattcagtcacaaaactgaaagaacagcagtgggacatctatcctagtgaaagttagaatacacttttgtggtctttaataacagagttgattgtttaccttctcctttggttagaagactggtatggggattgtttggaatgaagaggtaggagagagaaataattcaattctgtattctcccatcatctttatatttgaactgagaaatgtgtgtttctatcattcattcaaattattaaacaaaaacagagatcaaaataataagaacagatgattaaagagagtcccatctgccccatatccaacctttctctcttcaacctcatttctactcagattagcagatggcaccagttttgggccatggtctctcattttctgattacaaggggttgttcttttgcccgcctcctttaaaacaacaacagaaaaattggtaatgactgactgtatgcccattggccggggcaccaattcctgaggactagacagaagcttggcattcaacccagccttctgccaggatggttctgcctggcagcaaaaagcctggttgaattaagcttgggcttttagatcctagaagtcttgtctattggtggctggaaaaatagctagtactagcagagcctaaaaatatcagagaaaaaaaagcagaggctcttagaagttgcttttcctttttgtttctttctcagacagagtctcattctgttacccaggctggagtgcagaggtgtgatctcagctcactgcagccttgacctctagggcttaagtgatctttccactttagtctctcgagtacctgggactacaggtgtgtgccaccacgcctatctaatttttgtagttttagtagagatggggaatcatcatgttgtccaggctggtctcgaacacgtgagctcaagcgattctccctccttggcctcccaaaatgctgggattacaggtgcgagacaccacacggccaagtttttttctgataaagactataaagggaaggtagggaaaggtgattattgccaatggtggttggtatagtgctgagtgatacagaatgcaggattcatgaattctaattttgcatgtgacctctctgtaaaggaaaatgaccctctaactaaatgggaaagtaaggtttcacagatgagatagaagttcaaggtgaaagaacagtctataaggtaatacctgcctgtctgcagagaatggattcaaggctcctgatgcaattgaattatagcctcattgtcatatttttttttttttttttttgagactgagtttcactctgccaccaggctggaatgcagtggcctgatctctgttcactgcaacctctgccttccaggctgaagtgattctcctgcctcagcctcctgagtagctgggattacaagcacgcaccaccacgcctggctaatttttgtatttcaagtacagatgaggtttcaccgtattggtcaggctggtctcaaactcctgacctcaggtgatctgcctaccttggcctcccaaagtgctgagattacaggcgtgagccaccacacccggccttcattgtcatctttgagttaaatgcattttggctttaataaaaacaatatgagtaaattctgaacctataatttgagtcccaatagtatttcctaacaagtgatataagtaaacactgagaaaagagtatagtgcttacagaatgacagcatgaattcagcaattcctgtttagcaagaggtctgggccaataacttggggatgtcatagacagaatgcatttggctttcagcaaaatttttggtctgctctcccataatctctttgtgaacaagtagaaaaatataggcggggtggcattatgattatcagtattcataattaattttataactttttccagtggtgattaaattttatttcactctagagatgactttctaagattatcataaataatctatccttggctctatcttatccagatttttgtcttagactaggatgaagatacaattttaaatggtaccaaaacttcttgggtcataaatatggtagatgggaggaacaggacacatatagattttaactcttttggcagtggcgaaaataagatttgctaggactaaaagtgtgattatgtttgaaaatccaactgtgaaaatagagaattgatagagatgagacttacgatttttagacgacacttacagtgagtcagcagcatgtagttagctggcaataaagctaatggtattttcaagtaccttataaaatatgttttatgtaccggactgtactttgtatttggggaagaggggatagaaacattgaaggtaagatttgcccagagtcacagatactgttaatgttcacattcttcacattttatttgtacatcactcttagtctttaaaatcaaaatacctaaatagctgtgaaaattcagtggattaaaagctactttgggaaagacagtaaaactttattcaaatagggattttcatataatgttaattttttgaaaaatcaacaattttaagaaaaaaataggatatatgaaaaactagatagttaagttgaagtttgagcatctttcaaagagtagggaagtttacatattgcatattatacatttaaaaatcagttccagacatatttttgttcattcatatatatgaatatattatatatgactatattatatatattcatatatattatatgaatatattatatatgaatatattatatatgaatatattatatatgaatatattatatatgaatatattatatatgaatatataatatattatatatgtgaatatatatattatatatgaatatattatatatgaatatatataacatatgaatatataatatgtatgaatatgttatatatgaatatattatatatgtgaatatatataacatatgaatatatataatatatatgaatatgttatatatgaatatgttatatatgaatatatataatatatatgaatatgttatatatgaatatatataatatatatgaatatgttatatatgtatatataatatatatgaatatgttatatatgtatatataatatatatgaatatgttatatatgtatatataatatatatgaatatgttatatatgaatgtgttatatatgagtatctataatatatatgaatgtgttatatatgaatatatataatatatatgaatgtgttatatatgaatatatataatatatatgaatgtgttatatatgaatatatataatatatatgaatgtgttatatatgaatatatataatatatatgaatgtgttatatatgaatatatataatatatgaatgtgttatatatgaatatataatatatgaatgtgttatatatgaatatatatataatatatgaatgtgttatatatgaatatatatattatatatgaatgtgttatatatgaatatatatattatatatgaatgtgttatatatgaatatatatattatatatgaatgtgttatatatgaatatatatattatatatgaatgtgttatatatgaatatatatattatatatgaatgtgttatatgtgaatatatatattatatatgaatgtgttatatgtgaatatatataatatatatgaatgtgttatatgtgaatatatataatatatatgaatgtgttatatgtgaatatatataatatgaatgtgttatatgtgaatatatattatatatatgaatgtgttatatgtgaatatatattatatatatgaatgtgttatatgtgaatatattatatatatgaatgtgttatatatgaatatattatatgtgactatatattatatatataatatatatatgaatatatattcatatatatattatgtatgaatatatattcatatatatattatatatatgaatatatatgtgaatatataatatattatatatatatatatataaaatgccataagccatagagattcagaactaataaaaggcaagttgcttgctcattaaaagctaataaactagaaggaactacaaaaagttttaaggttaagggatgcaaaattgattagcaaaggcagatcagaaagagtttctgactcatgcttcattggtgagaacagcaaggaagaactgggaatgagaatcattgagttttggccgacttagaggcagagtgttttaaaactgctttttggggccgggtgcagtagttcatgagctgggggaaaaaaaattacttcattttcccacctcagtttcagtttcctcatctataaaatgagataacaacagcgtggagtctacacatgaattaatgactttatttatttatttatttatttatttatttagagaccgagtttcgctctcgttgcccaggctggagtgcaatgacatggtctcggttcactgcaacttctgcctcccgggtttgagtaattctcctgcctcagcctcccaagtagctgggattacaggcacctaccaccatgcctggctaatttttgtatttttagtagagatgggatttcaccatgttggccaggctggtctcgaactcctgacctcgggtgattcactcgcctcagcttcccaaagtgccaggattagaggtgcgagccaccgcgtctgactttgaaatattttttttttaagattacacagctaaatggaattctctaggaagcacatccagctgctgaacctgtgatatttttttcttatggaacgttgattgaacagcttccatgggtgacctggtttggatttccgtagggccttgcttataatgctgaatacactgttagtttttacttttgtgtcacaaaagtaaaggttcatagttagatctaagccccttgggggacaggaactgtgttctattcatactttgaattgctagtgtctggcatgtagtagtgattaatatattttttaaaatgaatgtcaagtattatgacaggcactggtacagaaagatcaagaagaaatgacctcttcccttgtgagaggctcactattgtgatagaccaacctctgaacagaggaattaccatctagggggctgttataacaggcatgtgctgttcgagttcaggggaaagatgcacttgctcaaagagggaagtttgggaggtgtacgggaaggaggaacccacctggatcttaaaggctgagctggctgctgaagaagagaggggcacttgggcctggtcaccagctgtgcaaaatcaacaagggcaaggaagtggctgatgaagcctgaaacagggagattcccaaatgtgatctgtgacctcaaaattgaaaattttagttagtgtaattttagtatattttatgtgcatgttccaaagttttttgaaaattggttttatatgtttagcatatggggcaattctaaattagtatatttgattaacgttgtatgctagtcctttgaaattctgcagttggattgtgtatatattgtgtataatgttacctcttttccgacttcatgaacctaacatttaaagtggaaacaaatgcacgcatgtgttagtgtttagtgcagcaagaaagcacggcccaccacttccaagaagtgagtcgttgcatagggtgccccgtcctcagaacattgctcattgttcattttttattcctcagctccttagttctactcaaagtctaatattagtttaactaccaaatggcagaaaccagagtacgttgtacatttttcttgaaggatacaactggaaaaaattttgcagaggctcatgtgatgctattttccttccgtggtgacacttagaattcgtttcacattgcctttgagagaaacgaggaggggggagaagcctgtatttgatagttttgtatgttcctctaaagaaagagagtgcttgaaaaaagaaaggcaggctttcagatgttgtctgaacaaagctacggaaatgtgagacgagagcagcatctggagattttcaaacactggaacatgggctgcacgtttcttttgctgttggaggagtgaaaagctgtttcctgtcatttcccatcttgtcacttccagaaccaacatcttgctacttcttgcaccagctgctgctgctgttgttttttttaccccctccacagacagatggtaaaagagctttgataatcctcgcccaacttccccagttctaaagaagtttgcggtgtggtacctttatacaatgatcacatgccctgatacctactgtagcctgttaatagagttgggaacagagcagaaggatgtgctgcagacttttaatgtctatggcattctttgtcatgtctcatgggaaatgctgtgcacaagccccatctctgtggatgcttcgatttagcttctgaggttatatttagaaaagaggaagttgtggggagtacctttgcttccataagaatttgagatttctgatcaagatttctctgtacattgaatccaggatgggagttgctcttgatattcttgttcgtatccctaggttttcgcaaagcagaattaggcatattggatataccatcttttcacagggctgtttatccttaattactttttttacacctatttcttccaatatttttcttgcattacctagtgcaaacaggaacttagaagttaatgcagaaaatgccgtatgcataggaaagatatttgatgcagacaaccttggttttgttttaagttttattacctttattattacaaactaaaaatgataacctcaatgagggagcttagcctttctgtccccccctaaatcatggttgctttcctaagtataaaagtaacatactcattgtagaaaactttgaaagtagaaaatctattacagaaaatacaaagtcatccataattccttaataaccactcttacatttggtatatttccttgtagcttttttttagagttatgtgtgcctgtatttctcttgtatacttataaacttacattaatattgtggccattttccagaatggatctggtggtagtagtagtggtgatgataatggcataacctaaaatttattgaacatttattatgtgatagtcactatggtacgtgctttacatatattacacatttcatttctcacatcagttctataaagtaaggattatttatttttattttagacatgagaaaagtgaggctgagaaacatcaagtaattttcccaaggtcacacagtgcgcaataggtgaagctgggatttgaacccagatagtctgtcttcaaagctcatgctgtttgtcatttgctcatctatgtttaaaaggtctgaatattttttaaattattgatacatatagcctaagattttctatttattcagacttttcagtcatgagagtacttactgcgctctcaccatcttcacatatcatcaaatatgttttacctttataggtgtttggggtgaatgattgctcagtttttacattggcctttcttgattactagattgattgggcattttccatgtgttattgatcatttttatttaatctataaattgtttatgttctgtgtggctgcttttgttcaacagttaatttttttgtatacaaaatcatcatgtgttaagtatattaactctatgttgtgtttgtttaaaacatgtctccttctgttaacttgcttccttatatttgaagaaaattgtatgaatgttttaaatatgtacatattcatattttttctttataattctctcccacaaatcagttatttagcctatgttttcctttattttatggtttttactatttataacaatttttaaaatcaaatctgaaatttattttaatatatagcatgctatgagactttgaatttattttattgatgggtaatactttttgtttttgttttgctacttcctttaaaaaatattatgcattatatattccactcttctgtggtggcattctttattatatatttgtttattttgtctaccagcgtctcttcaagcaatctttctgtgtcagtggcctgtgtatgggtatgcctacagacattttatggatagtaaatttgtaaaatgtgcaagaagttttttgtcttaaaagcacccagactcagcatcagaaggcccatatccaaacctcagtataacctcatgattgacttgtgacatgaccgcatgtaggcttaaatgctgtcaggaaaattaaaggaagtaaaacgtgaattgagaaatttggagatttctgaaaattttgaaaattgagattttgctgttaatatcacagccgtatcactaaaatttccacaatcctttgaatttgtgaaatctatataaacatgatttaaagtacttatgatattgtcctttttttcatattacccaaagtatggaatttgtggcaaataaataaccaggtatatatggcccatatagatatggtttttatcctgcacttcttttgagatagctgggggctttactagagagaagaaataaaacaagataactttggcaagtatagatgaagtttgagaggtgtcttatttcattttgtgttgctataaaagaatacctgagagtggctcatggttttggaggctggaaattataagagtatggtgctggcatctggtgggggcttttttgctgcttcattccatgggagaaggtggaaaagcaagagagcatgagagcaagaggaagcagaactcactttaataacaacccactctcgcaataaccaacccaactccagtgtgaatgacgttaattcactcatgaaggcagtgaccccacgatctaatcacctcctgtttggccctacttcccaatagtgttgcattggggattcagtttccaacacacaaactttggggacatggttaaaccatagtaagagggaagtttaacatttgtttaacgttggtatcgaaaggaactatttacgttgcagccccgaaaagactacaaataatattggttaaaatagaagtgggctgtattcttttgccattgcagcaagccttagtagtgacctagattcaaaatgttactttgattttatttaaagcactgaagtattgcatttttcctcgtggttttatgcacctactaagtgcagctaccaatgacaaagatcttctataataaaaatgatgtttccttatttttgggtcttttttcaatctgaaaaatgtttctttaatcggattctcataataaccctatgcagccatataatctatggtattattatctccactttgtatatcaggaaaatgagactcatgctaaaatacttgcccaaggtcatatgacttgaaatggtgggactagcctctggcttagctctagtgagacctaaaataatactcttttggtttggtgagttccatcctttctttttttaaagaatttgcatatctaccttatccacttttaaaatgtttaaagaatttatttcaggtgcctgtccagagtgacacatgtcaaaatgttttttaaacagataagtactattcaaatacaaggctttatctttcttactgcctggggtaagatacctgtcttccctgtcccaagttatatgatgcttatttaaaaagttacctgtgagccttgcttattaaagtatgcctcagctatgtcatgaggatatttttttttaattaattttttttgagacagggtctcattctgttgcccaaactggagtgcagtagtgtggtcacagctcactgcagccctgacctcctgggctcaagtgatcctcccacctcagcctcccaagtggctagtactacagtcgtgtgccaccacatccagataactttctatttttggtagagactggggtctcactcttttgtccaagttgatctcaaactcctggtcttaagcaatcctcctgcttcggcctcccaaagtgctgggattgtcagcataaggcactacgcctggctgaggacatttttaaaggtgtatacttcaccatattctcttttcctctacatgaagtttagcaatgttcaagatggtggccactccatcccccttgatgactgagtgactgtgatgagccgagcacctgctgactcacaacagccatagagacataagagtgtgaacaagaaataagcctttgttatttttagccatggagattttgcagttgatactacagcattatgtagcctatcctgaatgaggtaggatcataataatatgtttgttatgcatcacacaagtttttgggttgtttcaatctaaagatctgaaattatacccaaactagatattctccagtatcaccaaacaggatctatccattctacagtgctcaccagattgcttctgtcatacttcacctggacatctgtggattctggatattagaaattggaaggaaaagcttgtaaggggatctcagtgcccagggtcaaagcttcattgttgggcagccaaggaagagatttgcttgacttacttgagtaatttttgacacatacttgatttggtcatcaggcataaaggatggccagattactagtaacttattggagatacacttttaaaataggagttaaggctacttatgtgttgatctgaaattaagaaaagggcaagatttctccctgtggcctgattttcaaccatgactaaataaagcctgaggggagccactgaggatggaaaaggtcactcagtcttttttgctgatgaaaaaatcgagttgtctagctctggattgacatccagcactgacatgctttaggaaacaaatcttttgatggcaaaactctcactagcctcacctctcctctcctttcctctctcctctcctctcctctcctctcctctcctctcctctcctctcctctccctcatttttcccttttctactctcccacttctaccctcatttacttatttctcaatttagctcatcagggctttttgttacaaaaaaatggtgtgtaagttacttagctgtaacttggaaactgttttcccatgaatagatgacagaattactacatgccaaattatcccagaataggtggcttaaccaattgtataattaagttactttaataattaccaagagggtcctgagccccatggaaaccttcactgcttggaggatgtataaatggaaggtgggcagcatgagtcttttggactggtggccggaacaagcagttcttagctttttttaaaatcatctttcatatttcagagcaattctttgcataatccagattgcttctgtcatccttcacttgatcatctgtggattctgagcttcagggtggccatgcgacctttcagcccttgctgtggaaggtggagctcctaccatctctgcctgtgttggggctagacgaagtttccctctgactgcctcaatcttttcactgtcatgtgtcctgggagcctcctacacagtggagaggagggagtatgagtctcaggaaccattgagttttttcactgtgaggtgggacaggcctaaatttctccccttaggcctgccattcactgagggtgtgcagtcatcatgctaagttctctttcttgctccattttcatcttcactcaccccttactttctgcaaagcgttgatggtgttgggttctgacagttaccagttggggcatttgtgatctgtggagaaggcagagatagttaatgagtaggcacatttgctaacctccttggacaggaataagttcaaaggggtggacaagcaggattggctggaggaggcaggtctccacattgttctctcttgcccctgggccctggcgtccagggtaatttttgtctgcctttgtggttcatatttttagctctctgtaagaggcccccttggtaaatatgtcagttcattgttaaacctagacatgagtttgacatctattttgtgaaacaaaccatgtaaaaatatgggtctttatggtgttcagtgttccaaagtcaggaattttttagtttcttttgtcttcacttcttgttattctctcacttgctttacttcttccagccttttccttttccacctcatctcctgcttcttatttcctcatctctttttccttaccattttttcctcttccatttctcccttgatcttttcattatattcaattcatttcattcattgaatggtgttagaagaggctttgtctttgcagtcagaaggctcaggtgaagcttcatatttcaaagcacactatgctgacactaagaaaacatcttgcccgggcacttcagttgaagaaaactatatgatgtgatcagtatgtgatgatggcttttcagatcagatagctgggttgtatttataatttatttctcttatcagtgaaaaagataaatgataatgtagtaacaggattttctagagtttgggttgtagagaaataagtgctcatgaataggaccgcatatgtgtgcatgtatgtgtgttttgggggtatggagaaagaggaggaaaagaatattttatagagaaaatttccatatggttaccttttataggatctagcacatttcaatgaaaacacactttgctggaagaattcaattctctgtaaagtttggtgcagcaaggggtgaaaatgtggggacacagctggaaacttatttgtgctgcaggcttgcagctgtacctacctgtgatgcgatgaatactatttgattgttaatgtctttctgttactgaaagcttgcttcctttcctaaagctgatggtaacaatttactgactgtctaaaccttgaggactaacttgggctgggaaaaataaatcctgtctcctgaaatttacatcttattaaaactcaaagcagccagcagagatgagaaggatctccagcctgggagctggaggtgggaattctgctcaagtcaagatcgcttttagctttcctacattctcctgtgaagaaccattggattgaatgatggtggcaaaactggtgtgacttcattcagtttatctctatcccatttcccctctccacatttgactgtcagtctactaatgagacccagttatggtccttggaaggggaaatggaaggtggacatagctgtgggggatgaaatggaggagtttttaatatcttagcttgcaaatttactgtctgccatagctgaagaccatctagtaccctctttaacttttgccactttggagtttcctctctaccgttacttattcagcaggtttttgtttttgttttttgagacggagtctctctctgtcaccaggctggagtgcagtggcgcgaactcggctcactgcaacctccgcctcccgggttcaagcgattcccctgcctcagcctcccaagtagctgggactacaggcacgtatcaccacgcccggctaatgttttgtattttagtaatgatggattttcaccatgttggccaggatggtctcgatctcctgacctcgtgatccacccacctcggcctcccaaagtgctgggattacaggcgtgagccaccgcgcccggcctcatcagttattttttaattggctgtgttttctttccctgtaaacacacttgttcagaaggaaatataatatcactataatgagcagaaggcaagtatcacatgccataagaaagtaactataaaaatgagtgtaatacaattaaaatattatgaggctctagttagatactgttccctatggaagattccgaacttgaggcctgcactcacttctgtctcaagtagaaagggagcttaaagaggcatacactttacatctaaggaagcactaagtgaggcattgttcttaactaattagacagattaaaaaggaaaggccaaaccatgccattgtcttagctcttgttttctttgattttgaagatggaaaaagagataacacttaaaaataaagcttgcctactcagacataattaaggtattgtcattcttttttgtctgtcctggttctcattgcaatattttgttcactgctcaatgagtatttattaaattaatgaagatttcaatgttaatgtctagtttcatttgcccttcctctaaaggctgtattctttttttgctcttgctctctgtgattttttggtagttctcttttatgtgcttactcacacatgagtgctttctctaacacactggtcctgtgttttgcttctttgtgtgcattcacgtagacatgcacacctcttcaaatgacacatgcctgtaggcaggataacaggttgagttgtcttgttaattaggcattctttttctggggctggtacaggatgtttgagaatactgtcccccagaatactcatctggtacactggaactgccatggactagttttccagggcttatacatacaagtggcttccaaaaaagcattttcagacaagctgcttgttatgtgaatgtgtttttctttttagtcaaccacaatatatgcagcacaaagctgttgccattttcttggaatgagaaaattatgagcataatgtttcttttacatctctgaaaaacgctaatatccagctgttgtggtggttgcagttgtcagttgctttttgtaacccgacaacactgtctcaaggatgaagagaggaaatttggtgactagtctttcctgctcactctcctgaaagtcctattaatttgcttttttaaaaacaacagccaagtatctcagttggagaaggcaaagtcttattggtccttatattctgtgcttggattagtatccacagtaaaccacacacattttgttccttgcttaacgtgagccaggtgttatactttaaagacataatctcacttagtcctcacaaaaactcagtgaatacatactatcattagcaccatttttacagatgccaaaacaaaaaattgaggttaaataattgcacaaaatctggcagccattaaatgactgagctggaatttaaaagcagatgtgtctaaattctgagcttacatttgtaaccactgtatataatgtagtataataacttccccaataattgacagagtactttactcagaggctttacaaggacaataaaagaattagttgagataacacaacccatgttgtgagaagattgtctttttgattcacagttcatgcaaagaaataatatacagcagactgtgaataatacacaaacgaaatgaaatttcattcttgaatgaattatctgtatctccttttaagaaaaattggtaaagcatttaactggtcatggctcagggaaatgtctctattctgtttctgtctgaattttattctttaaatattcactttttttttttttttagcatccagtggccacctagttgttgttgttgttgttgttgttttttccccctgtgcttatgcttgtgccttgcagggctgcatttctgcttgctgtgaattctcagttcacagctgcagttgttcaaactttaaatttaaaattcagtctatgtttctagtaattgctgctgggaaactgaaacaggactacttggtttcagagtgaggctgttgcttcatattggaagaaaggtttcattagcttggaaagcaaatctcgggatatcaagaaaacaacaaaggctgtaaattaatgcagaactcaccctaaaaagggtcaatgatgaaagaagggagaaagaagagacaggagtttcagtggtcaagggaatattttcttcatgataacagtgacctgaattggacagaaagcagaagggagtgtgtcattttaagaaggtcagtttgacagaccgcaatattccaggtttctattattatatataattgacattgttagctaagggatggattttcactatttccttctgtagtacctcagtcccttttaagtaattttttttttcctgacttcaccaccaggatcgtgtgatggtttaggaggagatttgggggatagagaggtgattctgaagataaacccactttggctgcctctgtggtctaaagccagtttggagagcgcactacagaaacagggaattcacaggggatgagtcagagagagggactggagcagtttgtcttgtttcacttgctcttatcacacagttcactcctttctgctcatacattgtgtagtccaccatggagagaaagggagaaggttgcacaatgccttgacagatttttttttttttttttgaaacggagtcttactctgtttcctgggctggagtgcagtagctcgatctcagcttactgcaacctccacctccccagctcaagcagttctcctgtctcagcctccctagtagctgggattacaggcatgtgccaccacgcctggctaatttttgtatttttagtagagacagggtttcaccatgttggccaggctggtctcgaactcctgacctcaagtgatccacctgccttggccttccaaggtgctgggattacaggcgtgagccactgtgcctggcctccttgacagactttttaatgattgtagggatagagaatggtatacaagtaaatatactactactgtttttgaactggcacagtgatgaagactaagccagtaatgctatgaaacttcaagtattaaatttctaaatatttggcattaggcaccaatctaagttacagtttaatgcttttcatcacttgtaacattaccaaatcagaggaatgaaataatatttatccaaataaaagatgtgttaacttcgccaaagtgaatgcacatttttctttgatttccccataatacatctttctttttcggggaagacagaggttgggaatgggagggagggagattattgtgaatctcagattatattgatcagaaccaagtttagcttgttctggtatgtaaattagagatttgtagttaagtgaaattgattttgctgagactaaattaatcacagtccttaatcactgtaacctttaaacattgcagtcttggccacagctgcagggcagagcagtgctcctccgagctttatgctgtcatttcatgaaaggctgaatgcccgtgacttgtgcaaacaagaattcccatgtacaggcttcagagctggttccctgccctgcaggggatcagctggagcatctcccacagggccaagaggctgctgtggcctcttcaacccaagaagatgttctgctcagacacaaatattttcagtcttcctccagacatcatcaaactagccatcactgcgaaatgctcacaggaaagtagttgttagaattaaaatcagaaacaaccagttatattgtgatagttttttctttaattgtatatgtttatgtatatttataaatatatttatatttatagatttcttttatatatttatattatatttatatatatatgttttactgatcacattttgaactatttggaagggtgatgttgacaattttgaaagatagtgaggcatggagaggttaattgactcttcagaactaatcctgagagcctagaaggagggtcaagaatagaaactgggtttggtttggttttgatggtcatttcagttctttggtttccgtttcatgaagcatcccagaatcaaaccatcattaagcctgccatagaaatgcaaattactttcccactttagttggcatatttgaaaatagttttgtgtgattttttttagccccttttgtagtctattcatgaagtttatacatgtaggactcttttttttttaacgcctttaactaccaatcctccatttttcctttaacttttctatattcgctgacttttatgttcagttgaaggaattcatacacattcagtataataaagtgcagctggatcaatcatttaaaaaaatcagtgaacatctgtatttcacaaaatcacactttatcaggactgaagggtataccaggatctaacgatcaacttcaaccactcagttttgtaaatgaagaaaccaagagtagttaggtgaaatagctttctcaaggtaatttactatagccattctgaggctgcaccctagctaatttgattcctgtttaacactcttctctatgacattgactgttttctctgtaaaagagatcccggttatacaactatttcacaatccgattccttataaaaaagcaagtagtgctcaataaatttgacttaagttgtactttataagctaatgtaaaaggagatttaccataatctgccgtggtgagttgcttatagtaggagaaagaatatcttaaaacttactttacaaaaaataacagatgctggtgaggttgctgagaaaaaggaatgcttatacaatgttggtaggaatgtaaattaattcaaccattgtgaaagacagtatgtcaatttttcaaagacctaaaaacagaaataacagtcaactcagcagttccattactgggtatatacccaaaggaatataaattgttctatcataaagatacatgtctgtgtatgttcattgcagtactactcacagtatcaaaggcatggaatcaacctaaatgcccatcaatggtagactggataaataaaatgtcatacatatataccatggaatactctgcagccacaaaaaagaatgaggtcatgtcctttgcaggaacatggataggagctgtaggctattatccttagccaattaatgcaggaacagaaaaccaaatactgcatgttcccacttttaagtggaaactaaatgatgagaacacatggttacatagaggggaacaatacacactggggccttttggagggtggaaggtgggaggatgaagaggttctggaaaaataactaatgggtactaggcttaatacctgggtgatgaaataatctatacaacaaacccccatgacacaagtttacctatgtaagagacctccacatagacccctgaacttaaaagctaaattaaaaaacaaaaacaaaaaaccaaaatacttactttaaaaacaatttctgtggttgtccttctcttttttattgtatattggtttgtgtaggtccatttaatttgtttacttttcgtagtaggaatacaattgtcagtgacatctagtagattgaacataggctctgaagctgaagcctcaggtccatctttggccctgacactagccctgttacctttgtcattttacttaacagctctctgccctaaaccataacacctaccccatagagttgttgagacagttaaataagttaatgaaaagtcaggctcttagaatagtgctgggcatatatgaatgttcattggatattatctaatattgtggtcattatcagttgatttcttcttaatttaaaaaattttcgtatgtgatttcatgtggttttagggaatgataaatgtaatttagactttttattccattgggtctgttacagcttttttctcaatgaaactgatttggttacctcagttctaatgctggctttgcctctgctttttgatcacatttagaatacagcactcagttctgggtatgtccaagatagataggggagaaaggtaaaagagaatattaatgcaacttgattgtgcagctgttctttccacaaatatttattgaatgactgctgtttgtcacatgttgatgcatagggacacggtgcacacctgagattccattcctgtagacaggacatttgcctgcttcctggcacttatacctctccccaaattgacaccaagcattattttagaaaggcatttagtagaatgcaatatcagcaaatgaaaattgtagagttgtatcttgaagaaacttgaccccaccccccactctcacctgcatccccacatagagccaggacatctcttaagacccaccttcctgggtttgctcatagttggcacttaaaacattctattgcagttacctatttttgatggactctgcaagagagagactgtcagttcacaagggcactgatgtttggttcttcattttatttacagtatgctatacaaagggataggtttttgttgttttgaatatatcttgagtactcctttggaaggatagagtccaaaggcatcttacctgagccagaattcataggggtggttccctaccgtttcttctttcctgtacacactcaccaccctcaaatttccgctcagtagaggatgctttaggaccttttttcttctttctttctttcttccttttctttttttcctttttctttttgaggtagggcctcactctgttgcccatgtagtggcacaatcatagctcactgcagccttgatctcccaggctcaagtgattctcccaccttagcctcccaagtagctaggattactggctaattttttcagttttatttttggcagagacaaggtcttgccattctgcctaggctagtcttgaactcctgagctcaagtgattctcccaccttgatctcccaaagtgttgggattataggcatgagccaccatgcccagcctagaaacttttcttttcttttcttttctttttttttgagatagagttttgagcccaggctggagtgcaatggcgtgatctcagctcaccgcaacctccgcctcctggattcaagcgattctcctgcctcagcctcccgagtagctgggattacaggcatgcgccaccacacctggctaattttgtatttttagtagagacggggtttctgtatgttggtcaggctggtctcgaactcctgacctcaggtgatccgcccgccttggcctcccaaagtgctgggattacaggcgtgagccaccatgcctggtcagaaccttttcttgactccacttaagctcttccatttgaactttcttttaattatctggattttaactttatcagaattagtctgccggtaatcctgtttttagctagaaggttaggctttgagaagtgtgaagctggatgggagggaaggaggccagcaaagggaaagggactagctgggttgaagaggccccatctgctattccagatggggcatcctgaattcatcactcctaaaactttgctctatgtgttttctaggctgcagcatccagacagcagcacacccttcacatgttcactgtagtaaaataacgtggaaagggtagaggtatctggcagataagagaggttatttcgtaaggctgtgatgcccagcacataggtctgtacatcacctccttcctgctgctcctcaatctgcctttctttggtcactgccccctgctagtatttaattctgttgaatttgttcaaattgacttgtttaagaaggttacccaaatctgcatacagccttcagcattgctttgaatctcctttaggaaaggaaatgtagattcaaatacacaggtttatctctctgacctttagctaattattagattgagataaatgtgtgtaagtgacaaattgcctttaatgacatttaatctgcatcctgacattaatgtctggtttagtgtcccagttccatagaggcaaagagcatggacttttgtcttaatttgacctatttaaaaggtgtttgtggtgagagtcaacctgtgattaacttaatagcatgttttacatgaaaagcaatcaaatattgatgtaagaagaggctactagatgacatattttccagtctgtcataattggcaaaaacatcagagaaaggagagagttgttagtaactaaaactgaatgaaagcctcatagctgccccaaatccaatactggtgagcacattgatagtatctgaagaaaggaggctcttcttgttgtttattgtcacagaggccattcactgaactttggtgggtgttagactaatagatttttttttttttttgagacagagtcttgctctgttgcccaagctggagtgctgtggtgcgatcttgcctcactgcaacctgtccctcttgggttcaagccattctcctgccttagcccccaagtagctgggattaacaggtgcacaccaccatgccaggctaatttttgtatttttagtagagaaagggttttaccatgttggccaggctggtctcaaactcctggtttcaagcagtctgcccccattggccttccagagtgcagggattacagacatgagccactgcacctggcctaaactaatagattttcacacctttttgattcactaaaggacatcataggggcttattaaataagtgagctatttttagggagtgagaggtctgggaagtggcattcttggtggatttgttgtgtgctagtcaggtgctaggtgctttgctttttgcattctcatttaactcctaactacaaaaacatttgtacaggcaaccctctaactcgtgataccatctttttgaattaaattaatttttttttttaaataaggtcttgctttctcgcccaggccggagtgcagtggcatgatcacagctcactgtaacctcaaacttctggggtcaggcagtcttcttgctttagtctctagaatagctggaactacaggcacacgccaccatacctggctaaattttttgtagagacggggtcttgctgtgttgcctaggcttgtctcaaactcctggcctcaagtgatctttctgcctcagcctcccaaagtgttggaattacatgtgtgagccactgtgcccagcctctaattggtgacttctcaattaactttgacataagtgtgtgttttataagatcattatcaccgataataaatgcagcttaatttctaatcaattggccaaacagggaaatttgagttgagtgagatcattaacaactttctttagcgctttaagagctaagtgatagcttttccagttctttaaacattacaaactgccgttcctggtgaatgtcattttctcaaattcattttcagagactggaatgggtctgtgctactctatataattttgtgctgagcggatggtatattgatgggaggaagtaggagagtagtgatggaagggcacaggcattggagtctgtctcccaggtgactctgtaagtttttcaactttcctatgccttgatttcctcatctgtaaagtgaggataatgagttaatgaatgtaaagcacttagaagggtgcctgtagtaaggacttacaactgttttatttattgtttttggagtttggttggaggattcaaagcaacattcattaaactaaacactcactaaattcactaaaatggtttccaagtgaaataataaatatagcaaaggagtctctcctctgctatggagtagctgagttgagtgcatctgggtgtccattctgctgcaaatccaggccaagcaaatacagtttctgtgcaattaaatggttgttgactggcaaagaaaaaaaatgtaaaccatagtttttccttctaccctgtaatctgtggtgtctttatgcattaccttaagagcaacttcagtgacttgattagagggaggtttataaactgcttggaggcaaagcaccgaactcttgactggcacacagcaggtccacaaggaaagccacttcccagggtaagaaagcacacacaaattattcagggacaaatgtaatggttacaagggtgtcatagaaacagatcagaatacttttatactactgcctggcttcttgttcccccattccccattataattctggattcttaagtttattttaatgacaaacatttttgcctgtctttaagtaaaagaacagaaaagaagttacttaaaatgcagtcctaattatgtcctaatgcaattttgatgcagcaatatgctttcaaacaagcaggtactgggtggcagattgacacaagtatttagtgaattgagaacaacatgtgttacatgaaattataatcaaattacaaacaatggaatggattgttgcttttaaaatcctctgaatgttggttaacttcatagggcagtgctgtgactatttccattaattacggagtagttatactgggacttgaccaagctcttttaatagttccatctgatttatgtttttctcttctctatttttcttttctgtctctttatttctttttgtcactatttttgttgacctgtatgtgtgtttttttctctttctgtatcagttcaagttctccagagaaataaaaccaataggaggagtgtgtgtgtataaatctaaagagatttattttaaggaattggcttacttgattgtggggggctggcgagtctgaaatctgtagggcaagcagtaggttggaaatttggcaagagttattgcagtcttgaggcaaaatctcttctttgtgataccttatttttgctctgaaggccttcagttgaatggataagacccacccacattatagaggataacctcctttacttgaagttaactgattgtagaagttaaccacatctagaaaatacctttatggaaacatctaaattcatgtttgattaattaactggctgcctgctattgccttgccaagttgatgcataaaattaatcataacattgtctcattcctttttccctcactgtgtgtttctgtctctcatctcacatgcacacaaatgaggttatgggacagcattagtgttaatgaatttcaggtaacaggataatgatcattatagcatctaccagtaattggatacctattatgtgctgagtcttgtatttgatgctttgtatttctgatctcatgtaatcctcttgacaattccatggattggacagaattaattttattttatgggtgaggaaactgaggcttaaagagctgctagcttttatttagccatgtagagctcaaggttcaaactctaatctgcctttcctgcagatatactctcttctgtatctgcttgtttctctaatattcccccatcactgtcatcactggctatttttcagtgtttcacttggatgaaaaacatatctacatactttttttgtttccttttttttttttttttttaaagacaaggtctcgctctgtcaccaaggctggaacgcagtggctggatcttggctcactgcaacctctgcctcccaggttcaagtgattctcctgcctcagcctctcaagtagctgggattacaggcatgcactaccatgcctggctaagtttgttttgtatttttagtagggacagagtttcactttgttggacaggctggtcttgaactcctgatctctggtgatcagcccgccttggcctcccaaagtgctgggattacaggcgtgagctgccatgcctggcctgcatacttttttttactaagcttttttttttttttttttaataggatgctgaaggagctgaggcagtgctgaaggatgttaaaagcacacacagtggagagcttattgttgttccaaggcctaattggagatctaggttggcatttcctacagctttcaaagtgtacaactaaaagactatcctaagaagatgagatagtttctgaactaggcacgaaaagctgtaaggagtgtcacctcccagtgccctctggcctatttttctcactgatggattgctttgttatctgctgccagaccccttaatgtgctggctcagccttcacagggattagtcacagaagatgggcgctgcagctgcaggtctggctccagaggctttgggtggtacctactactacttacttagcccttagccagatattccctagaagggaaaacgctccttagtttcactgaggatctggcctcatgagcagacactagttctaataatactctttaccttctttgtagctcccagccattgtcttctaccttcccttgcctagctttagtcactgccagcagctatttctaggctgttggcactttgaagtggaattgggcagacagaggtgagagcaggctgtgagttccctctctggaggttggctccttacagcacacatgggaggcagtgctgaaggatgttaaaaagcacacacagaggaagagcttacttgttgttccaaggcctaattggagatctaggttggcatttcctatagcttggcatggaacgatttgaatgtttgtggatggtgcttgcctcataccttgccaactcaaattttgggcagatcagcttctgtgagttttgtctcgacaagttgggaaagtttcctaactttagatgactgtgtgaatctttgaggagcttgatagttagcaggtgagggctgctattttgaaggaaatagacattaatatattcttctttaatatatctgaatgggtatacatatgtgctcctttgtttcttgtaaatgggcagtacaggagggagaaactgaaggagaggacttggtcaggagataaacccccacagatgccaagatgttggcttgttgaagcttattcgtggttagttttactgtgatactatgtgcagatggttcctaagttataatggtttgacttatgattttttagttttatgatagttttggtgcaaaatcatttttttttttacgtttagtacagtatccaataaagtgtgacatattcagtactttattataaaataggctttatgttagattattttgcccatctgtaggctaatgtaagtgttctgagcccatttaaggtatgctcggctaaggtcaggtgtatcagatgcttttttgacttttgatattttcaactaacaatgggcttattgggatataaccccatgataagtctaggagcatctgtatttgtctgtgaattacttagggactcttttgatgtcttcgttttggaaactctctgttgttggtttttgttattttagccttgtcgggttttcctcatactggtctaactgctagtatcttttattggcccctctttcttggatatcctttacatgtttatatttgttagtgtttcttccttgacttgtctcacttctcgtgtttccttgggtttgcctccattactaagtcttcatccagcccctatgtcattggttctcaaagtgtggtccccagaccagcagcagcagcatcacctgggaacttgctggaaatgcctgaactaaacttaagacactatataaaacaggaaaaggcattttacattttgatacacattgtcaaaaacattgtactggtttcatggtatgcattataaggcataaagtagatcaagcctatgttcctaatgcatacatttctattgacctcagagagtgaactatcatataatagaaataggattatcattagtttaatgaatgagaaagactcttcatgtttgttctttacctaatctatgcagtttaaacctagatcgacctcagggaaatatgggaaattgtgttctcttctggcttgtttaagtacaaggaactcagacccactctaatttgctttaagtgtttttttttgtttgttttgaacagtaagaaactatttagggtggagaactttatttcagtaaggcctcatgtgaagtggaattaagacagtcataatgtccttttgtggcttgatcttgatgaggtgataggcttctgcacacattcatcaactgttcatattctttcccgctctgtccgccccccccaccctcatcttgcttgcacacacgtgcatacttttgcatgctctctgactctctctcttcttccctctccttcctgccaacacagctgtattcatcttcatttctttttcacctggcttcctccctctctgctctgtgtcttttcaggtccctcccaagtttagttcacgcattactcattctatgaacctcttaaacttcgtgcattctatcttttatccctattactatgtcaccctggcagtttcataatgcagatttctgagtaggagtcccagtgggacagaacctggccacttgatggcaggtccagtgtcctggtcgattcccttagaaagtgctgtgcagaggactgttactttttcttatagatcattctatgttttaagtattaaatgaagcctcagctccagcatagcgtttctgacaggctgactcacttcacatttaatgattgtatccagcatcttgtctctactctccagcaatgcagctccttcttctggtgtcgtcacttctatggacatatcctgtggatgttcccatccacctgagcccaaaacctctgtgcttgtttgttcctcctcctccttagccctcacatctcttcaatatttttctctctctttactattacttaatgctactgccatattgcttcttgactagattttaataatcttctgatttcaatctgttactttgtctcagtcagaataacctacttcccctttcacatgaaatacttatctaccctgaggaatatccctcaaggctctctattgcctgcgaattgagaatagactcctctgctgaagattcacggtcttcagcagtatgccccctacttggttcttttactccaaacactgtactctagctacataggactactgagtaatactcctcaaaggctccctctcttgggtacttgtaaagtgccctttagctgtgtagcagagaataggacaggagtgcacactctggggctagactgacgggctggaatctcagcccagcttgaaaactttgagcatttgttattttatctttctgtgcctcatttttctcaactgtaaaatggaaacagtgatagtatctgccttgtgggttgttttaagagttaaatatggagcactcagagcagtgccagacacacagcaaatcctcaggtctttccagggatacttttttttttttttttttttaatattctccattagacgtgatgtttctgtctctgcgatgtggtaattttttctgttttttatttttaagggtacctatcacagtctgcttcccccttttcagattatttgtggatttcagatgttcacctgtttttctttgagctccttgagtatggagatggtattttattgaaacttatattatgacatacggagctcaataaacatttgttgaattggattatatccaaaagatgcttctgctaaaatactgtagtaacttccatctgtcccatgaatgttcgtgttctgagacaataatgtaattcttaaaactaggttttaaaccttaaaagtgaaagaaagtgaatactttgcggttgtcatatagatgtactgctactcaagtatagtaagtatattggtgaaatatttagaaaaaaacaactagttgtgaatctgaatcagagatcagcaaactttttgctacagagggaaaaatattaaatatgttcaactttgctggtcatattatctgtgttggatctgtttaccacagcaatcgtaatatgaaaaatatgtaaatggttgagttccagtaaaactttatttacaaaaacaggtggactataatttaccaacctctggcctgtgtcattactgtgcaaaccacacatcattttagaagctgtttgttgcaaaagctccaggtgctgccacatccaaagatacacacctgcatgtcttctcattaggtataaggaaacctttccagaaaatctcagcagattactcacaagttcagtggcccaaagttgtatcacattctcacacttcaaaccagttactgatgatggaatgagactaccatgattggcccaaatacaccaggaatcacaggtgttgttgtggataaggcctccctatctgcatcacgtgaccatgttgatgagggcatttccttgtgaagtgaaaaccattgaattgtacaatgaatgtgatacagcatgggctgccacagtccagttgtcacctactcttctgttgttcttctgaacatcatcataatgtcacatttgacaggtgtgaggtttctttgttaaagctcagacttattttaaattaatattcttatcacatgaatagacccgtggtaatgatgtaatgaccttggaggggcaggccagttttccgctgtgaagcataaagtttcccatatgacatccttgggctactcattttggtattctcagatatgcaaaacagagaaaacaacaggcttcccacttcagaattcaccatatacccttctccttcttgaaagggagaaaccaattagacaaggactagccttctcttatacttaataaaggcaggtgagttgagcctcttagtatttgtcatacactatggattaaaccagtttatggcccatgtcattgtacccaaaactctggtgtataatagtaaaacgttcatagttttcaaattagacttagagcttcttggtctcactttagaatattttgacagccctttggctttcacagaaagacctagtccctcaggggtcttgaactgagctaattatcctagtcatatcctgtagaacgggatcccactatggcttgtctgagactgcattgttgtcttgggttgtatgggaccatgagacaaacggctgtactgtttttccacttggcttttctgtggtgtaaaactatcttttaggagccacaaaatgctattcttttacttgttgaaagattttaagaaagaaagaaagggagggagggaggactgtaagggaaaagagaccattaacatgacatgtttcctgtcgctctccaatctgagtctaaccccagatgactgtattcccattgttttattgtgagggcatttgtgagggccttccccttggttgtgtcttggtttacagtctatagaattggattagacaatgttaattcaattaatgactgtactgaaagtttgtcttagtgtgcagtgaaaacaggagagcagcctctaataatctatggatttaatgactgcaactttgaagagtgttaagctaaagtgaagttcagaatggcttgttaactgggtttattagctgttgaccttccctttcagcataatagtggcagtcagaccgaagagagcactaacgtcctgattagcatttatctaaagataggctgctgcctgttacacagtaaattagttcaatcagccataaagagcttgagaaacattttctgctttataaaaagaattagatgttagaacagttcatctggcatagctcagtgaagatggattgagcccctgaacgtgctcatttgaggaaggcgctttgaggatattgagtaattgaacagattttcctacaagattgatcaggggccctagatttcctgcacaattgagtgatgctctaatttttgccttctaataagagcagtacatctgctcctgtttctgtgtattcatcgagtgaaactgaaaatcaatttatttagcacctactatgcactctatgtcccttacgaaataaaagcaataggatctactgatcacagtctatttgattgaagagatgaaaactacactaaaacttgaaattcaccacttccactaccactgcttcttttcttctgaaaagaagaaactgtagaatgaaagctgctacttttggtatatttcttgagatcatcttatgaagtgaagcacattttcccacagaaacagtatagtagtcggggttaacgtttctgactaaagtcttggcaccaactaagttcttctcatagtgggtcataaaagcaaaaaggcaaaaattataaacctttctaaatcatttaaaaacttaaattatgatccaggtccttaaaaaaaggacataaatgtactgtacaattgaattttatgaggtgccccaatgtactataaagtatacatagagcatataaaattctaactccgctgtatcataaatttgacctcactgaaatgaataggctcactgtatggcaagcattaatgaaacgtttaattaacattcccttcacttgcatttttagaattttaaagggcttcctggggactatttcaatggctgaggtttttgcaaaacaaaagaacaaaaccttctcataaaaactgatctcttttgctcaataactcctccaatagagacatttaatttaattagactgatgaacctgaatttgaattttatacccaaacctatgatcatccttaaaaaaaataaaacaaaaaatatggtattgagacagttaagcacttgatgacttcatgaaggcttcctgtggaccctttaagccactgtgtatacacatatcatttatgtccttgcagttttcccaagctaaaagccacagggatatgagtactttgtgagggacagtggtgcagtgttagaatggatgagctgtagggctgtgggcttcagaccctttcatagctccctgtaaggtatcctcctcctctaaccttccctgtaattatgctatgttggtttactttattgcctggtcactccaggagaagtccccagggagtcatacttgaatgaacagatagaggcagagtaaaaaaaaaaaaagacattatgctaagtgaaagaaaagtcattcacaaatgactgcatatggtgtgactatatttgtattaaatatccagaataggcaaatctgtagagatggaaagttggaaagtagattagtagttgtctaggggtgaaacatgagagggatagggagtaactgctgataggtacagagtttctttctggggtggtaaaaatataaaattagattgtggtaatagttgcacaactatctgaatataataaaaaccattgagttgtgtattttaaatggttgagttgtatgtatgcaaattacatcttaataaagctattatttttttaaaaaggtattaagtttcctcaagttaaatgaaatgaccaaaaggggaaaggttttaagcagtgagcactccttgtaatgtatgtgtatagtgagtatgcatatgtttgtaaaagtataatgtgtgtgatccaactatgagccatatggtgctagtcatgatgtgtatacatgaattctagaaaaagaggaagaacctttaagtgagagaatgccatgcattgggaagcagtgtggggcaagatctgtgtggctctagggtggcaaatttagtttgagcttgtgaatccttgcagagattggcaaatatcagatactccttggcagagaaagcagtagagtcaaaattgagaagatttaaggaagcagagactaataaggagagaatgttgaaacctgttatttgtagttagaagtgtagatgtatacaaaatagaaaaaaacaaaaagaatcttctgcattatatcaggaggaacttattggtgttttaggaccattaagatggagaacacagctcactcatatgtgggagctacaaagttgagctcatagaagtagaatataactgtggttattcaaagttgggagacgtggaggggcggggaggatagggagaattggtaagggatacaaaattgcagctagataggaggaataagttctgttggtctgtagcatattagggtgaacaccgttaatcttttattgtatattttttaaaagctagaagagaggattttgaatattcccagcataaggaaatgataaatgttagaggtgatgggtatgctaattatcctgatttgatcattatacattatgtacatgtatcagaatatcatgccatagcccataaatatggttgctacatgtcaactaaaaagaaaatttttaaaagatggaagacaaaagtaaaagataaatgtagatattcttttaactgtttggtgcttacctggtgtcctctgaaaaatcagagtcgtgggagatgaataacatttccagagagcactagatgaggagttagaaaagctggtttatcattcctactctgtctcttcccatgttacattaaataagtaactctgtgatgctttcttcctcccttgagttgtccttcttaccctgagaggatggcacaaggatcaaatgagctgacatatacctattgcattgcacctactagaatgtaacaaatgtttgtcagactgagggaggaaggaaggaaggaaggaaggagtagagtgatatcacatgcaaggaattggatttactgacttattcctctggccaagtgtgtcaacattatgattgcaataagaacttttgcattaatactatttatacttatgggtattattgctgcatttggtaattctacggtaaatttggaggtgcttctagtatcactgtcttgttctaccaatagtcttgtatttattgacagtttggtggttgttacaaatgacaggattgcaaatagaaatcaagctccaaagatggatggattagcttccttgttatgaccgtgttaaggttaccactcagaacaaacattggtagttgagcacgtcttgagtgtgagtgtcatactcagaacaattctaattttttaaaaattacttttttagaggctgtctcactctatcatcaggctggagtgcagtggcataattacagctcagtacagcctggaatttttgggcccaagcgatcctctcaccttagctttccatgtagctgggactatagtcacgtgccattacgcctggctcaattctacttttgatgaagtttttgacatattgacattgggtttgacatgtcattccaatataatatgatactgtagcattcaacaattctcttcccagaggagactatagaaaacagaacatttgcatttcccattttgtactttatgccacccactaaagaattccaaagtcatgcagaatgcctttgatgatgtgagctgcatgtgaatttcttattgcttgacttttaaatcccctttgttatctaggtccattacttataagctgtgtcacattaggcaagtgacatgcctctctaagtttccacttcctaatctggaaaggggggaaataatgagattggccctgtggcatcaggattaggcaaagtacttggcataacaccagtctcacagaatgcagtttttcttgagctgttgggtcagtgatgcctgaaagaggaggagtggaggttctgaggcattgctgtttttatcacgtttgatttgttttctttttgtctagacttgccatattatagcttcatcaggattttaaagacgattgtgaattatattttcaaaagttgtatggactcttgtactttagtataagcagcacaaaattaggcttaagaaacttagattttaatgttagctatgagaccttaggtcactggtgcgtgttcctctcatgaaataagagaatggaaccagctggttctttattcttcccggttccaagatgatgtggtcatagagtcttcattgcataatttcttgttcctcctcatttcttcttaccacactcttgtctttaatctctgacacctttctacccatctccttcaatgctccttctattcatcctttcatacgtcctaaaaattgttatgtcaactatgaggcaagcagtatattaggagctagatatgtaatgttgaaaaatatagacatggttcctgcagtaacagaatttacagtttaatggaagaagtacagataacacaagtaatacttacaaaatgtggtaagtgctatgaaagagcaggacagactgctttgaatgggggaaggggggatccctggcagtttaaatgacttttctcaaagcaggctgccaaaaggtagcggcgccggccagaggtggtttgagaggcaaagcagcaccacagacaggggtccaaggcaagaaaacgctgagctgctctcaggtgctggaaagccagtgtggcttgaagcgtgctaagagtgagactggaaatgcatgccaagtttgaggccgagttcaggattttgtattccatgataagtgtaatgggaaatctatgagaacttttaagtaacaacaatatgggaatcatacttgacttggctagaacaattaaaagctgatctcttttagaaagtacagttttgttttacattaatcttaacacagaatagtgtattacacctaaagtgaatactcttttaggctgggtaggggctgtcccgtggtttaatattgtttctatcataggagaagccttggtttcctagtttcccaccttgtttctcctctctctgccccactgggattctagctgcttcttcactgcatttgctcacctcttcttctccacagtcctttggtccttgaaatgctgtaagagcagaaataacagctatccagagaccttcagatagcagatgtgccttgggcctgtgggtctgtggctctggagggctaggaattacagaagagttaaaagagaaggcctctgccagcaggaattccgaagacaccaaaactgatgtcactggctgtgcaggcactgagctaattcttttgccaatcagttaaatcacctaccaagagtgttcattgtaagtaacactttcttgccatttggtggggatgtagagggacaaaggatgcaaaaggcaacaggttctttccttgtaaaactgtaatctaattctgtaaacaagccatgtacctttggaaggtcattttgaactcagtcctggtaaatatttgacaggtgttttaaaaaaataattatatttatacaatctataatggaatattatgcagcttttcacaaggaggaactcctgccatctgccacaacgtgggtgagcctggaggacattatgctaagtaaaataagtcagacatgaaaaaaaaattgcatgatttcacatatgtagaatctaaaaaataggataaaaatacagagagagaataaaacagtggttactaggattgggtttggaggaaggaaatgtggagatttgagtcaatggatacaaagtagcagatatataggatgaagaagtctgaatatctgtacaacatgaggactatagtgaatcacaatgtactgtattcaggatttttgctgagtgagtaggttatagctgctcttgccacaggcaggaaaagtaagtaactgtgagatcatggatatgttcacttgttttcctatagtaaccttttactatatatatgtacctgataacaacatcatgttgtacaccttaaatatccacaataaaatgtattaataattttatttaaaaatattttaaaatgtggacaattaaaaattttttatataattttttggtagttataatgctctgttcttttacaaattgtgagctggatactcactactcttcttttagcccaaattgagaacatctggaggcatttttatgtgatgactaaaaatacggtaattgagttagactgtatgggtctgtaccctgctctgccacttcctggacatgtctcagttttctcatctgtgtaatgatgatagtagcgtccacttcttgttgttattataggattaaataatatattacatgtaaaatgttgagtataaaacctggcagatattaagcacctaataaatgttaggtattaaaaatatataaagtatgacttctgctttcgagaacttaacctataaatatcctttgataccccgccccccgccctttccaccttgatttcatttacacaagagccaagtgaaagagtagtgagagatgaaactaggaaagcaggaatgaggcagtgggtagagaaggatatgtcctgaccaatggcattgacagagtggttttgacaggtgagtgtggaaatggactgcggtgagggagagtggaggtagtgttgagaacccgtaggctctggcagcaatgtggagcttacttgcagcatagcctcccttcaacttggaaaccaagcatttcaaagtacctgggaactttcttcatcacatccttccagcatttacattgtttacaaatgaaggagggaatagagtatattttattttctgataactttctgggtttccaaagagagaactgtaaaactttgataaacacatccataagagttgctgcccacacggtttcaaaactggatctcttgagctgggcataactggtcataggcagagaaacgttgactggtgatttataccttataccctctcattaaacactcttacctaactacgcaaattaggcttttaaaaatagattatttttattgtttaaatgtagaagaatatatctcagagttataggaaatttgcatgggtacatgtttataataaaaatcctgccaccatttatcataaatggccttggtttaggagtttacacagtagagagctcaaaccactggctttgctatgaaatagacccaattcaagctccatctcttaaaaagccatgtgagtttgggaaagtggcatcactttcctgagccctgggtttctaattattattattattatttttgaaacggagtctcaccctgtcgcgctggagtgcgatctcagctcacggtaacctctgcctcccgggttcaaacaattctcctgtctcagcctcccaggtaactgggactacaggtgcccaccatcatgcccggctagtttttgtatttttagtagagacggagtttcactgtgttggtcaggctggtctcgagcttgtggcctcaggtgatccacctgccttggcctcccaaaatgctgggattacaggtgtgagtcaccacacctggccaggtttcttatttttcaagaggagttataagacccacaaaccttacaattattgtaaaaattggtaataatatatatgaaaagtccccagcacagtgactcctgcctggtaagcaacccacgaattttacctattgtcagcattgtttagatcacctttatttaacttagttataatggggcttaattacaaaggggatccatattctaaaagcaaatactgaaacaaatttttacaattcactaccggttcttcagattaaggtcttctgatcatggttcagtttgggtttttgttgttgttgttgttgttttttctccccaagatgcagtcttgctctgttgcccaggctcaagtgcagtggcgcgatcttggctcactgcaacctctgccccctgggttccagcagttctcctgcctcagcctccctagtagctgggattacaggcgcctgactaatttttgtatttttagtagagatggggttttgccatgttggccaggctggtctccaactcctgacctcaggtgatccctgccttggccttccaaattgctgggattacaggtgtgaatcattgcacccggcctgagctactgcgcttgggccatggttcttaatagtaaaattatttaacgagatttttcccagttcttactggtaaaaatgtcctgtggtttaaaaacgttcaaattaatttgttgtatatttcacatgacagtgatacgagggataattgattatttgaggtattgatttgacctaattcagcataataatttactgattttcattcagtgcatgctaagtactaaatccagtcttgctgggtacagagaaacatacattcattcaaacatcatctcttctctcaaggagctcacagtagaacctatttaaatttaggcagtggggagcatgaggctgcagagaaacaaacatccaactttatgaaaagacaaaattatggagacagaaaaaatgatcagtggttgctaggagttggggagagggaggaatggataggcagagtggagaggatttttagggcagtgactctgtattacagtgggtacatataattttacgtacgaccaaacccatagaatgtacagcaccaagagtaaaccctaatgtaaactatgaaagttgtgataatgatgtgtcagtctagactcatccattgtaactatgtaccagtcctgtggggaatgctgatagggagattgtccatgtgtagggacaggaagtacatgggaactctgtactttctgcccagtttttctatgaacctaaaactgctctgaaaaaagtattaattttaaaaagtggtcttactgctttggagcacaagtaaatcatactaagaagacgatgtttaaattaatatactacagatacagtttgctttactgaaatgcagtatatgatgttcaaaacatatatctttaagtaatagccattttacaaaggaattgcatgtttttacagggaggtttcactggcctattagggcatgttggcttggtggtacagctaagatctaattccttctgccaccaaggagctttgtgaccgtgggaccacccaggaacctctctggctgtattctctgcagaaagacttaggacaacaacatggcatgctgtgtggacatgatttgctttgttgggcaaactggtgggattggtggggtggatactctctaatggaggttaaaggtcctgaagccactgcaggttaccctggggcgccatttctgtgctctggattaattctttgctcagctgttaaatgtctgtgtctggaagtggagatacacaagatgggttggtccccatggctttttatacctcaacaattatttcatccagtagatatctatactaacttgattgtaaacattaagtttacatgggatttctttaacacatccattttctaagaaagtgatccatgtgtaagtatagagtgaccaatgagaaaatagggtaattcccacacacccttccaaactttacaaggagtgaaataatataaattagcttcctctagtgataaaactgcaagaattttcaggcaaaagaaaaacagtttagtagcaccatctacaggctactgaagaggaaaacttcctatgtggcttttaaatgcaaggagtttgtggaaaagggaatacaaaaacttcatactctcttaaaaaaatattatccataaaatatactaattttagtatttttgttcttctttaccatgcattcaattcattttacaatatgtctctagttatcctgaactagtggaatatagacttgattatgtgttttcattaggatccctgtttcatccccatgcttacaaatttctctccctctctgtactaatgataagaatgaactgtgaaattcacatgaattccagtagtttcattgatagtaattcacagtataagacttgaagcacaaagcctgccagcaagggatgtttcatcttagcttatctgtatactcaaaggatttattgcatcatttacttccattatgggaggaaaaataaaagcagacactcttgggtatgtatgtatatgtgtttgccttttttaaaacaatgaagttgatttattaccttctgggtttaaaatcttatctgagccttttctgcccctaagattctgtgattctataatcagaaatagcttggggaatggataattattttgtaaaggaatctagaaaacttgtctttgaatatgataacagtgaaggtaatattttcattcccagataccccagttttattatctttttttgctagttttattttgttttcttataaactattatcaattttggtaacctggaaaattttattggattctccaaataactggattataaagtatttatggaattatcagagttgtaattttctgttagaaatggcttattaaaattaacttaatggcctccttgtaagttgttggtggagttgctgtttcattcattcattcatttcattgtgtgtgttattggaaagtgggtaagagttactggaatgcctagataataagttttcagtaaagcattacacattgcaagaagccaatctgcacccccacccaccccccaaaaaaaaattgagcataaattataattattagaacaatcttacttgaacagcattatttcttggaggaaaagaggaatagaggagatacatattgaaatagtttgctaaactaaagaggaattcaaaggataaaaaaattgataatgagattttcaaggttcctgttgaaacagatgaggcagagcctatcaaaactggagccaggagtgataatggtttttaagtttgtgtagcttaattgctgatggtttaggttgatggaaaacttagtaatactgtttccaattttttcctcattattttaaatgtgtaaaaaaattgtgcattaaatactggaacctttctctgaaaaaaagtaaagcaagttctagtatgaatagaggtttaaagtaaggcactgcctcgtcgtcctatagctaatatttttccctgtttttcttgcaccagatggcactgtttagttctatttcacaatcttattctggaactttcttcgggagaatctgttttagcccagggtcaccagtgacacctctctattctgcatgaagtctttatgaatgcttgtaaaaggtcactgactcagacatgaagctgtttatttgaggtcttgtggttctttccagttgcacatttgctgtgaggtgagcctaataaaccagctgatagaaacctacatgcttcttatagagttcagccagtattttgcttggagacatattgcaacaatatgatttcagcattctcacggcccagtctaattatctgacacattttggaattattttatatgtaaaagtagagctataagcagaagggcacactcactaaaaaaaaaaaaaaaaccttgcagagcttaaaatgtttcatgacagtctgttgaactatagatttatcaaattaacttgcaaaaataaaatttaaagaacctttcctgactattcccaaggctgacttggaaggaaattatcaatgacctctgatgtcattatgcataaatggggcaggtccatagccaagctcgcctctttgctgcacataacaataaaacatccttttggaagatagaattagctttatttaataaaaatgccagggtcatattgtaagacttatctctgtgagctttgccctcccctcccctcctctcccttgaataatacagaaacgttggacataattatgacacagatttcataaggctgcttctccttttacaattatattttatgaagaacagacaatgttttctttgcaaattttgaagctccttcattttctgaatgcattggatttggtactaaatgctctctcccgtttgcatttccttctctccctccctccttgcctccttccctcccttccttccttccttccttccttccttccttccttccttccttccttccttccttccttttttttttttttttatttttggtcagtgtttcactcttgttgcccaggctggagtgcaatggcgcaatcttggcttaccacaacctccacctcctgagttcaagcaattctcctgcctcagcctcccgagtagctgggattacagacatgcgccaccacgtgcgtctaattttgtattttcagtagagacagggtttctctatgttggtcaggctgctctcggactcccgatctcaggtgatccgcccatctcagcctcccaaagtgctgggattacaggcgtgagccactgggcccggcctcccctttgcatttcactgctctatgtattctcttggtggtgatatgagttgaagggtgggagtaggggtggagagccctctctagactggagctatgagtgcataagtgaaatctcattatttccatctttaaaagaaggagtattggcgtgtggtgtttttagccagccctccctcctttcctctcatgcccatccacaggccattgactggaaggcacaacagctcccagcacagcccctcctcctgccgctggagaggtgttgggactggtgtgctggtttccaggtgcaggtcctccaggctgagccacagctctctgtagaagtaagcatgagacaggctgcttccataaatcaagccctgaattttattacagtgtttatgtaacctcagtttatgtgctataattctttgctgtgttgcctagagtaattcccaaagaggatgtttgttctttttccctggaaattttctagcataggccttttgttttgacattctccttccccccaccctctgccttttttgggatggcctggggatgggtatcactaacagtcaattgctttttactgagtaaataatataatccagcgtgtgttagattctgtttgtactagatgttattcctactcttaagtgggagaaaaaatctcaaattaatttttacattttcaagattatagggtggtagggttaatgtgtacttaattgatgagtaaatgaaatataagtgaaaacaaatgcctttgctatccatgggagacccgttccttttcatagcctccgccaccatcacagatctcatgttgatagagtcagattgaccgctgagagagaaaatacagactggaaattttgggtgatttagacttttaactgaagaaaatgtcagggtaagatgaccagattcaactgtattccatgtagacaactatgtcaagagagaaatgttttctggttggaaatgaagacaatttgacttaaccggagcatgtttttaaagaaacccatagcatgttttttttttttttaacttagctctttttttcgaaccttatgtttggccctacagagaaattaggtgatgagactggacctactgaaagtgttaccggacctattctgcttggacacgctagacttgtgaactgctgactggtatatttcagttagtacagttaatgttttatcatcactgccattagaaggtattacatagatgtgatctttttcattgtagtttaaagaagatagttaatcctggggcaaagtttatgaaggaagtgtgtgaacagagcaatctttttagatttactttaactacaaaactggatatttgttttaaagctgtgctgtttaggattgtagacactagccacatgcaactgttgcgcatttgaaatatgaccagttctaattgaggtgtgctgtaagtctagaatacacacttgattttggagcttgagtatgaaagcaagaatttataggtcctctttaatcatttaaattaattacacattgtaataattatattttagatacattgggttacataaactgtatcatcaaaattaattttatacctatttttaccttgcttttactttttaaaatgtgactcctagaaaaaccttaaaattgcaaatgtgactcacatttgcaactcacattattttattatattatattttattttattttatttattttcaagatggagtcttgctctgtcacccaggctagagtgcagtggtgcaatctcggctcactgcaacctctgcctcccaggttcaaacagttctcctgccccagcctcccgagtagctgggattacaggcgcatgccaccatgctcagctaattttctaccttttttttttttttttttttttaagtagagatagggtttcaccatgtttgccaggctggtatcaaactcctgacctcatgatccgcctgcctcggcctcccaaagagctggattacaggcatgagccactgcgcctggccttgcaactcacattattattggccagtgctgttttaaagttctgttgtccaatgaagggaataacagatgagtacactcagtaaaaccttcaaagttatacgtttaaaggaatattctatgcttcctgataaaatattaataaccaaaattagcaacaatatatagatgaaattattgcctcaagatttatgaggaaatattgactggaatactgtctattaaaatattcctctttacttgtcaagtctacctctcagtatcttaaaggaaagttctcatctaatagggtgtagaggttaagagcatgaactctaggttggaatcccagcttggttgtttactgtctgtataataggaagtaagttatttagcttccctgtgcatcagcttccctacatgtaaaatggatacaccttaatatcttcttcatattaaataaaacaaagtgtataaagcacatgctaggattcgcacatactacataagtactatgtaagtgctagctattatagtgatagatgttattgttcttatcttgttaaaatacgtacaactttttgatagattattcgaacctggactctattctcaagcaaatggaagctgttggctttcagtaattagtctgaattttgttgaaactcagaaacaactggcagtaattaaaaatgggaaagtaaatgagcaaagaagggagctcatttattggaacatatgatgagaacattccataaagtaaaacttgtagtaattgtcgattaaaccaattttctacctgatataaattcagtagtactatatttctttttatcatgtttctttgtcaccaggtatattggtctgcaattttgagtctttggaagttatttttgtgtttattatgctctgataaagagatgatgacctcttaatcttgtgtccaagagtggtggtgctatattgtcctagaattgtttgaattttagagcaatgtgtatgtgtgcatttaaacccaagtttaataagtcattccattgtgttcttaatagggctagataacctgagaaccagttggttttttattgtgccgaataaaatttgtaatctggtttagactctgtacagcactgtaggtataacaagtcttttatgcagttcgggggtgatctgtgatataagtttgttatggtggaattgatgtttgtgatgggatgtctagatgaaattaccccatggaatataatcttttttgagtagaggatggtatttaagaaatatgtcttcaaaactcttatacaggccagtactgcctctttagatgtaaaagtttataattttaattgcaggaccttcttttacttggcttttaaaagttattcacttagtcaaaatttattgaacacctatagtattccaggcagaatgctaaccctcacggagctcacaggggatacacactaagggatatatattgtagtacagcacagtgctgtattaaatagcaattgcagagacactttccctattttttatgtttttactgccactttgcctttataacatgaggtgattttagcatagagctgaaccaaatgttgggatattaaaaagctgaagcaaagttcataaagagcatgacttgggcttggactttgcattttacaaggtgtgcagtgtgagcttacagaggctttgacagcagggagtgagtggagcgttgggctttgttatttggagagatcactcttagtattggtattgggacatagatggtataataacaaggagagactgtaagaaactttgcagtatctaatcaagatatggggagaaacttacactaaagagtgtgtgctaggtgaagaagaggtaggattttaaggaaattctccaagttttaagtgcagaagtgtgggaggaaaaaatgtaagatgatgatggttctggcttgattttccagagtagagtagagtagccttcaagatttgatacaacgcttgacataggacatcttaaaggggagctcttagacttcaaggagaatatggtaaatattaagtacactattgggagcatgggtctgctgtatgggagagtgtcttggctagaggcttacttgaggtagtcatgatctaaaggtgatagctgaaggcatgggaggtagatggtataaaataataagcctctccactgtgcttctgggggatttccaaacaccttagcatgccttacaaggccctttagggtttttttctgtactttgttagtctcctttacaaaagttaatgctgttctctctcatgcaacatgcattcctcgtgtctccagctgtttgctgttctcctcacttcccgggctcttctgtatctccattacatcacacatgctgtttcctgtgtttgcaaggcatggctcctctttgtccccttaacaagctctggatttttctttaacacccagttcctgaacctccatggcccagctaatagctccatccttgaacccataagattttgtacatatttctattagtacttatatctcacttagagtaattatcacttgcctttcactcattctgtatagactgtgaactcctaaaggaaagagaagtaactttagtcatttttacatccccaacctcaaaatggcacttggcaaatagatgctcagagaatgtgttttgattgaattaattcatttgtgtgtgagctgcaggtgtcacattagtggcttttggatgtgtccagaagtatacctattatacgttgaaattttgcaaatcatcatatttgcaaaggttaaatgtaaacaggagaaaggtgagacctgaggtccttgtcaaaactgtttttcttactgtaatatcaatgtgtattgtttgtggaaaagttgattgataaataaaagaagaaaatttaaaatatccatagtctgaccacccagtgatatcttggcttaaattgtacgtacccaaaatagcaaaaataggatctatctgtgtatattgtccttgacttttttaaaaaacttactatctgtgcatcattaaatattagtaagtagtcatgttttgtggggttttcttttagtttgagatgaggctggtcttgaactcctgggttcaagcagtgttcctgtctcagcctccaggtagctgggactataggtacacaccaccaccatcctcagtagtcatttttgagtgggctagttaaatagacgacactcccatcatgcattatttaaccagttccttgctgttggacttataggctgacttataggctgtttcaaatttttaatttatatagtcacatttcaatgaacaatccagtagtgttgtcatattcatttttatttagaatacttcggtgaaaggaagtatatatcttactttttccaactctattagcaaatcatctcttggacatttttttttttggagacagaatctcactcttgcccaggctggagtgcagtggcatgatctcggctcactgcaacctccacttcccaggttcaagtgattctcctgcctcagcttcctaagtagctgagattacaggtacctgccaccacgcctggctaatttttgtgtttttagtagggacagagtttcactatgttggtcaggctggtctcaaactcctgacctgaagtgatcctcttgccttggcctcccaaagtgctgggattacaggcgcccagccagtctcttggaaaagtcttaacaatttttattatcaccaactgaattcttctcatcatatttttaggttttaaattgtctggaacttaaaaatatatgaagataggccagccacagtggttcatatctgtaatcccagcactttgagaggctgaggcaggaggatcacttgaagccaggaggttgagactagcctgggcagcatagcaagaccctgtgtctacaaaacccaacaaacgtgtgtgtttgtgtgtgtgtatgtgtgtaaaacatatatatgaagatatgatatatgaagatacattacgaagataattcaaatatatatatgaagatacataggaagataatttagcttgctgcaacagaaattccaaatttagggctaaagaaattatcaaactgaagcctttttgtaaatttaagtagttttgttgattttagaagtagacttttctggccaggcgcggtggctcatgcctctaatctcagcactttggaaggctgaggcaggcagatcacctaaggtcaggagttcaagaccatcctggccaacatggtgaaaccatgtctctactaaaaatacaaaaattagccaggagtggtggtgcgcacctgtagtcccagctactcaggaggctgaggcaggagaatcgcttgaatccatgaggtggaggttgcagtgagccgagatcgagccactgcaatccagcctggcgacagagcaagactctgtctcaaaaaaaaaaaaaaaaaaaaaaaattagacttttccaaataatggtcaaggtttttaagtatgagaaaggagtttcatggtcttggggatcagggtcctcttggcatggagtgggtggtgacgtgaaggtgagccctccagttccagctctgttattagccttcttgtgcctcttgtgtggctgtttcccagctccaacccaaagttttattaggataaagtcttggatttaggcatatggatattaaatatcagtagctgaatttggggtttgaaataattgctgcttacttctaacttccccatcccactccagattctttttgccatccctatctacattaaatagctaattgaagccaggcgcggtggctcatgcctgtaattccagcactttaggaggccaagacgaatggatcacctgaggccaggagtttgagaccagcctggccaatatggcgaaaccccacctctactaaaaatacaaaaattggctgggtgtggtggtgtgctcctgtagtcccagctacttgggaggctgagacaggagaatcacttgaacctgggaggcagaggtcgcagtgagctgagatcatgctactgcactccagcctgggcgacagagcgagactctgtctccatcaatcaatcaatcaattattattcataaaatgagaagaagctcctccgccttcccctgccaaggggatgagcaaatgtgtgttacagctcactttgaagagctgtccaggcttttgagtgaaatgcagaatttttacctcttgcttagtaatttgctcatttttcagactactttgcacagatttaatgattaaggaaacaggataggcaaaggtgccagcgtttgatattatcttaaggcctaaactgaccttacggtgatgaaatgaactttttgagtgcgtttgtctcctgaataaatctgtaacagttttcttaactgactccctctgtctctcagcatcagaaagaaatgagagaacattaagccacagaaagcaaataatggtcaaaataaagatactcttttgctggcaaacttaaaaattcacttgtggggctgagcgtgttggctcacacctgtaatccctgcagtttgggaggccgaggcaggtggatcacctgagttcaggagttccagaccaacctggccaacatgatgaaaccccttctctactaaaaataccaaaaaattacccaggcgtggtggtgggcacctgtaatcccagctactcaggaggctgaggcaggagaatcacttgaacccggaaggtgaaggttgcagtgagctgagatcacaccactgcacttcatcctgggcaacaagaacaaaactccatctaaaaaaaacagattcacttgtggaatctaatagctgtaggcaagggatatttattgaaaccaagatttaagtgtggtttatgatgtttatggagtagtttaatactacttttcttcaaaatgagtttttaatttaggaaaaagaattcagatatgttcccagagtagagatgactgaccatcatgggagtggttagggtttggggtttgtgtgggtaagattctgtttacccactacagccattgtgtggatttaaaagctttcctggatggaatttatggagtgaaatttgaaactagtgtcctgtgtactacaatatatggtcacaacaagcaatcaatttagaaagaaatggaacggagaagatacaggttaaatgatgagtattgtgcagtgcagcaagacatagagtgatcttaacagtaatgtggtatgtcaccatctgagttctgttataaagctcctaggcaatgactaaatcctagaaatcattgcctactttcagtggcagacagagtataatccattcatgatagggggttccaggtacattgatatagaagactggccaagggggaatgacaggggttacagctaacatttcctaggtaattggttctaatttccaggctccaagcaagatactgtatctcttttaccctgtttaatcctccccagcacccagtgaggtacagatggtattgtatccattttagaattgagatgactgaagcttagagagattttcccagtcatatatattcacggttcctggatacagctgtacaggttgttcactgcatgaaggtggctggctgaggtagcaggcaaaggatttgtttgctcagcagaggcagcattttctaatttgcactaaaacctgtgtaggccaactgtagccctactcataaagttggttaatgcctgaactgggagtagaggtgaggcagtgttgaagtggataggtagattctgagaagcttatactatacctactgaagtcctaatctgtaggctgtctgcaaactggtttgttttgctaccatcctatcccagcatttcctcaaagatcccacagtgacttctttattgtggatctgatggtctttggcagctatacagacattcttagagtcacagccaggattaaagtctaggatgcttgtcttcaagtcatgcatgctttctgtatgagataatatacaaaaagatggtcaagaaaagtgattttgagataaatagtggcctagaatagctagactgagattgttcaagcacagctattaatttgcttacttgctcagcactcaggctgtgctatttgcttcaagggatataaagattgctgctttctagaaaattataactcaattagggaaaccaaatcaatatatatttcataatataaaataagagaaattacagataacaataaataatagccaaaatacctttcttaactaggcatgtctatgtttctttaccttgctttagtgctcttagatgtcccattccagcctttgagttggagtggggaaggtgttccttattaaagaagcatctactacaaaaaatctaaaaccagatctgaggcccatactagacccttctattagtggtaattttaaaaaagaattttccatctaaatttaatagctttcttctgtagctaccctaccctatccctgggccaggcaccaaagtgaataataatgtgctataaaatccaaaccaaaatagtacatcttctttggcatttgaaatttcagtgttttttgcgtgtagctacaaatgtcttccattgtggcaaccactgttttgggtggttttttttttttggagacaggatctcactctgtttcccaggctggagtgaagtgatgagatcatggctcactgaagccttgccctccagggctaaagtaatccttccacctcatcctcttgaacaacttggactacaggcatgcaccaccacagtcagctagtttattatttttatttttgtaaagacagggtctctactatgttgcccaggctggtctcgaactgggctcaagaggtcctcctgtcttggcctcccaaagtgctgtgggattactggtgtgagtgaaccaccacagtcagttttggggttcttttgaataatcagaagctgaaatcagaagccaaaaatagcaaaatgggaattctgtgtgcttttgtgatatgattatatttgtgttcccagcctccaaagaaagcaaatgtaatttatatggtactcaataaactatggcagtcaagaaaaccaaaagaaaaacctttttccacttggcactgtccaatagagctttctgtgctgatgaaaatgtcttctatgtgcactattcaattcggtagctactagccacatatgcatttgatatgtggctagtgtgatcctaaggaactgaattttgagttttactttcataaatttaaatttgcatagccatgtgtagccagtggctaccatactgggtagcacaggcatgccacatgctgtttctctcttaagttggcacctttaatttctgttttaaaattcatgtctcctttacttgtccccttctatcttctctttctcactcactcccttcctttttctctttgctttttatttctccttgcttctttgctttcctgttttttctcaaccttctgtgatactactaggctgaccgtaaccccattaattataattatttattatggtctttcacctagttagacttgcctgcctgtgttctccttctgtccccaaagatgggggcattcgcggatatgcagtgtttaccaaaagctcctgatatactggttacttaataaaaacaaacaaaaaaataaatgggatttttctgacaagatggttttggtgaacctatgctgattcctgagatcacggcttctttttctaaatacacaaaaaaactgctttggtaaatcattctagaattttgcacagaatgaatcaaaatcagtggtattacataatcctaggctccatagttctgatttccagaactattgactaatagtaatcaaaacactggaatacttcactggaagacttctctgtccttacttttcagtagggggtttaatctaactcctctccagtctttcttctagaggaactctgtaattccaatctcactattttggtcttcccttctcctcctccttatctcttccccctttctgcttttccttctcctccttctcctgatataacttacttcctttctgagaatgccacttgtctctttctaactttaggtacttttgcctacttctttccttctactttaattcacatagaagtaccgtgagactatgtaaacacatctactttaagttaaacatttcctctattcagagtcatgcctttttatatttaaaaaaaaattctaggctgggcacggtggctcacttctgtaatgccagcactttgggaggccgaggcgggtggatcacctgaggttgggagtgcaacaccagcctgacaaacatggagaaacctcatctctactaaaaatacaaaattagctggacgtggtggcacatgcctgtaatcccagctacgtgggaggctgaggcaggagaagcgcttgaacccaggaggcggaggttgtggtgagccaagattgtgtcattgcattccagcctggacaacaagagcaaaactccatctcaaaaaaaaaaattctatatttgatttcaagcctcaaataacttaagtaataatgactacccatctgtaagagtccttgctttgtgatactgttacactctgttgtattgagaatgctctaagtcatatgttaccaacatgctgtggacctttagcttttcccagtttccagacagaagcagtggtcagtcacttaactgcactagacagaaaagcagtttttcccttctgaaggttaaacaggtttttacaccactggagatttttaaggtgggtatgggtattaaggtgggtattgttagtcttttccctctaagtttccccaatgtccaaagaattaacaaaattttaagggttctgatttatatggtaacacagtctgttagtcagatgtaccaagtttcttcctatctaattttttttatttttattttttttgaaatggagtcttgctcttggtcaggcaggtctcgaactcctgacctcgtgatccacccacctcagcctgccaaactgctgagattataggcgtgagccaccatgcccggccttttttattgttatttttttcagagacagtgtcttgctctgtcgcccaggctggagtgcagtggcgtcatcttggctcactgcaacctccacctcccgggttctagcgattctcctgcctcagcctcccgagtagctgggattacaggcgtgcaccaccgtgcccggctaatttttgtatttttagtagagacggggtttcatgttagccaggctggtctcgaactccggacctcaggcaatccatcctcctcatcttcccaaagtgctcaggatacaggcgcccagctcttgccatcttagagtctttgcaatttttacttttatagcctaaagtggcgctttgcatgcctagatgtatcttcagcctttatactttaatcattctgaggggggttttctgtgtccctccttcatcaccttcaccctgtttactccctccatatcattcattcctcaatacttatttccatgtttccctgtctccaccactgggatgtaaggatttcttatcacttgttctgtgcagttaatctcagtgctcgggctcacagctgggagctgataagtgctcaatgaattcaagtgtttagaagaatgttagtgcagagtagagattgggcaggcagtgttagtaggttagtaattattactagaaccaggtagagtttctacaacctgcattgaggccctgagcatgaagaatggagtgttaaaatgagcctttcaaaggcaggattggcaactgtgtgaggtgacaccactagagacatggtttggacagcgcttccgaagatggaataccagataaagatcagtgtggatggtggagtccttaactgattcagtttaagatatttgattttgatgcatttgggaatagggtgctcttgctgagaataggggttagggctcaatttacaaacctttctgttcctacattctaggttcctatgattataatgattcttgctgataatattttctcccagcattatttcttatatataatacgtgactataaaggctcgttcctgtttcaaatgcctttgcacatgcatgatttggatttttttccagccaggtctcaggggccatgtttttaaagtctgctgctctttgggctgatattgtggcttcttgaatcgcatacaaagcaggtttcttgaaatctgctcatctaccatagtttaccagttatctgtatccttgcggctctgcttgaactgaagcttaatcttgttctttgtagggcccagctatttttgcttgtcattctatcacatgccgtttaccaggaaacattcaaataatgattaatgatgccaaaactttaaacatggaggaagctggtaataccagctccgctgtggagattttcaggagcatcaatgccggctgaccggactggtatttgagtctcggataatggagtagtaggtctcaaaaagttacacttttctgggtaattgtcagcttcccagagtactgttaaattctgtccctcaaaaatgatgaaattgcaaaggaatggtcactgttacaggtattctatcttcattatctgatttaatcctcaaaaaaataattgatgtggaataagttttttcattcccattttaatgctagaaaattgaagcacaaaatctacccaccaaattgtggactgtgttttctgtatctcttatcaaagctctccagggtccctagaccctctgttgtccctctgttctagcctttcagattggcttctttcacttagttattatacataaaatgccatgttataaaatgcctcagtcaggataatggggaaagtgttcttgggagacagtgcacataaagaccttacagtgctgggtgctcaaaatgttaccatcacttttattgttagcctcttccctcttaagtttccccagtgtttaggaaattagcaaaactttaagggttctcatggtaagacagtgatacgactattatgtatatggtaagggggtgatatatctatcatggtaagtaacaggacattgaaaagacagtcatgggaataaagctaagtaaacacatgtttcattggaatagcttctattagtgacaatacctcctatattttggactaattcccagatgaaagattttgctgaaactaggcattaatgaaactaagccattcagtacagtgtgattttctttttttatcttgtgatttgagaagtatattctaaaaacccagtaattcagccaggctggacattcagttaaatatcagtggagccagctgtgtaaggacttattggctttgtcctatacatgtggtatgtctggagttttggaaacaattcatggcctccttttatcggttgagtagcattgaggcctcataaaaaatagtaacttgattctaaggtaaatttccctggaaagtatgaaatgggaaagttaggtttccatgtacccccccgctacgcatagcattatttcaattccaagaggcatttgtagtcaatttctatgatgattggaaaggagcttaaaaaattcttacaatctctttaaaaacttttgaagcagaggagaaaaaattggtaatttgtttttcaggaagaaacatacctggatttatctattgctacatgtaggttttttttttttttaactaactagaatcacagcatctttttctttttaaactaacttgaatcacaaaatcttatgtcatacttcatgtctttccttattaaggataattagtttatggaggattcagttatgatggtgatattattagagacttatctgaatgaaatcagaaaagtgtatcccgttttatgtagaagatttttacataaaatatttacacacacacatacacttcattttttagagcagttttaggtttaacagcaaaactgagcaaaaagtgcagaatcctccctacccccaccatacccctcaccctagcatccctgactataagcttcaagactgcaccagtatggtacagttgctacagttgattaactggtattggcaaaacataatcacccatcttacatagtttacattagagttaacttttggatttgtacattctgtgagctttcacaaatataaaacggcatgtactcaccattatggtatcacacaaaatagtttcattgccctaaaaatcctttgtgctctacctattcatccccctaccaaaaccctgatctttttactttttccatagtttcgccttcgcaagaatgtcatacagttggaatcatactatatatatgtagcctttcagattggcttctttcacttagttattatacatttaaggtcctccgtgtcttttaatggcttaatagctcatttcttcttagcactgagtagtacattgcctggatgttccacagtttatttttccattcacctaatcttggttgcttccaagttttgtcaattatgggaaaaagctactgtaaacatttatgcgcagatttctgtgtggagatcttaacattcacattggttactttttttaaatttcagatttatcaatattacagagctattgcaagagtcatatgagaatcgaggatctggaaattctgtatgaaagaggtgccatctgagtagggccttaaaggatgcgctgatttggacacatagattggaggaggtacatcgtactgtggctggcacagtatgtgattttctgtttgattggagttcatggtaaatgtaggaacacggtgttatgttttcgatgccttcgatgctaggctaaagaagataggcttccttagtgaggccataggaacccatggcagatttttgaggtaggaagtgataagtaatgtcactcatttatttaagcagctagtcaagctcgcttagttccaaatagctgcttgaccttgcctagttccaaataattgacttaaaattaacaagttgacatttattaaacagtactttttacagtttaattgttcaccactttagactaaattttttctacaggtggtgcaagttaattagattttcttataatgagaaagaaaagcatttcagtacagtgtcttctgttctgatattcaaggtcatttcctatataaaagtaaaattctacacagcataaaaccatcctttttgacatttagggaccataggttttaataacattgaacaaagggttaaattttttaaaaagtttttgtacactctttctttggtatgcttcatctctttcatttgagctgaacagctttaaatttcacttaaagaaatgctagataaagagaagaacattgtataagggcaactaagtgaacaggaagctgtgcttctcagaatggggagattttaaaatagaggagaaagctgtcaaagcaaaagtatagcagcctcagctttacttgggaatttattagaaatgcagattgttagactctaccccagaagtcctgtgggcggggctggcaatctgtgttgtaagcgagaaagactaatctaaaccactgatcaagggagggggatgttaagacttactgcagaaaagaggtgagaaattgtactaacagttactgttaattcaacacttactttgtaatgcacattttacagatacagcttatgtaatcttttatgtcaaccctaggaagtataatattacaatatcttactatatagatgagcagaaaagaatggtttaagaagtagcattgcaaaacttccggcatggaaggtgtctttgactctatactctgacctctttaaatcgtgctaggccatgcaggtatgttgtttgtctcccagaaggcagcggtggggctaaggcagcacccacctctctgctccctctgctgcattccccagcctccctgactgaggtaggtatttcttccttcctgcatccaggtggagcctgcctggtccagtgaaggaagcagaacaggaatggcaggaaaccagctttttctgtttctctggagttctcttaacaaaccctgtgaccctaggcctgtctcttggtatctctatgccttatttattttcagcggtaaaatgaggactgggataaatctgtaggttctttctgaattttatctggctctagcacttaattagagacagatggtcaaactaggtgacctctcaagggttcattctggttcgtgttgagaggagtttgatattggaaataatagattcttgtttatgtgcgaaatggagacagtactttctggaaatggtgtgatgcaaagtgaaatcatgtctgtgaagtccctagtagcctgcctggcatacatggaaggtgctcagtaaatggtagttcctcagtccccaagaggaaaacagccgcattcctgattctggtgttttctttccttaagttttaacaggttagtattttaattttcctctcaaggagggaataagaggtgctaggtttgtattaaaatattaagttaattaaagcttcctattaaaattttaagagagaggaagagaatggggcaacatgaccacaataaataaagcaaataggtcattatgtttccaaatggcattatcccttgactgttggtagctttcctaataataataggttgaaaaaatgttactgtaacataaataataaaagatacttatggtagtactctgctaagtactatatagacatgagatacttaataacttttaatatcatggtttggcaaaagaaacttcacaatggattaactatttatttggtgaacttaacttggggcaggcttgtgggtggaatttaagggttatttcttcttttttttttttttgctcccccggagacggagtttcactcttgttgcccaggctggactgcaatggcgtgatctcaggtcactggaacctctgcctcccgggttcaagcaattctcccacctcagcctcccgagtagctgagattacaggctcccgccaccatgcccagctaatttttcttattttagtagagatgggattttgccatgttagccaggctggtctcaaactcctgacctcaggtgatccacccacctcggcctcccaaagcgctgggattacaggcgtgagccactgtgcccagccgagttgtttcttccctaatttctctcacaaaccttccttttatatagagaaaacatttttacttttcatttgaaatattcttattgttgtttttttctgatcattactgatgtaccttctatagaaataagacacatatttggcagggcacagtggctcatgcctgtaatcccagcactttgggaggccaaggagggcggatcacgaggtcaagagatcaagaacatcctggccaaccaacgtgatgaaaccctgtctctactaaaaatacaaaaattatctggacatcgtggcacacgcctgtagtcccagctactcaggaggctgaggcaggagaatcgcttgaacccaggaggcagaggttgcagtgagccaagatcacgccactgcactccagcccaggtgacagagcgagactccgtctcaaaaaaaaaaaaaaaggaagaaataagacacatatttatcccaacgtacattgtttttcacaagttgcaatttgatatccttagctagtttcatcattctaccgtgacatttatccccattatgacatttctaaattatagtgcttctctctcatgttacgcatgtttctaagctcttggttggaatctgtaaaatagctagttgttaacatttaataaaatttagacttacctcaccttactctgttagcaaagagttacatgaactctgttgttttgaattaagaggtcagttgtggcagtaaacctgggtagaatttggaaaggaactaggctacttcctttttgattcttccttattaggtcatttgtcaagtggatacattatcttctttccctgagggcaggagaccatcttagttcccttctgttaaagagatctatgattcattacttccagtgtgaaggccaggtgcttttgcatgagttgtaaactgctaagcgagcccttttgtgccttgtttgtgtatgagagtctttctcttcagagtgtagggcaacctgtccccaaccagtcccctttcccaacatccccacccacagtgtgatggatgctggcagtcataccacattcaacatttccaagtgggacttgtttttattggatatgatcaccaaaaaaatttgaatttagatgagaaacaaatcaaggggtggttattcacattgccgatgggttttgggttttgtttttttttttttccttcaaaatggttcagcctaggggttctttaaatagcaagttgctctgctagatttaaatgggatttgatatataaaaatccatttacacatttaacaggatgttatgttggtataccagaatgatgaagagcaaaattctggagtcttaaacccaagcaagtttagaatcccagctttctcgtatcctggcttgtgtgatcatgggcgagttatttaacttctctcagcctcggttttctcactggtaaaccagagatcatagcacctcatagatagcacttctggagtgttttgaatggcagaaacagaaagtgtcgtgtaagacaacacatgcattgtgtaaggaaagtcttagatgtctaacacagcagtggcagtgttcattttcagggccattttgcctgagtttttgttaggcccttctctcttttcttctttgaatgtatttgtaaacttgaaaagaacaccgcgaaaagagctcaggatcctgctcagccacacttcacctgctctccagcttggcatgattgattgtcaggaaggcataaagaactcaaaccatgaattaccctactcggggtaatcacaatggtttggatggcatctccttaatttttgctttgacttttctttcctccgggcaagagagagtagaaggagtggcaagagtatgccttttagttactgagttctaaattcttggaatgagcatagtctgttttctcaggatcagactagaaggcgtcattctattacagaagagccaagacttgtcccaaatggatgtgggtttcagcaaagcatctttagcttaaggagcgaaggatttggactgtgttcagcatctgtgcttcgcaggccactctttatccttttagtgagtcccgcttgtctgtcctctgtcaagggctcgtgtacaccatgctgatttagtgctaactggggagattacaaatgccttgcctggcactgtcagctaaacctgaatcattgtctgtgtactgtgacccgactagtcagaggtttaccctttgctttgctgctcactcttataggcagaaaagcccagctcaccccagcttttataacggggtcagctccagaaatagcacctttaactgggaatagaagcaacacaaatccagcaagtagatagtatacaatggctgctttttggccttggaacaaacaaaagtggtttatgtttactacataccacttccaaaactgctgtctgtcatttactagagagtttatcattcctgagggccaaggtctaggttttcttcacacaaatgccctccaagtgggagctgcttggtgttggtcattgtttgcacccagatttataatttggggttaattagacataaagacttaaaggcaaatgtggtacctgatggaccatgggtagataagacacctcccaaaatggatggtgaaattctttttaagagtcatagtatggagaaagtccccttgtgaagctttgtgttggagcctagaattgtaatgtatggcactattagacttccaaaaccaatgtgaacttcagtcgtttgtatcatgatttgctttatcctatgttcctatctttcccggtagtaggtattactttgtctgtgggttacatgtctttctcctctaagatttaacctggggattattacatgcatatttatatgcccagagacaatagtaggcgctcatcaattgttgaataaatgaatgaatgaatgaccaaatgattgaacaaacaaaggagcaagtgaacaaacagagatgtgaagtggtggggggcatttctatatgattgtgtgtaaagagcaccctaacacagcatctgaacaaatcactcttggaaatctgttcaatcccaccaccttcactagctattcctgtgaaccccaaccctcccctagatacattttggtgatatattagattattttttctttgcctccctcctaccatgataaaaaggatattgaatggccaaaccagtgcattacagtaacatgaaagaaatgtttatctttcatctaccagaattcaaggaaaaaaaccacaaaactttgtcagctagatactttcctgaattgttttttaaaattgtttaaaaaattattattattgccaggcacggtggctaacacctgtaatcccagcactttgggaggctgaggcaggtggatcacctgaggtcaggagttcaagaccagcccgagtaacatggtgaaaccccatccctactgaaaatacaaaaaatttagctgggtgtggtggcaccatgcctgtaataccagctactcaggaggctgaggcaggagaattgcttgaacccgagaggcggaggttatggtgagccgagatggtgccactgcactccagtctgagcaaccagagtgaaactccatctcaaaaaaatatatatatattattatttttaatagggtcccaccctgtcacccagtctagaatgcagtggcacaattatagcctacagcagcctgaaattcttggtctcagggaatcctcccacctcagcctcttgggtagctaggactgcaggtgtatgctaccatgcacagctatttaataacagttttttttagagagggagcgttgctttgttgttcagactggtctcaaattcccggcttcatgcgattcccctgcctcagcctccttctcaggtagctggtattgtatgaattgtgttttgaataagaagaaattaaggcttataagatcagttgtgtgttagcagcgatgttgctgactgatctttgcaatctgtaggactatttggtgctacaataataagaaattaatcagtttgataattttgccatcatttttaaaaaattttgtaaaataattgaaaatcatatgtgcaatatcttataaatttttattttcaaagcacattcctatatggcaattgaagtacagtttgaacttacttttgactaccttcttaatagtgattgatcataaattataaaattttcacttaccaaattatgtttaaaaagctaaatttaacattttctttttaattttggagttgaatggtcctttattccagtctttgtttttgtttttttccaagggaagacaaatatttaagttcaaagtcatgtttaatagaggaaatgaatgaaaagtggatgtctgttatctgtttgcaacaatcatctttatgtcctagtaaaagtttaattttaaaatctaactttacagatctatacccagtaaatttttttttttttttttttcaaacagagtcttgctctgtcacccaggctggagtgcaatggcgctgtgtcggctcactgcactccgtctcccgggttcaagcgattcttctgcttcagccctcctgaatagctggtactacaggtgcatgccaccacacccagctaatttttgtatttttagtagagacagggtttcactatgttggccaggctggtcttgaactcctgacctcaggtgatctgcctacctcagcctcccaaagtgctggggttacaggcatgagccgccactcctggcccccagtaaataattttaagaatcttaaagttactcatttttacttagactttatgagattaagctattttcaaactcacttctatttgtcctcccctgagagctatttacaaatttgtatagcactctggagtgtgataatatcgaagtcaatgcacagtcaggaggcttgttaacttatgtgatgatgtcagttttgataaacatctttctcatttaggcatttaatgataatcatttcttcaagaaaaagttcttagtggggaaaaagaggcgaaaagtacagtgtgattaacttatgatgcattttggattacagccttttaaccaaaagagaatcatcattaaaacaataattcctcagaaggcttgaggcatttaacttctcttaattaaattagctcagtttactgccagtcaataaagtctggtttggaatgatgatagaaattaaatatctaagaatgcagtatacataatagttaaagaaatgcaattaaaagtaataaggaggtactacttttcacttaggaaattaataatgatttatagaagtgagactactaacttctgggaaaaatatagtgagactgtcacttttatacaccactagaaagcccttttataatgtttgtcaagattcttcaaaatactaatagcttttgatccattaattctttgtctaggacatgctgagttggtgatcagatgtgaagaaaacttcaggccaggcttggtggctcacgcctgtaatcccagcactttggtagttcaaggtgggagcatcgcttgagcaaaggagttcaagaccagtctgggcaacatagagagatcccatctctacaaataatttaagaaatgaaattagctgggagtggtggcacatgcctgtggtcccagcttacttgcaggactaaggcaggaggatcacctgagcctgggagattgaggctaaagtgagcccgtgatcacaccactgctccccagcccaggtgacagagtgagcacctgtctaaaaaaaaaaaaaacctggaaaaagaaaaacttcatacagccaaaatacccaacatcatgcaaatgcatggttgatttatgttattttctattttggaatattatgcagaggttaaataataagtgcacataatatttactacaaggcagaatatttgctatatcttaattttactaaaaagtgtaacatataataatatttgaattatgtatggaaaaagagagtgagaacaagaatgaattgaaaacagaaagaaaatgcacccagatgtttacagtcagtgattatgttctgactggcaaaacataagtagattttttttttcttttttttttttttgagagagatggagtcttgcttgtggcccaggctggagtgcagtggcgccatctcagctgactgcaagctccccatcccaggttcacaccattctcctgcctcagcctcctgagtagctgagactacaggcacctgccaccccacccggctaatttttttttttttgtatttttagtggaaacggagtttaaccgtgttagccaggatggtcttgatctcctgacttcgtgatctgcccgccttggcctcccaaagtgctgagattacaggcgtgagccactgtgcccggccataagtagatttattttctaaaataagtgcatattacacttatgataaaaattatcatcatgaaagattttatgttcaaggatttcatatagctgctttgtatttcttctggcacattacagtcatagtggcagtgacttgtagggacattgtcctgatacttcgagtgcaattgatgatatttgtttaatagtgaatgtagcttaagaaaagaaaagcaatcaaacaacaaggtgattaatgtagccacttcaactcctcagatctttggctgacatgttttcctagcaaagcagaggtacttaactaaccacagagaaatgctcacacatgtcagaaggaaatccaagtgatcacttgttttgccttgggcatctgcactttttatataagtatgactttcagtctgtgagacctttcgataagtagtgataatccagaaggattgatgtagtgattctggacttgagatttcttttcaccactaagacatttgactgtcacttgcatcttaatgcgtccatataattttctaaagcattgggggactgactaggtaaagtcactgtggccttttaagtatgtggccagctgatctcatggcctaccagggcttccaagtgattagtggggattggcaagaattgacctctttggagcctggggaggcagaagtacctcagtaatagggttcagggagaccatacatggagcatagctctctctgactttcaagtggatagagctagtaggcctctactcattgtggtgtttgtgatcagacaacccttgctttggaatcactcttcgttgagagatactgagtccaggatgtgccaagcaagattgtagatactctcacagatgaattcacccattcatttattgagcacttgattttttaggagtacaacttcatcattaatttcctagctgtgtcatacaggatcagttaggttagattctccctttgtaattaatcctaattgctgggactttcatgtttctaataaatgtctattcccataatcctgtcctacattagctttcttcatgttgttctgtgagatctatagtaagcagatgacactgcttattatagattagctacttcctgtgtaataaatcaattattcctctcaatagggacaatcttgaattaaaatcacatttttttcttagagaattctctgtcaaattctatcaaaggccatggttttttttgtttttttttttttcctgtccagagacaccttattaatgacttgattttatccttatttcaaattctaattcatgaatatcagggtataaaatattaaatatgctggttcagctaccagcttttcaagcatcattggggaacatcctgttatataataggaaaacatttggtatggcttttgggatgtagatcatttttataattattatagggagtaaaaaatgcagaataaaaaataatttaaatataattagaagtgagagcaggtcagtatgaccaagaatataaatcataaatctctctatttttgtgttcctttatttcatgcagagaaataccaaacctttgtttctaaaagggcaccaggtctttcagaaagctgtggttctcagcagcaattttagttaggtttcgtttcatgttttctggtattctgggcctcccaatagccatttgtgcctaaaagagagagaggatgaggagatttgggttgcttgtactgccagcctggtggcactctggggatattagatgtgttctgaggatatatgtgtttatttaaatttaaacagaaagtatttcaatggatgctgggcgcagtggcctgtagtcccagcactttgggaggctgagttgggtagatgacctgaggtcaagagtttgagaccaacctggccaacatggcaaaaccccgtctcttaaaaaaaaaaaaaaaaaaaaattagccaggtgtggtggtgcatgcctgtaattccagctgctctggaggctgaggcaggagaatcgcttgaacccgggaggcggagtttgcagtgagcagagattgcgccactgcacttcagcctgggcgataagcaagactgtgtctcaaaagaggctaggcgcagtggcttacgcctataatcccagcactttgggaggctgaggagggtggatcatgaggtcaagagatcgagaccatccatggctaacacggtgaaaccccgtctctactaaaaatacaaaaaattagccgagcatggttgtggtggcacacacctgtagtcccagctactcgggaggctgaggcaggagaatcgcttgaacctgggaggtggaggttgcggtgagccgcgatcaagatcatgccactgcgctctagcccgggcgacacagggagactccatctgaaaaaaaaaaaaaaaagaaagggagagagggagggagggaggatttcaatgggacagaaattcaccaggtacattagaaagccttaacacttgagaatgtgaagtcttaaaaaaaatttttttaatagtttgggttacttaaaatgaaatactgtactgaagcagatagaaggactcttaggacctttctgtgtttcttctgtacctaatggcatataataaattcactgttttgtttaaatgatcagttgacttgagctttctgtcatctgctcagaaacactactttaggaatcttattccatttgggaattctgactagaagctctcccagggtcatcatatgaatgagtaacttacttcgcagctctcctcttcctcagtagctgcttctctgtagggctggagggaaagagagtcttccatgcagtctcatcagccaagaggaaggagatgctggtacctggtctgcatcccaacagacagcacaccctcatgccttccccttgaatgtacctttttggctcttcctcattcctggggaaatgtaatagttcttgattgttcacagtgttgactgctccctacaatgtgaggttccccctctcctctcccacagatggcacagagaaagtgcttatcatcgacacagtagtggggaaaaaaatggattctcattttagcaggtgacttgagggtggttggttgtcagtgtgctttttttcatattggcttgttgctacagggtctgatgctggcagattacaactttgtagctagtcattttcgatttatttgaacctatttctccagtctactgagctttcactggctagcatcaattcagacacattgcaattcttcagaatctctatccccatcagatggttcgatctatgagaaatttagctagaggcgtttagacaaaaaagaaatattgtggctggggaagcatttaagttagaggaggcagccagggctgttttattacttagtcctgtgtcacctgtgatgacccatgagagtggagaatattgatcgcttgtcactcaaggcattcagcagattgcattgacaaagcttggcaggtctctaatagcagggttactggccttgctgcggcccaagggaaaactctgcaggccctattacttggcggcctttaactcttatagaattgggagagaacactgacaaaagcgaggacatgattttacggttacaaatgatttttcttgcttgctttcttctcaccctttttaatttttcttttcttcttttcctgtctatcttaccttccctccgtgatccctgccagcccctcctttcttattatagctgatcatggcagtattgtttttttctgggtaaaaatcagagtggattagagaaagcttagcaggcctagcatgaggcctgagttattctctccttttaggacagcttgtgcctgaccacattgtttggaatgtgcctgtggatatatatacagtacttgaacttgatgtgtaggccattcacagctgttgtcctctagtagaataagaactgccacttcatgacagatgggtttctctcgttttccatttcctggtagccaggcttggttcaagcctttgaccttacatagtcccgaggttcagctgaaagtaatgtgctgacatcagagagataatggcactagtgcaaaacaggaatgattctaaaaaaacagtagagaggattctatctttcctagacactgcctgatttatgcacaggttcgaatcaccaccattaatgacattttcattcctaacataggttggcctcctgttggacactgttgtgtaatgagcgtttctgcatggctgtcatttgctttatgaagcattctttttatttctattttctgtgtacctttcatttaaaaaaatatcgtgtttgttatctccattgtctctttgaggatgagaaagacaaatatcattacccccatttcaaagaagagtaagttctaatcacaagtgatttaaatgttagagtttcattcaatattttcactaaaatttctagtcctctagtaaatcagatataagcaaagatcatatgtctatttcagcctctaggtaggctggccagctttcttgctttctccctctcccctcccctcccctcccttcccctcccctctcctcccctcccttcccctcccctctcctcccctcctttctcctctccttttttttttctgtagtcttgtactggtcaccccttcacttcctcttcctttgcaatgctttaggctgcccaaaaggttctagccagatgaacagaaacagaggagaggagagcttcttaagaggctggtaggccaggtgcaatggctcatgcctgtaatcccagcactttgggaagccgaggtgggcagatcacctgaggtcaggagttcgagaccagcctgaccaacatggtgaaaccccgtctctactaaaaatacaggaattagctgggcatgatggcgcacacctgtaatcccagctactcggggggctgtggcaggagaattacttgaacccaggaggtggaggctgcagtgagctgagatcacaccactgcactccagcctgggtgacaaagtgagacctcatctcaaaaaaaaaaaaaaaaaaatgggatgggtcagccttgagtagtggacatggcctttgcatttatattccaacattttgccacagatgagttatgtattattggcagattacttaatctctctgagcctttgtttctccatttatcgaatggaaggtaatattgtttaccaaaaaaagtgaattatgtggtatatggattatttctcaataaaaaatatgagttgtgtaaagtttctaacatagaaatgccctcctttgcttccttcctccttatacaactaagggcccacaaaggcagaatgagaattaccatctaggccaatactggggaaatatgtgctactactggagacagaaatgtggaagtattgcaaacgaatgtggacctattaatattctatagcactttgagccactttgaattaaaatacttatctgtgaaaggttttataatttatatgacctgaaataatttacacctaattagattttgtcaactgaataattctgtctcatgttgcttccacagaataatttaagcaactgcattttattctcaaaatagctgtaaatgtcaaattaattttgttgacatgatcaacatgtagaagagctacttggcagaattgtttgtcaactgaatgtattatgcatctttacaaaatatgtagattgattatggtttagctgacttttgcagtttgttggtctcctggaaagaagtaacgggtggtggttacaaaaaccgttatggcatttctgttcatctggctagaaacttttcgatatctgtaagttttccttcacttttcattatatagaccatgtctttcccttgggtgttatcttttttgtctgggtgagactggatcccacgtaactgctttggtgtttgttatactcctcattaattttatggggctcttagttgacactggccacataaaaatgattgttgagtctcactctttttattttggaccatttctttcatgtgggagcctctttatccctctccttaaaaaccctgtttaaggattagtgtccttgcagtttagttgtagcttactcaagttatcccatttattccaaaatcccttttccactccattataccctgtctagtccggtcttctagctactaagattgaagtcctgtcatcttcaggtttggttgaatccagtgcttcccaaccctgtctcatcatggcacatgtagaaaatgatattattgtacagcacacggaagtaaatcaagaccttttgctgtggaggtacctggctcagaggccatgacctgccttaagtaggagggaatacatgcatactatcctgtatgttttggtgtaaccaatccccaaatttgaaccaatcttggcaggtattagaaatttgcttatttggtgacatctggaatttacctcctcttttgagctcagtatttcatgtactttaaggtcattactgagctttctaccaaatcattcccatttgtgtctagtcattagataattcagatttctaccttggatgccttgaagtgatgacaccttacccttgctcatctctctcccaagggaataaacctgtattttgctttcagcttctgcttagaggagctggctccatccagaacaattcccctcccactggacatcaaaagattgcatttccattggcaacaagtctcaacatagctcagaaactactgttgactacttgtctcccctataacaatattggatccattggagagtgaatcagtgtctccctcaagttcagcccactcatttagatttttcattttagactccgtgggaaggatgtcccagtgcagagttggcctctgtacccctgattatgtttcagctttctctaatttctctgctaacctgctgttgatgcccctaaaggcactcaatattgagtgtgctttataaatacatgaactacatgtattttatgaaaacataaactacaaatacgttaaaatatactgtagattcattactaaaaggcattatctattcagtatccttaatgtacaaataataaaagagatatgaaaccctgtgtctagagctaaaaatataccttgacagtacaaatacacatggctaaaaggcattatctttttagtatcttcaatgtacaaataatcaaaaggtctgaatacttctgattttcataatggagaaggggaattgtagaaactgtagaccaattagcttgatgtcagctcagaaaagattctagaaaatattattaatgaatgctttctgagagtttaataaaagaagtagtcatcactgggaacctgtggaggttcacttaaaatgttatgccatctatattccttcttctgcagcagagattgccaaactttttctatacatagccagatagtaaatattttaggttttttgggccatacagtctctggtacagctactcaactctgccactgtagcaggaaagcagccacataggcagtatgtaaacagatggatgtggatgtgttctaataaaataacttaatttataaaaacaggcagcaggctgatttggccaattggccatcgtttaccaacccctgctttagaagaatatcttagataatgtgtacctgatatattctattcttctttctgatgggaaatactttctctttttttggcgtaaagacgttttattttctttgctaataaagagttggcataaaaaaaagcatcgcattaaaatcttcataaaggacatggaaaaggctcaagttaataatagtttacagtaagttctcacttaatgttgtcagtcatttcttggacactgctaccttaagcaaaatgatatataatgaaactaatctttttttctcaccaacattgtagtgaaaagatgttgaacaaaaagacgttatccaaggatgtaaatcatttaatttaaagttgcagtttccaagaacctattgactgtgctaagtgaggacttactgtagttaggtagaattataacaggtttaataattatgaaacatgaagagtggtctgtggttgcaggccacaggctgtgtgctcttgattcaattatgtcaatatttttattagtgacttgactgaggttggaattgacttgtggatcaaatgtgtggatagcctgatgaagagagagatcacttacactttgggtgataggagtaagatcccaaaaggccttaggatagcagctgaaatctttcaggcttaaatgttgaaaacagataaatgggaaaccctgtgtctggagctaagaatgtatcttgacagtacaaatacaaattgtgaaaacatagttgaatagcagcctgtttgaacaaagctaagagagtatttcaattagagtgcttgcagagaaagttatccaggtggttgaagggactcagaatcatgtcctattagaaatggttgaaagaagtgtagatatatagcctagggggatatatgataactgtcttcaattatttaaagggctgtcatgtagaagaggaattagacttattctggggggtcctggaggacacaggggagagcagtgggtagaagatacaggtagattcaatatgtaaataggaactttctaacaatttgagctgtccattagagggatgggcattatttagagggtttaagtcactggcaatattgtagacatctgttgctgaccttgtggggatgttgtgagagaatattagctttgactcattattggatgggatggttcttatggtcactaacaattctgagagtgcgtaaaaggtaggccgagggataatgtgctgcgccctacgtcccagtagttggcaaagtccaaacccagatgttttgagtctcctgccttgtttatatggttgaaatgctgactttacacagtgttccatatatgtatctgtacctgtcatctttatgtgattggctagagaccctgtcacgttcacttttgtaatctcacaaagcttgacaaatgccctgtacataggaggagcaaagtgtttgttgacctaaagtgaattacagaacagctgagacacatctaaatattgttcttttactgatcctggttccataatgaaaacatttggaagttgaccagaaattatacctggggattcctagtagaatggtgatgtagatggaacggctctctgcctttgtttctgtctgtggtacaccacacacaaatgccaacacttcaccaagagtggaagccatcaggctgcactctctgaccaggattgttttaccccttctggatggcaatacatcgctccctttctttttcactgcctcctgtgcatacctccgtgctaaattaaactccagaccctgggatgtctggaatatattttccagtcttctgaattctaccaccctgaagtagtcatttgctgtcatcataattctggaagatttaatattcagattgacagtggatatgccggtctcattctttgatgtttggtacatgggcaagtggtcaggtatcctggcctatttatcaccatattctccatggcctgtactcagggtcaggcatatggtaggtagtcagtgaatgtttgtttttgttagtaggactctggtttagtccttacagtagtcccttttatccatgttggtatgttccaagacacccagtggatacctgaaactgtggacagtaccaaaccctttccatactgtttttttttaatatgataaccaagacagctactaagtgactaacaggcaggtagcatatacaccatgctggacaaagagatgattctcatcctgggtggacagatcaggacaacgtgagaatttcatcttgcaactcaaaatactgcctaatttaaaatgtattgacgaattgtttatttctggagttttccatgtaatatttttggactgtggttgctcatgggtgactgaaaccacagataaggggtactactgtacttctgtttcatcctaatgaagtaaagtttctttgttcatcaaggcagtattttctttctcttttgtacctaccatgctctacctacctcatgtcttcattttctgtgccactttcttgctgtgttttattaggataatgttttaatagaataaaagaagggcaaaggtatagtaattgaatgtccttcactatcaatccccccaacccctgaagggagaaaggaaggagaatgtgggggagaggggaaggaagaaaggaaatggtggagaaagtagagaatgagagaagcatcctgtttcatactgagaagactttggtattgaagaattttgactttgttagtgccatataacttgtgtgttgctttgtttaaattctcgtctgctctcatgttttcattgcattctgtggatagcagctaagagagctttcagacacatctgtattagaagtaaaataactgttaatgtcaagactatatctttgcttttttctccctcagcttcttttctcgattggtagaaaacatggaataatggtgccagggttagctttgcctggagaagagttctgtttgccagccctgctgcagattgataaccatcaagggaaggatagcccagtcataagtgaccttgtggactgcgtatctttatgtaccccttacacactagtaggaagaacccaaataccatctgccaatgacagtgaggcaggaacctcacttttgtgacaaaaggattgtactttgctctgctggaactggctcgttaacaattcataagaaccaattaagttttcaagaattttgtgagctggttttttagtaaaacctttattagaagttaagttatattaaaaaaaataattagatgggtatggtggcaggctcctgtaatcccaactgcttgggaggctgagacaggagaattacttaaacccaggagatggaggttacagtgagctgagatggcaccactgcactccagtctgggcaacagacagaaactccatctcaaaaaataaaaaaaagttatgtaaacttacctgtgcttttaatataatttacttaattgtaatcagtattcaaaattcatcacttccttattagctgctacattttactaatatccatgaccttgaggttatttacatctagtatatggtagaaatactacaaaatgatgtgttattgagcctcttttcctaactctgtattcaatgacatcactttagtagccatggtggaagtatttacaccacagaaattggtaaacaggatgtcttattctgttttgttctgctgtaacagaacaccgcaaactgagtaatttataagcaatagaagtttatttggcagatggttctggagactgggaagttcaagatcaaggggccatatctggtgaggaccttcttgctgtatcacagtgtggcagaagacatcacatggtgagagaacatgctcaagagagtttgaagctcttttataatcagcattaatccattcatgagggtagagccctcatgacctaaacatttcccattatgttccatctcccaacactgttgcacttggggttaagtttgcaacacatgcttttggggggacacattcaaaccatagcactgtacaaatccaaatttggtcatttgttttgttgattgtctacacttaaaagaatgatggaggaaatgttattaatacagattaaatttaaaagtatgttgtatttgcatccattacattgtggatagcaaaacaattaagagaatatcttcttgtattttgaaactgtttccaactcaacaaagaagttattcatgtcctcgaggaaggaaactgtttatatcattcatgtcttaggtgttccactttaattttactggttcaaaaacatcaaccaggttttacaaaactacactcattcttcaggtacaaccataggttggctgtagatataagaattgcacatattttaacagaagcattctgtgaatgttaattttcccatttggttggaattcacagtaaagtttagcatgtactttgttattatttgtaaattgcttgctatacatgatttatatcagtaaattttataataaataggtgtacatctatacatacatacttcttttcccaaggagctggttgttaagtattaccaacacactactgtttacaatccaaatgagaatgtagctctgtgtcttaaggtagtgatgatcttgtgtaaatggtgagatttttgccttcatcatagcaaaaggctcaaatgcactataggaaggaaacctttctgattatggaatatgaagtcaggattttaaatgccaccaactgtcgaacacttaaaggacaaagtgtttgaaatcttaaagcctgcctactctatttaaaagaacattagagggcgttggaaagaggtgataaatatcattaggacctcagcaaggctttggaacccaacacattgaaagataattgagtgaagaggatctctggacacaaagcaggcaatttagttatccaaagcatttatgtcaagcagctaatgcgtgaggatttatttatttgtgtttttctctcagagcttaatccatgaggagtacagagtggtggtagggtggaggctagcctttattttgcattgctctgagaagtgttgcgataatgggagaaatttggtgtcctagaaacgttattattataaatgaaaaatcttgaaatacgaggaaagtgaattttttaaaactgggattagaaactcagaacaaaatgagctggacgcgctggtcatgcctgtaatcccagcactttgggagtccaggaagggcggattacttgaggtcaggagtttgagaccagcctagccaacatggcgaaaccccgtctctataaaaaaaaaaaaaaaaaaaaaaaatcagctggatatggtggtgggtgcctgtaatcccagctgctcaggaggctgagtcaggagaatcgcttgaacccgggagatggaggttgtagtgagccaagatcatgccagtatactccagtctgggcaacagagcaagactccatctcaaaaaagaaagaaggaaaaaaaagaaactgagaacaaaatggtcttttgcctctttctacttaaataagatggctcatgcaaaactatatttttgtgtgagatttttggttaacaagaagttgtatttccgttcatcagttagactcagtgtggaggaatgttttgtttaacctactttaactagaaacaaaatgtatttgcagaagtttataggtagaattataaggtgatctaataaacttgaaggttactttcagcatatggaaatcagaattttgttagtggaatggcaaatgtgaagaatgaaaaatccagttgatgccagttaacattaacttttaggaaagaaaaaacggtagatttttctgtgaagagtgtgtgtgtgtgtgtgtgtgtgtgtgtgtgcgcgcgcctgtgtgtgtgtttaaattagatttttctgtgaagagtgtgtgtgcctgtgtgtgtgtttaaaatttagctcatctggttctgtgttgtgtgttttctctgtgtgtgtttgaaaggggacatattatgaacgttatggttccctacctctaagatccattcctaaaatagttttactaatccgaagaatgactaagaatgtaactatggaaataaaatgacttttcaatcctgtgttgactacgtgcctaaaatgttgatttgctaaaacctggtacttccaaattaaatttcatggtatatggatgatttattgtaatctcttgtgaggaaattcatcttaaaaactttttcgaaatcatcctaagtttgggagaggagagcatttctaattcaaagcaggagtcaggctaagatcacatgtctccctagaggaaagaggggaggttttacttgtgcatatgttttttaaatatttatagatacagctggacttttagtactttagttctggttttaatgatggaattcccaaaggactaaaattgttccaaatgtctgaaccgtgtctgaagttcaagaacagtatatggttggtctgaagactttaatcctagttggaaactttgaatgagaaacctggccttttagtcttgtatttcttgaactttctgttaacagaatatctcctcgccttttatgtagcccttaactagctgcagactgacttggtcttctctagtaaagcattttctatgtaaggtcaccagtaaatttctttttgtcaacagagtaccttcttgcctcctattcagccgttaactgttttgtactgacttggtcttctctactaaagcattttgtatataaggtcaccagtaaatttctaagtcataaaattaagtgatttttcttatttcccatctatccagtcaacagtcattttattcagtacctactgtgtgacttggtgctagggattcattagtaaacaaagcaggaatattcttttacaatgtggagctttcaattttctgaccctgttgaccttccttcttcaaatttcataaactcgcttacttctggttagtgaaatcaatgatgattattttaataatgattcctcccctcatgattgtgctcagggccctctctttccctgatgattgtttttcttgatactttgtggatgattttatatggctaagacttccaggttgtcatctgcccatacacagaggaagtcctgagggaacccacgagtttcctctcactgcttccgtgctgtgtaggcaccttctcctgttagaaaaccatcaataggagcttccatgatcatggtggaggcggcaaatagtgtgtattttgcagggataaggcagcgaggacaagttgcctctatctactttagccagaagattagtactaatttctaaaactttcaaatttgtctttaaaaaattgcacccatatagcatatacatttagttgtatgcacacacacactaaaataaacttctttgtatacagtgatttggtataatcttaggacgattgtattttccttttgtttgtaacaactttattgagatataattggcatataatgaactgatcatatttaaactatacaacttgataagttttgacatgcatacacctatagaaccaacacaatcaaggtaatgaacaggctaggtgtgatggcttacacctgtaatcccagcattttggaaggctgaggaagcagaatcacttgagcccagaagttcaagatgagcctgggcaacactggaaaactctctcactacaaaaaaattaaaaattagctgggtatgttggttcgtatctgtagtcccagctactcaggaggctgaggtgggaggattgcttgagcccaagaggtcaagactgcagtaagccttgatcatgacactgtattttagcttgggtgatagagcgagattccatctcaaagaaaaaaaaatgaatatatccatcacccccaaaagtttcctcctttctctttgtaattcctttctcccccacctcccttccatctccaccccagcttattccctggcaaaaaaacaaaacaaacaaacaaaaaaaacaaaaaacaaaaacaaattaactgttttttgtcactataaagttgtatacatttttctagaattgcatataaatggcattacatagcacatactgtttgtccttttttttggaggagggggggttctggcttctttcactcatattatgcttatccacattgtgctgtatataatgtttcacaatattactcaatttatggatataccatagtgtgtgtttatacattggactgttttcagtttttgttattatgtataatgcagctatgaacatttatgtaagagtacaatgtacattctcttggacaaataagagtggaatggctggataatgtactaggtatatgctaaatgttctaagaaactgccaaacaataatcaaagtggttgtaccattttatatgctcaccagcagtgtgtaagagtcccattgtttccatatccttgccaatacttgttatgggcagtcttttccattttgccatcctaataggtatatagtgctatctcattgtggtcttgaattgcatttccctaatgaataatcatgttgagcaccttttcatgtgtgatttttcatctgtatatcttttttggtgaattctgtttatatcttttgccaatttttaaaaattacatttttttcttgagtgtcgagttctttattctgtatacaagacctttatcggatatatggtatacaaatatttgcttccagtgtgttgtttgtctttttattctcttaacagcgtcttacaagataagaggtttcaaggttgttttttaatttttatttaatttttagagataggatcttgctctgtcacccaggctggagtgcagtggcatggttatagctcaccgtaaccttgaactcctgggcttcagccatcatcccaccttggcctcctgactacctaggattacaggcacgaactaccctacccagctaattttttaaaaacttttttgtagagatagggtttcaccgtgttgccgtggctgttctcgaacttctgagctcaatcaatcctcctgcctcagtctcccaaagcaaaggtttcaaattgtggtgaatataatctatcaacttctttttatgggtcatccttttggtgtcatatctaagaaattatttacataccaaggatacagggttttcccttatgccttgctctggaagggttacagttttaacttttacatttatgtctgtgatccattttgagttaatttttgtatatgaaatgagacatatagtgaattcatttatttttgcatacttttttttttttttgagatggagtctcgctctgttgcgcaggctggagtgcagtggcacgatcttggctcactgcaacctccgcctctgtgttcaagcaattatccctgcctcagcctcctgagtagctggaattacaggtgcccgccaccacacccagctaatttttgtattttttagtagagacagggtttcaccatgttggccaggctgatcttgaactcctgacctcaggtgatccacctgcctcgccctcccaaagagctgggattacaggcatgagccaacatgcctagcctatttttacatacttctatacagttgttccagcatcatttcttaaaatgactgtcctttcttcagtgaattacctttgcatccttgtcaaaaatcagttgtttatttacatgtaggcctaattttcttcctttttactaatcaatttgtctgtcttgaggttgccaacccaaggcccatgggccaagaaaagctcacagcctgtctttgtatcatctgttagataagaatgcttttttctatttcttaagggttgtataaaaaaaaaaattaaaggaaatgtgacagaaaacatgtgtactgcaaagcctaaaatatttactgtctgaatcttctcagaaaaagaaaatttctaaacttgacctatcttgacaccaataccacgtcttgattattgtagttttataatctattaaaatcaggtaatgttagtcttccaacttactttttccttttcaaagttgttttggctattcttggccctttgcatttgtgtatgaattttagaatcactttgtaaatgtaaatttcttcaaaaagacctgctgggatttttattcatattgtattgaatctatagaccaatttcaaaaaattgatatcttagcagtattgagtcttttaactcataaacaaggtgtgtttctttatttctttagattttctttaacttctctcagaaaagttctgcagtggccgggcacaatggctcacgcctgtaatcctagcactttgggaggctgaggcaggtggatcacctgaggtcaggagttcaagaccagcctggccaacatgctgaaacccagcctctactaaaatacaaaaattagctggctataatggcgggtgcctgtaatcccagctacttgggaggctgagacgggagaattgcttgaacctgggaaacgatggttgcagtgagctgagatcgcgccactggactccagcctgggcagctgagtgagactccatctcaaaaaaaaaaaaaaaaaaaagttttgtagttttcaggttacaaatatttcacaacctttgtcagatttatcattatgtatttttgaagctgttgtaaatggcattgttttataaattttaatttctaattattccttgctgcaatgtaaatgtacagttaacttttgtatatttatcatatattctgtaatattggtaaactcacttattagtgttaatggctctttttaaaatttatttgtattgtatatatagttgataatgtcaaagaagagtaaatataattttccttttttttttttaatctggatgctttcatttcttttcttatattattgcactggctgcaatctctagtataatgttgaatggaagtggtgagagtgtacatgcgttttcattttaactcatattatggggaagcatttggtgatcttccattatttatgatgttagctgtaggttttctgcacatacctttatcagtttaaagaagtccctttctatttcacatttgctgaaagttttaatcaggaatggatgttggttttgtatcaaatgctatttattaatccattgaaatactcatttttttattttttagtttaatatggcaaatttaactgattttcaaattttttttataaaaacatgatatatttttataaaagtatattaaaaattattcgtatatatatagttgaacttaattagcctgtcattttctttttcttttttttttttttgagacagagtctcactcttgtagcccagtctggagtgcaatggcgtgatctcggctcactgcaacctccacctcccaggttcaaacaattctcctgccttagcctcctgagtagctgggattacaggtgcccaccaccacgcctggctaattttttgtgtttttagtagagatggggttttaccatgttagccaggatgctctcgatctcctgatcttgtgatctacccacctcggcctcccaaagtgctgggcttacaggtgtgagtccctgcgcacagcctattctgtcattttctttcattgtctttggtttctatatcaggataattctgacattatagaatatattgggaagtattcccttctctccaattttctgaagcagtttgtatagaatttatattattgtttccttaaatgtttggtaggatttatcagcgaagcccttgggcctggagttttctttataggaaattttaaactccaaattcaatttgtttaattgacaaagggcttttcaggttttctattttttcttaagtaacatttggtagtttgtatcttttctgagatttattatttctttaatattttgaaaatctgtgctgttgtaacctttcttattcttgatagtgacaattcatgtcttttttttttttttccaggtcagtgtggctagaggtctgtaagttttatcggtcttctcaaagaactaacttttggtttcattcatatttttgtttgtttgtttttgagatggagtcttgctctgtcgcccaggctggagtgcagtggcgtgatctcagatcactgcaagttccacctcctgggttcacaccattctcctgcctcagcctcccaagtagctgggactccaggcacccaccaccacgcctggctaaatttgtttttgtatttttagtagagatggggtttcaccatgttagccaggatcgtctcgatttcctgacctcgtgatcttcccgcctcagcctcccaaagtgctgggattacaggcatgagccaccgtgcctggccacaggtttcattcatattctttattgcctttcagttttctattttatttggtttctactcttatcgttgttatttcctgtattctacttacttttgctctctttttttttttttttagtttcttatgatggaagctgaaggcattgatctgagacccaccttgtttgtttgtttgtttgtttgttttgttttgttttgttttaaagacaaagtcttgctcttgtcccccaggctggcgtgcaatggcgcgatctcggctgactgcaacctccgcctcccaggttcaagcgattctcctgcctcagcctcccaagtagctgagattacaggcgcttaccaccatgcccagctaattttttgtatttttagtagagacggggtttcacaatgttggccaggtgtgagccaccgcgcctgtccgagacccatcttgctttctaatacagtttaatgctatttctccttcaagtattatactattttaggttcatcccacacattttgatatgctgtgttctcatttttatccatatcaaaatactttctaatttttctttaagtttactgagacttgctttgtgactcagactatggtctgtctttgtaaatattccatgtgtgcttgaaaacaatgtatattctgctgtcgttgggctgaatgttctataaatgtcaattatgcataatagtattttttaagtcttatatccttctcgattgtctatttatttgttctttcaattattaagaaaggggcattgaagtctccagctaatatttgttctatcaattattaacaatggagcattgaaatctccaactatagttatagattttttttatttctcctttgagttctatcagtttttgcttcacttattttgaagcttttttattaggacatttaagattgttgtattcttttcatgaattgactactttattattataaaatattctttgttctgaaatatattttgtctgctattgatatagctattgcagctcacttttgatagtgtcttttttcattcctttgcatttaacctatttgtgtccttatatttagagtccattttttttaagagaacttgttttggggtatttaggtctttataattctttttattgtgtctgacaatcttttgcctttttaattgtggatatttagactgtttatatactttcttgatatggttatgtttatatattttatcttattttttcctatgttcctctgtattctttacttacttttccacattttgtgccttttaaaaatcagttgagtatttttaaaggccgggagcagtgtctcacgcctgtaatcccagcactttgggaggccgaggcaggtggatcacttgaggtcaggagttcaaggccaccctgtccaacatggcgaaaccccgtctactaaaaatacaaaaattagctggatgtggtggtaggcgcctgtagtcccagctgcttgggaggctgaggcaggtgaattgcttgagcccaggaggtggaggttgcagtgagccaggatcgtgccattgcactccaagctgggaaagacagagagactgtttcaaaacaaataaataaataaataaataaataaataaataaatttaaaaataataataaaataaaatagaaatcaattatttttaatgattccattttatctcctttcttggcttattagctgtaggtctttgttttttggttttaattgttggttttggggttataccatatcttcaacttataccttcaagtgatatactacccattcatgtataccataagaatcttacaagtgtatacttttgtttcaactctcttgttgtcacacaattctacttttatatatgttctaaagtctatactatattgttattgatatttaattagttaattgttctttgaagaaacttacataatataaattttttttttttcttgagacgaagtcttgctctgtcacccaggctggagtgcagtggcacaatctcagctcactgcaatcttcacctcctgggttcaagcgatacttctgcttcagcctcccgactggctgggactacaggtgcgcaccaccatgcccagctaaattttgtatttttagtagagatgggatttcaccatattggccaggctgctagctgtgctacaatttctggtgctcttcattcttctttacatagatgcatttctatgtaataccatttgccctcttcctaaaggttatcctttaagatttctgtctttttttttttttttgaggcggagtctcggtcacccagactggagtgtagtggcatgatctcagctcactgccgccttcgcctcttgggttcaagcaattcttctgcctcagcctcctgagcagctgggactacagatgtgcaccaccatgcccggctaatttttgtatttttagtagagatggggtttcaccatgttggccaggctggtctggaactcctgacctcaagtaatctgcccacctctgcctcccaaagtgctggggattacaggcatgaactgccacacctggcctaacgtttcttgaagtacaggcctactggtgattaattctttcagcttttgtatatctgaaaacatcttcattttactttaatttttaaaagacatgttagttgtgcatagaactagcggttgatactttcttttcccttctcccagtactgtaaaaatgtttcacagtctttgcaattgcattttttaagtaagaaaattaggtatcattctaatctttaacctctgtatataacctgtcatttttcccctggatgctcttaagaatttcttttatcactagtattgagcaatttttttatgatctgcattggtgtacttttctttatgtttcttgtgcttagggttctttgagcctttagatttgtggttttatagctttcatcaaatttagaaaatgttttatcctcataggactattctgattctcctcagctagtaatttctttacctaatggacccatttacaaaatacactccaggtcctataaattttttttaataggtcatataaaagttactaccaggaatctgatgtttatagtgacagaatcaagtctcgacacttggaaaagaacattgtctgttttctcttgtaaactctgggattgctgaggttttcaaggaagccaggtactaaaccactctgctgttacagtcactgttcttctttttggctttcctacctcctgagattcttggcagatgaaggataagtgcttcataagcctgaaatggtggcccttctgggtcctgtggtaatcatctgagcacgtacttttcatttctgagttagtacggagattcctgaagttctgtctacatctttccaatgttggatttatacccaacatgtaggaatataaaatttagtgctaagatgataggtgttcactttgttccaatcctgtaatttgctgtggtgacatacaagggaaagagaagagccttaaatatttgcctgctagctatcaagtaggggggattatactcttaatctcatttacattttcttgtagctatagcaaagtttgacaggcaatcgtcatatcccccaaattatattagtgtgccagttacaggtctgtgactcctaagtattatttttaatacttaggagtattttaatactcctaagattatatttaaaaaacataatctcaccagtacatttttattccttcctttttaataaaccagctttgacagatgaaaaggaatctgtgctgtagctcagatttctcatgttaggcatattttagccgtaaacttaattatcgcaggaattttcaaatgactccaactttttctgcacttggtatcagaggataccaagtcctgtttttgagctgataaaatcctccttctgaaagcatttgtttattatattactgcttcacatgagctgagctctatcctgaccccgtgttaagtgtctgtggtagatttcattacatccatatactggaagtcctgccaatacactggcagcaaaatcctagtggaaaataaatggcaataaaaaagagaaatgatagcctgtgtgagtggtgaggagcacagctttattgagactggacaaccccagagtagtgacttggcatgcagacatgagcttaagagagtgtgagtgaaagctgatattggaataacgactctgtggcacagacatgggaataatttaattaattgcactgaaatttctttgatgaatagttatgtggtgataagcatgaggtcgaacagcagaatgagtctcagctttttaatgggccagcacagctgcggttttggatgccttcccactttatttctgcctgcagctctccaccgctttattcatccacatctcagctaggagcaccactcgcggggccccctctccatgtcggcagagctgaggggcaagtacatttggccatgggaagcaggctggtgactgctttgaaatgaaaaccagatcaaacgaaaattgtaggatggtgtccttatgatgcctgcacctcccctcctccccaaatctctaggatgcttttacagagtctttgctgctacgttgtataaagattttaataaaaatttcttgtccctggagaaacaggcatgtctttgttgtcagagagctagagggaaatgagcaatgcagcccagctggagtaccagcattaatcccatgattcgtagcccgtattttcagacagatcaattacttatggctgtaaccaatctctcatcgttttcttgctgtgcagggctccatttccagactcggcagctgacataaccttccaacttgataggacttcagctgcaaatctcttcaggtctgctgcctccattcatcgtggttatacaaatgagttgttaaataaaaatcaaaagtaaaaaattatgggtggtaatctctgcctggctcagtaatacccatgggcctaggcaacattttcagttggatttttaaaaaacaagatggatgattcacttgtctgacttccttcacttttatggacaggctttgcatgagagaaaagccatctctagagggaagaaattatccacagtggatacatttcttatcaatttataagttgaaagattaacttagaagtggagagaaaggagattatgaggagacacgaaggacatgtacaggtgagctgtgtctaatgcatttcacactgagtgagtcaccccttttcagctgctaggctgcctgggcttaaggccaggagattctgtatcaaaaagaaatgacccttgctaacacagaggtgtcatggaacatgtaagctgtttatagagtatgtcactgtgtgaatgtagaacttgtgtgaaggatctaaacccaataacctttgaagaatttacccagaatttatttagtgttttcaagttataactactccttgtgtgtattgaacccttcacagctatgtcaggccagctaagccttcctggaagaggtacttaggggccagataaagcaaattggagaatctctttgtgatttgactcactttagatgcacagatgctcatctgttaggaaagcatgtattgactctctttgtgcccttttctttcattgtcactccatcatttccatctcttcaatgaatagtcctttgaggactttcccattttccctataataaccaactacgaaaatttgcaggaagcaaaaaggaaaatgtggacatctagagaatataaatggttttatgtttaatctagggggaattatgtatgtatttatatatatttgtgtatgcgccctgcatgcttgttgcattttgctgtatgctttagaaacctttgcctacatggaacccattagtagtgtcctgggacaggtattcatgaactctgttaacaattaaggaagtaagttcctgctgctacaggctgacagccacagtttccccttgggcttgtatggctttggattgattctaaagaagcaaaggaaacatacagaacatacttgtttgatttgaaagttaaaaaccggtctgtgtctgttttcttctcccttttcactctagcccttcttaggcatcccaatgcgagtagtaaaacataaatcatgcaatatcataagatactgctacagctcttgccctgccctggatttgtttttttgtgcatctgaattttattatgatccataaagcagtatggaaatggctcattggtagggttgcatggcagtaccccatcctcagaccctgccaacaattgaaagtctgagaggtaataagaaataaaagggagatgagatttatagttcgtgagttcaagttgcttttttttctccgtggaatgttgcctgtcttattaggagttctttagtgaaacaaaatgcagtggtagcttagagaaattatggatactttccaggggtgtgggagaagcttaggagtctgtaagccttctcccctggttgcagttaggaagccagttgacagtataataggcttttggaagtgggtgcaatggtttgtgtgttctgtttgatgttgcaaataccaagcccgcagggagatctgcaaagaggatattctgttcttaaagaaaggaaaagattaacctgaaacgtgaactgaaaaactcctgaattctagaggacttaggtgcagccaaggaaggatctcatttacttacgtggaaacatcatttggcaagctgcctgctccagacaagcagatattttttaatgatttcaattaatgaaaagcaatcactaataaacttgagaggattggatcacatattaagagtgtgtgtgtgtgtgtgcgtgcgtgcgctcacgtgtgcgtgtgcagtatttgcatggttaaggtttggaaatacgtgcattctcatacacgcatagaagtcttacaactacgtgtactacttggagcctgcctgatggtccttttcttcacattcagaatcatgcttctgacccattaggagaggctaactcttgttattttggagacattttcaggagtggtaatgaatgggcattaaggcacttctgttattcatgaatatgtacattcacttaacatatttattgagtacctactgtatgccaggtattatgctaggtgctgaggttatagcagtaaaaaaataaaaagatacatagtctctgctctactttagtttataggttattggagagacagacaagaacaaataataatacagttatacacttaaaatttttatattgcctttgtattcaataaaaatttgttgagggcttctagatgctgtagactctgtgatagagtctaaagaaaagcgtcttgcctaatttctgttaaaatcagtggtttgccatttacgaggaataaactggccatgtttagttatggtattgaagaaagggtttgatccatacaggaactatacttcacctctatgtattaatttagtacacagttttaagaacagcaaggtagcattcaagaagagcattctgttatatacttgtatataaaccctattgtatctactaaggatattgttataacttcctcttcactggtatctcctcaactctgagttcaagacctacccttctctccagctgtgggaaatgggatttgtcaacctctctgagacaaagtttcacatcagcaaaatgggaatagttgtactagttcacacggggttgtaaagagtgaatggaattgtgtatttgaaaacacttcattaaagggatggatatttcaagtacactgatttaatttttacaaataatatgaatgtattagatcatcacatgtaccctgaaactatgcatatcaattatgcatgaataaaaaaattgttgaaaaagccggtcgcagtggctcacgtctgtaatcccagcactttgggaggctgaggtgggtggagcgcctaaggtcaggagttggagaccagcctcgccaacatagtgaaaccccatctctactaaaaatacaaaaaattagctgggcatggtggcgggcgcctgtaatcccagctaactagggaggctgaggtaggagaatcgcttgaacctgggaagtggagtttgtggtgagccgagatcgcgccattgcactccagcctgggcaacaagagtgaaactccatcttaaaaaaaaaaaaaaaaagaaaaaaaaagaaaaagaaaatactgtgtaaaggactatactcatttgagtttgtataattttcattattattacatcagatttacagagagaataaaatttattgaagccaactgtgttgtcttaaacctccgaaaattcagaaggaggataatgctgagttcaagtacgatatagaaatcatcatatcttttctctagcaagtgttccaagagaattagaatataatgccaaaattaaggtagaaattaagttattctagaagtgggatagccagtgtcagcatgcatgcatgatccttgaaaagtgatattgggcagcatttacaccaagctttgctatcttacgttctctttttgcttcttctacctggtgttatttgtgccttccctaaagggctgaaattgaaaagaattagtacgaatgcattttcaatgacaccttggccaagaggttcatgcatttcagctttggacaaggtgctatggttcaaatactcatgaatatgatataagaacagtcattatttaaatgatgaacctttatatgagattacactgggtgttactaatctgcaagttgtattttctgtggggaaaaatcagtatgaatgaatcaagaactcagtgtgcatcctgcagtgcatgttgtatttgcatgaacggagatgtaatctcttcaccttttgaatcattttgtttaaaggccctatatagatcattctgctcttactggtgggtgacattttcttaaggttctctccctagatagactaatttgaaaaaaatgcatccctcttgatgtctgcatgtgcatgtgtgtatgcatatgtataaaatatagaggtgatcacaaagcatactgggccacttagcacttccactaattccacattatcagagattgtttggagagcatatttcattctccctactttgtcacttatttctaacactgagtatatctgtacagttcttaatagtaaatggcataatatcttattctctgtattctatacattgtcaaccccattcctagctgataatcagtagtcaaaaatgggtgaataatttgaatggtacttgtctttaattgtgattcatgtctgaatggcttgctggtaactaggagctaaatttaatgttaatccaaggtcacactctagtccacatactggaagctcagcctcttgacatgcatgcttcatgcaattatcaggctgctcccttgtaggataaagtgcggcagtctagaaagcatggcactcaaatgggaagaactgttggtgagtctgtacagaacagatgaggttgcagatatttgaaagcatttgctaatggaaactctgggtaaggcagcatcttaaataatacgtagaatcagcatgctgtctccaaaacacatttgcagcatttattagctgggtgtgagctaaaggtaagctcccattaaaagaaaaaaaaatcttcgtaatgattagcaggggcccagtataatttaaggtattctttggagtttataaatatggcctcataaaaagcctgaatataagagaactgtgactttaagtcattagaagcccagtggtttgataaaataacaggaaacagacaatttattatgagcagtctcagtagctctggattatctataaaacttttacggccttccccaagtggcaagaagccataaaacttgcctgaatgagggacttgttaatttacttgttaaagcaaattaaaaatttataagtgcttttaggtaaatgagatcttctctcattgctgcccttgcggggctgggagtcctaggaggggagagtggatatgcttagacaccactgcagaacaataaaagctattaaatttttccagtttattacagcagagccatgcagctgttgccatggctagctgtggggtaccggtggttgacagcctggagtctcactcaaagggggaaaaaataaaaagccaaggaaagggatgattttttacttttataattctccaattgttgatgttgtagaccatgtctttttatttttccttgaccttgtaaatccagaagttttaaacttttttcttttctttttttttttttgagacagagttttgctcttgttgcccaggctggagtgcaatgtcacaatctcggctcactgcaacctccgcctcttgggttcaagcaattctcctgcctcagcctcccgagtagctgggattacaagcgtgcgccatcacgcccagctaattttttatttttagtagagatggggtttctccatgttggtcaggctggtctcaaactcccaacctcaggtgatccgcccacctcgacctcccaaagtgctgggattataggcgtgagccactgtgcctggccttatactgttttttcttatccccagaagtgtttctgtttattttgtcatacattgttggtccttgaaaattcctgcccgtcatgattccttttagtcatttagtccatggacaaaggccaggtcttaggctgtttttgttaacctcaacatttcttgaaaaaaacctctttctctctcttttcctttcccatatctagccacaaaactaggagaaggaagaaagggaatctggtacatgttcttgtgtatttaactccaaaaactgttagaatcaatattttttgtggaagccaaagtttataggtaaaggcagattttcttgcactctcccttggatgaaatgtcagcgtaggttaaaattcttggatcttagcatcttccttaacttagggctgttctctacgtgttgaatttcttctgtaataataggtttctgaatggtgactttggctggtgggggtcatttttttggctttaagccctgtgactcaggggattttttttttttttggctcccttaaatacaattcacaatgagcagttttctccctgccctagtgacagtaaggtttctgggacataggaaatagcttattcttccactcagatcagaagttttgattgagctctgtggcatttttaaggcagaaaaagacacgttatgcctcaactacctaccctatttaatgttaaattaaaatgatggttatttttaaagtgtgtttacatttaaaaattcctccagaaaagtcaagttctgcaaacattttcttgtagtatttccagtcactgcacaagaaaggtacattttattagttttaagaacagaaatagtagaaagacataattggtacaagtgtttgttcttctacagtatttactcttcagtttttacatatatatccatacctctgatttgtagtttgtttggaattatgtttagaaaagcatattgttggcaagtaaagcatcacaaaattaagggtagagaacagcagtaaaaaaaaaatgacaaatatgtatttttagactgtattccagttttaggaggtatcagcttttagagattccttaacgttaaaatttgtttcagtaagtaactcttgttgtggtcgctgtcttcagtattccagaaataatgctgtatctcttattcaacttcatgaacctctttactggcttccatattaatgtcatttgcatttagagtgtgtcatcttcatttagaatctcagcaaaaattctggtttataaccatctttgcacaaattatctctgtgctttaggacacttttctgggcctggtcttgcattttttatgaatacaactttaagagtggaacttaaatatgtccccttttattggattatccccatagacctgaccacaaagtctgtggaagtagaaagctataacggttgtaccatttttttttttttaaatactttaagttctagagtacatgtgcacaacatgcaagtttgttacataggtatacctgtgtcatgttggtttgttgcacccatcacctcatcatttacattaggtatttctcctaacgctatccctcccccagccccccaccccacaataggccctggtgtgtgatgttcccctccctgtgtccatgcgttctcattggttgtaccattcttttgttcaagagtatcaagttgaatttcatgtactgaaaaagtagatagatttaaaaacatttaaatttaggtagcaaatgacattgggccaaaggtccattgctaaggagacccaggaaagaatttattacaataggaatatgaggtgtggaacccaaggacagctgtcatgaaggataggtaatcacagtaaagtagtgatgcttcatatacatttgtttttgtttttgtttttttgagacagagtctccttctatcccccaggctggagtgcagtggcatgatctcggctcactgcaacctccgcctcctgggttcaagcgattctcctgcctctgcctcccgagtagctgggactataggcgcacaccaccacacctggctaatttttgtatttttagtagagacggggtttcaccatgttggccaggctggtctcgaactcctgacgccaggtgatctgccagcctcggcctcccaaagtgctgggattacaggcgtgagccacttcgcctggcatatatttggttttaagagttcaagctagaattttagagtagatgttcactcattagtaatattgatatatgttgtataatgattgcttaattgctaattttcttatgctaattgatgtttttctataaaaccaaattcttcagctctttacatttattgaatgctatctggcttatgaattttcataagaactgccaaaaaaaaaaagaaaaaaaggggcaggtcccctccttccttctaaaaagagtggttcatgcctgtaatcccagcattttgggaggctgaggtgggcagatcacttgagatcaggagttaaagaccagcctgaacaaaacagtgaaacaccgtctttactaaaaatacaaaaattagccgggcatggtggtgcatgcttgtaatcccagctacttgggaggctgaggcacaagaattgcttgaacctgggaggcagaggttgcagtgagctgaggttgtgctactgcactccagcctgggtgacagagtgagacctatctcaaaaaacaaaaaacaaaaattaaagaaataaaaataaaaaggtagagagtatgtctataatgactttttaatgtgtcagggagtttttaataggaaaaaaaaatcattccactaaaaatatgtcctctgtctcccaactagaatttcttccccatgtcactgccagccattgctgtgacaatatagtctcttactcttttatcaaatattctccatattattgctgtaagtactggacagatatcataagtaaaatatgtccacctggttgctaagaaaaatcccacatttattttatatattttgtaatagctttacgtattcgttcaaccgtaacattttggtttaaagacttcattaagctttcattgtccaatagcaaagaagtatgaagtagataccccttactttgcagtgtttactttttttttttttttttttttgagacagagtctcgcactttcgcccaggctggagtgcagtggcgtgatctcggctcaccgcaagctctggctcccgggttcacaccattctcctgcctcagcctcccgagtagctgggactacaggcgcctgccaccacgcccagctaattttttgtatttttagtagagacggggtttcaccgtgttagccaggatattcttgatctcctgacctcgtgatctgcttgcctcagcctcccaaagagctgggattacaggtgtgagccaccacacccagcctgcagtgtttactttttatttattttttattttttggtgatttccttttaccattagctaccagctgtcaggtattttcatatagttttggcattatagtttctttggttagatcacacacacacacacacacgtacgtatatgtattgtaggtataagcactggaatttagcagagctttttaaataaatgggctagtctacatgcctttctattcttttccttctaataatcttatactaataagattatagttacaagtcagacagcaatttcatggcacctgtagattttgagtaagaaataaaactaacttcagttgattatagttttttttccatcattaatttaatccaaatttctttaagatggctaaggtaaatgaaattatattctcaattgcttgtctggtctaatatgaccaaaaaaaactgttagagactgctttaattatttgaagtgtttgaagaaatttgagagagtattgtagaatttattcttatattaatgcaattaatatattaagattcaaccacatcaaattatgtattagtcatccagaattgagagacatggttgtaaaaatatcattaaggtgtgtggtatttacttaaaatttattcctttagagataccagaataattatttatatctgtttgctaattgcttactctaaatgtttggtcagtaaatcagaaaaatattagagctatccaaaggaacaaacacactgcaatgtgttataacatgcctccattgcccataaattattaatacaatgttactctggaggggtagcataatgttttggaaataatgcacactccagaataaaaaggcctgaatgtgaattctaggcccatctcttcctttctgtttaatcccaggttaacctgagcctccacttacttaactctaaattagtaataattatatctgcctcacaggttctgagaggaacctgtagctcagtacagcaaatagtaggcactacctcaagggcagtaaatagaatattcagtcagggatccacgttctaggctcagcttaccacccaatccctgggtgtcttggtggagttgttcatctctctatattttagtttctttgtaaaggggatacattaaaatttacttttctcactttaaatatttacgtgaggattaaatcatttatgtacaattattagaaaattgtataacagtaggctgggtgcagtggctcacgcctgtaatcccagaactttgggaggctgaggtgggtagatcacgaggtcaggagttctagaccagcctggccaacatggtgaaacccctatctctactaaagatacaaaaaaaaattagccgggcatggtggcgtgcacctgtaagccaagctagttgggaggctgaggcaggagaatcgcttgaacctgggaggtggaggttgcagtgagccaagatcatgccattgcactccagcctgggcaacagagtgagactccatctcaaaaaaaaaaaataaatgaaaataaaaataaaatagtgtaagagtagacaaatgtgtacaacattattatcacaaaaatgaaagcagcttaatggtaattgatcatcctgtttttaagctactagatcagagaatgtgatgtgcccacttgtcctttactgtccttatgatagttgtctttccatgttggcacaatggtagaagctgctgtccaggctattttgggcaatttgagtcaaaaattagcagttattcaatatatacaccttttttttttttttaccagcagctcaatgagggtttctattatatatcaaggggctaatgtggcataagttgttttttcttttttttttgggaaaaatcctaactagaaaattgggtctgttcttaaattgtaaatgtgtgtacatcaaagccattgtaaggataaatttaagtctgatagtgtacatgtgtacatagtttcagtacacattggcgaaatatcctgctgattgctgattgaaaacagttgttaattctctacttcactaaattcagagtggaaaactttccttaatgaagaacagattgaggagatccaagaccttactgtgtgggaattaatggcagatgcatatactggtagttaaaatgtttcattagatgttaatgtcttgctgtgtttttaattgttcaggaattagcctctagaatattaaaaccatctgtttgttatgatgaaacagaatgcttaaatagttattaatttgtgtttcttgtctttttttgagggataatctgtaaaactttgatctgtttggagtttagggaatttggaatgtggaagtgaaaaataattttaaagcacaccagtgtcctgaatagctgaagtatgtctttttttttctccttacccactgcatatattttgtgttctttctctcttttttcttaaaggagggtgagttgactttttttattccatggtgtgatgagaatctattaaacagagctggtttaatagttgatttaaactttaagattatcttcgtgcatgtggattattttacattcaacatcaaaacagaatttagacatttagaggaatgaaggacagcttacgtttttaactctaaggatgtacttttactactatattccactagctctgcataactgttgatggctatacagactactgctggcatgggttctagtcttgactctgctgtttcatgccttgtgatctggcacagattagtctttctcagctttagtttatttgtctgtaaattgggaagtacaatttaatttatagcattttttttaatgcttagaagtaatacatgaagactgcatatttgtcttttgttttgtttttatagagatggggtcttactctgtcacccaggctggagtgcagtggccaatcatagctcactgcagcctcgaactcctgggctcgggcaatcctcgtgcctcagtctcctgagtaactgggactacaggcatatgccacaatgcctggcagtatttaaattttttttagtgattgagtcttgctatgtttcccacgctgatcttgaacttgtccctcaagtgatcttccagcttcagcgtcccaaagtgctgagattacaggcataagcacatacccggacccacatttgttttatgtagtgggcatattaattgctgtctttcttgattacatggagccagtgagatactttggatgccactgagaatatacattagcactgtagctgcaagagccagaaataaactcttcatttactggcctctcccctgtgttgatagccaaacagtggtgcatttaagttcttacccccaaaatgaaaatctcagctaatgtcatcttggctctagttaattgccaggtgtgtagagctacagtggagagaacaaatctacctgtgcatgagatcccaatttatgtctctgggggccctagtatttgtctttttgtctgtgagtttggctaagaaaaattttcagcttctcataaatttatattaatcagtaaaatcatgccaagaattagaagttttatatagttgaatctttctgcatcttggagaaattccatgtgtttagaccaaaaatgaatgatagttgggaaattcatggttctctttacgtttcctttacctcacttgcccctcaatcaaaactgaattatctcatttcctaagtctgttttgcgcaggttaaaaatgggagggtctttatacatcttctggagctgagtgaaagtcacttgctacatgaaagtgaagtttgttgtaaaccttgagtctctaattcaggttcctcagaggccaggctcataatgtgaataagtgacacaggacaatgtagggtgtggggtcgtccttgtcatggtgctccattgaccctttataactatagcattagtgcagttagtgctcttgtttccaggggcacacccccttgctaactggactatgctggcactggacgtcatatgaatgattcattcagtattaaaagaagaatcaggccaggtgtggtggtgcaagcctgtaatcccagcattttgggaggcccaggtggaaggatcatttgagcccaggaattcgagaccagccttggtaacgtggcaaaatcttgtctctcaaaaaaatgtagaaattagccgggcatggtagtatacacttgtagtcccagctactggggagactgaggtgggaggatcactttagcccaggagttcaaggctgcagtggggtgtgatcgtaccactgcactccaggctgagcaataaagtaagaccctgtcttataccatctccatagaaagcaccatcttaaaaatttacccaggatttcttttataaaggttgttgttgttatttttattattaagaaatcagtgattgttagtacacattttaaaagctttctgtcattgcaggatatgtcagaaaaaagtttttgctgtagtgatctttaacaacataagaaaaggagtggttttttttttatacttgttaggtaaaataaataggatttttaaatgcttcatattatccaaattacataaaagtggcaatctcgtcagtaagtatgtataatactaagagagctattaacttttcttggtagtggtttttgaccttttgctgaacaagtactttaaaaattttcaaatgccaggatgaagacttcttaaactaactgtaattatgcaactttttctttataatccgatacctcactatctaaaatatctgaaattacatatgatcactgtttcaagaacaaaatcagtgatagcacattttgaagactatggaatctaaaggctgattttgtatgctcactagcacacatgatacttttcatgttaccattcagcttttgagctctccttactggccaatcccagatgagaagctttttttttttttttttttttttctttgagactgagtctagctctttcgccaggctggagttcagtagcgtgatctcggttcactgcaacctccgtctcccaggttcaggcaattctcctgcctcagcctcccgagtagctgggattacaggcacgccccaccatgcccagctaatttttgtatttttagtagagatggggtttcaccttattggccaggatggtctcaatctcctgacctcgtgatccgcccatctcggcctcccaaagtgctgggattacaggcgtgagccaccatgcctggcctcacaattaagtttataacagggatatgttatgaacttaatatgcttggctattaatatttggatatgttctcaaatattctagaacataggccagatgtggtggctcatgcctgtaatcccagcactttgggaggccgaggcaggcagatcacgaggtcaggagatagagaccatcctggccaacaaggtgaaaccccgtctctactaaaaatacaaaaattcgctgggcatggtgggcgtgcctgtaatcccagctaccccggaggctgaggcaggagaatggcgtgaacccagtaggcggagcttgcagtgagctgagattatgccactgcactccagcctgggcgacagagcgagactctgtctcaaaaaaaaaaaaaaagtttaactctagtgtgtggtataccagttcagttctgtcctcatggaagtaatatggcctttcatgggatagtcactaatgataagtttagtgacatatagtttattaagatagctatggacagtgtaggggcttagtcttgatgagattttaatttttggctgcacttgaaatgaactgggatcaaaatagtggcaagttggatagagatttgctgtcagaattaatattcaagaagttctgatagcttgcaaccaaagtattttatattataacaaattctagatgctcataattattcaattaaaatggataaacagtaaatatatgggttagagaagaacaatgctttttccagaaacaaagttttaaaaacttgttaatatggcaattttaaaacatacatgaaagtaaagataacggtataatgaacccaacatcatctaacttcaacaattaagacatggctaatcttacttcctctatatccctacacttcccccttcccaataggtattgctccccctatcccctggattattttataaaataaaactcagactcaagttatctcacccattaatgttttactgtgtatctgtaaaggactctgcttttttactgtaactacaacaaaatgtaaataataattccaggccgggagctgtggctcatgcctgtaatcacagcactttgggaggctgaggtgggtggatcacttgaggtcaggagttccagaccagcctggccaacatggcaaaaaaaaaaaaaaaaaaaaaaaaaaaaaaatagccgaggatggtactcaggaggctgaggcatgaaaatcacttgaacctgcctcggcttccgaaagtgctgggattgtgagccaccatgcccggcccaaattgttccatttttggtcagtgggaaccccttcagtttggctcccaagcccctttgtcagggtcttgctaggatgacaaggtgttccagactcatcttacatatttcctttctcagaccttcagttggacacttttagttttttcgtgttagaatgggaaaaacaaaagatagaagacattttctatttgagagtggtggctattttaatgaatgacaggccatttaaaaagttattgaaacatgttttttaaaaacagaaaatcataaaaagtaagttttgtgtgtttattttttatattcatccttgaaaaccaaataatattgtctctaaattactttttaataatcaaaatcttattttaagaaagctgaaaactgtactaaagcaatcaaatattccttcaacacattattttttacattgtgtatgtgtattgtgtgtgaatttctgagcctatttgaaaacagatttatcatttagtccatggttatactcaaggaatgccaaatgcaatctgttcattctggcctttctctttaattcttgtacatcttttgtacatttctattcttgtacatctttttttctctattgtttagactttttggtcaaaaatttaaaaattttctgattggcagttggttgaaagagataatttattatctaaagatctggaatcaatagacaggaatgtctggcttactacgataaagggttatggagaccaacgttttatcatgcagataaagcctccaggtatcaggcttcagagagaataaattgtaaatgtttctcatcagacttagagagtctgctctattagtaattctgaaagggaggaggttattatggggcatgtccggtccctgtcccccatcatggcttgaatccgtccctcaggttagccttagaatgcccttgctgagaggaagagtccattcagatggtgagggggccttagaattacattttacagcataattaaacctaggaatagtatccaagttgtagatagatatgtgagttatacatcaaacactgccttttacacttccattttcttgccttcacattattaaattatgaagaaatagtatcgtaatatcctcttggcctaatcatagagagtagagttaacaattctcttgataagcagtagaacattgttaagttctgctgtctggattgagcgtgtctatagtaatgatgtcaaagtcggtcagttcgctcttgattttcttaactgcttcttatttatgtttgagactatatagttagattgatcttggcttattttcctttttaaattttattagggctgggcgcagtggctcacgccagtaatcccaacactttgggaggccgatgtggctggataatctgagatcaggagtttgagaccagcctggccaacatggtgaaaccctgtctttactaaaaatacagaaatcagccaggcgtggtggtgggcacctgtaatctcagctactcgggaggccaaggcaggagaatcgcttgaacccgggaggcagaggttgcagtgagccgagatcgcgccattggactccagcttgggcaccaagagtgaaactccatctcaaaaaataaataaataaacaaataaataaataaattattaacttagtttttctactgctatgaagtccactgaacccctttaaataatgtgcatgtttggcagctggaagcacttcagtcgtttttattttctaagctaatagcacaattttaagtcatttcctgtctaataatgcctaaagtgtttattgggatcatcattaacacaggtaaataactttccaaagtccaaacatatccaaaaatcctgtttcttactttgcattaatgaaacttgtctaattgcattagagtgactttacgatacatgaatttcaagggaatacctaactttctttctttctttttttttttttttttttttttttgagagtctcgctctgtcgccccagtcgcccaggctggagcgcagtggcgcgatctcagctcactgcaagctccgcctcccgggttcaggccattctcctgcctcagccccacctcgagtagctgggactacaggtgcccaccaccatgcccagcaattttttttttttgtatttttagtagagacggggtttcaccgtgttagccaggatggtcttgatctcctgacctcatgatccgcccgcctcggcctcccaaagtactgggattataggcatgagccaccgcgcccagccctaactttcttatttaaaatccaccatggtaagcagagttccaagatgaccctaaaagtacttgtcccttatttactcccatgttttcttatatagcacagttgactttatgaaaggaagttcttctgtaagcctgacctaatcaagtgaactattaacaggatgctgactttctggagtaagaaattaaactgatgggatctttcctttctataataaactgcttttttagaatataagttagataccataaaattcactcattgtaagggtacaagctaattaattttagtaaacttaaagagttatgcaatcatcaccatacaacattgccatcacctcagaaatttcccttgtgaccatttgcaaattggtagaatcttaaattcttgtgaaaaatcctgttagaacttggtgggctatactttaatatattattaaatttaatttgctgtgtttcttcagatttttgcagctttttaaattaggaaggtcatcctgtagtttcattttttgttttgtcaccagattttggcacaagttagctttccatattttttcatgttctggaacaaatgttgttaaatcttcttaaaaactttagactgcttaattatggttttgaaagtatcactgtagaatgtttacttctgtatttagaaatttatctgttttttattttgcttgccatctcttttatacttaaatgtgttagaggtgtatctcatatctttatgggttccccccagattatactatagtttactaactgtacaatattttaatttctaatgatgttcttctcatttttagaattctcttcctctgattttacctatacttgcctttttgtcttatttcttttttgttcatttcaatctttataattaggccatttatttctattctttcacatttaatagaaaatacattaagtccatgagttaacttctagcaaagattttacaacataagttttaaaatttatatatttataattttcattttcttaatttttaaatgttgtatgtgtgattttgtcttttacccagttgttaattgtagacagactttaaaaaaattctttaggtgatatggatattcaacataaaatactgttattactttttatcatagagaagtctgttcatataatttttacattttgaaatttattcttatattctttgttaccctggtacattttcagttggtggtaatgtcccatagatcctctaggtgtgtctctttaagttacccaatttactgtatattaactaagtcaaacttcattttttaacctctgcgtcctttttcattgttttgttttcttgttccttgattagtagaatgctaaaggctcccaccttcttttgctttcttttattatttagaatattttttactttgtatagttttgtataatggtttataacttagaagggtataaaaggtaaagactgtacctttcatcactataaaatgactttgacaggtgatttttttacctatttatttctaaccttttgtctttttccctctctctttttttaaatttaggagttctttgtaactaataaataatgggacatcaatctgttgattgatctgtatatctatccatctctctgtcttacccaacacaaaccagatttttatttttaaatgggagcttaatgtatttatattattatcagaacactttgttttacactttgctttcttgccacttttcttattttctttccctttctctattatgatttgagtcattttatatttggtaattatttggaaggcaaatatttttaacgtttaaattttactaatggttagcttcaagattatcaaattgttatttaaaacactttctctagctgttgtagatgataacaaaagaacctttgattctgtgatcccagaaaaattccttgccctgcccttgtgtccaaaatttgttaaaataattttagcttttattcacaacttggcactgtacacttaaagatacaatatagttttcttttttaaaaaatagtttttctatccaactttataattttacttattgtagttattttgtgtttgcttatttcgattcatcagcatttttcattaagttttttagtttggttcatgtacctgtcatctgaaatacgctttaaaacttaaagaataaaatagtacaaattctatccaatccatgatactttcccaatttggggacaattttatcttgaaaaataaaaatagtatttttcaagattaaatacttggctgctttgatggtagtgtagtctatgggtatattaaaattttcttgaaaaaggagaatcttttgagcttactgaaacattccccaaattttgcatagagttcatttacattcctacagaaaaactcagcagtctgaaaaaggatatgtgctactttgaggaatcaaatttgtggaaggagattccatttggacagtcttctacattgcctgcataattcgcatcattcctctcaaattccaggcatagatatattctccacataatttatccttctgtaaattttgtttgatggattaatgacacctactgggcaagtagcatctttttgaaactctccatatccaagctgaaaagaatgggatagcccagctcacaaatgccaagcagatgtgcacagaattgctataccttcatgcagtctagggtgatgggacttcgttacatgttcattagcagtgacataactgtggatcgttattttcctaattagccattaataacagttaacactgtaatgggatcacaatttcagaatttggagcatatattgttgacagtgaaatctaatgaaaaacaaactagcttcttatattttataaaagatgttaatctcattgatagaattactgccactcatgccagataccagctggctttcattttgcatattttgttctcattctggtgcccaaactattgaatatataatactctaatgggaagaagcttctcacaacagagagtgggttatagtaatttttaaataaacaaggtcctgaagtatgtaaaggctgatggtaagaaatcttactgtatcagttataggaaaagctttcttgtaatagctgccatggatgctcatacaaatcaatgcaagcagatcaatttttcttagctctttaaatgtttaagccagcatctggcctttgtgatgtttcttggttgtaggtaatagctgggaatttcaggtgaaggattacaacttctgagttagttatgctaccccaaacgatccattggatgtggctaaaatgctagtttgaaactatattcagctgggcgtggtgactcacacctgtaatcccagcactttgggaggccgaggtgggcagatcacctgaggttgggggtttgaaaccaacctgaccaacatggagaaaccccatctgtactaaaaatacaaaatcagctgggcgtggtggcacatgcctgtcatgcctgtaatcccagctactcaggaggctgaggcaggagaatcgcttgaaccggggaggcggaggttgcggtgagcagagatggcaccattgcactccagcctgggcaacaagagcaaaactccgtctcagaaaaaaaaaaaagaaagaaaatatattcatgggattggaaatgaatacttctttgcctgaaatcttgtggtttagctttagtacttactgtagtcagttcatttctttgaaatattgagctgtctgacagcttaaaatcctaagtttcctttaaacttgagcctggctttggaggagaagggggtggtgtaggggtggattttatgtaaggctctctgaagagaattcactgaagtgttttttgctggcagggcactgggaaggctagcaggctgcttcctctcagtccttcttgggttttgcccttagcctagatcaacatttagtcagataatttacgtcaggtccactgaagtctgtttttgtgccttggtaaagtcatcattttccttccgtgaagaagcatggaaaaggcccaggtgcaatgtccaggttttgttaagccagttggatattaggaaaagccttgacactctttatagtcttagttcccagctggatatgtatctctcatctaagttgggaactgagtttttattattagttttttaaatagagacggggtcttgttatgttttctgggctggtctcgaactcctgggctcaggtgatccccccgcttcagcctcccacagtgctgggattataggcatgagccactgtgctcagccataaaggtgttgatcaaatatcacctaacaagattattttctttgtgaacgtactatagtcaggtaccacatacaaatttagaacatattatgtggagagtactaatatgctgcagaatcattacttcatgtcaaatgtaaacatctaactgtgcactgagaattagttttttcatccataccttggaggtagttctacctgcccttacttaactcagaatcagtgggataagagtttgatactgcttatgaattggagggcccatgccacatgcaaactttattatcagtataactatgttataacaataggctttttgagcttgaaaaatgtgtcataatttaaaaaataaataatagaaagaaagagctcttcaaagaccataacagaggaggtaagatctgagctttaaaaaacatcttgacatcagaagcacagagaaggtaagggtgaacattccagagggaatatggtgtgaaaaaaatgcagagcaggaatggacaagaaacgttcagggaatggagacaaggcgatgttcattgtagattaaatctctcctttattatcaatataaaagtgaaaaatcgaagagaatgacaatattctgagcttttattccatagtaataacaaaagcctcatacaacttgcatctgaattaacttagaatgaggagctttagcgttgactgaggagaaaactaagtacttaagagctcaggaaggatacaaagtaaaattagcatcaattttctgggctcctttgcagaaggcttcccggagaaagggattttagaagaaagtgataaaggtgaatttctggaaaggatgatagcaaaaaagaatgccttgttttggagacttggggaaagctgactctgtgaatggtataaccaaaagtgaggtctgaactgtagtctttaaagactacaaggaatgttgattcagcctcactctattcatcttggtttcatcttcccctaggcaccatagccacttgaaatcctgcaggcaaaaatttcctacttattgcctcttctattctttgaagtttcctcctgtctagaaaaatggagcttatgtttagtttgagattttccacgttttcattcatgcacccagctctaatgtttcttattgtctccccaaaggaactctgtttcaaatgaaactgctgatcatttcccagcatgttgctttttctgtctttgctttctgcttttctcctcaatggagtatctttcactgtcctctcagccatatgagtttaatctacttttaaaatccaaggcttcagaaatcacttctctgaacctccctggctactttttggtttcattgaacatgtatttccttgtggtgttgtatttgcttatcttttactgcctttttcttgttatattggaaacattgtcaaggggctgtgacttgtaaccagtactacattgcttggtgtttctgaaaatgtgtttggtgatgatattgtagactagtactccatatatttatgacttagtcttatgtagactgatggttttcaattttatgtatttgttcatttttaatggaaaaccagagcttgttaaatgtgtggaaaccactagaacgtaaacttcatgagatgacttttgttttttttttttgtttttttttgtttttttttgtttttttttttggtgtagtaccatatcttcagcacttagttctagcccatatgtggcacttaatacattatttgttgaataagtgctgatttaatttacttaatctgtaggtcttcattggttcttttaaatatgtagtaagaaacctccaggatgttatctcaattaacaagatcattaggtgccatcccagtgtttgaaggataacatcacagcatctcatcattttttcctaggagaagaaaactttattttattttgctctgatttgtttctttttttgagacaagacagaagaaaaaaggtaagaaatcatagttggtgtaatctcactttagtttattcaacatttttggtcttttcattattgaaaaaaaattgcagtggaacagaagaaaaaatttgatggaaagactgctttctaatttatggaccttgaggtttggctttttaggtgtttatttaaggcttgcccactctgttctctacattgacatttcatggtgaatattttgcttattctaccctctgtattttttctatggcagcttgcctggcagtattcagaaactgagaagaatattaaagatcagaaccttaaattgttcactcttttttttttttttgtgagacggagtcttaacgctgtcgcccagtctggagtgcactggtgcaatctcagctcgctgcaacctccgcctcccaggttcaagcgattctcctgcctcagcctcctgagtagctgggattacaggcacatgccaccatgcccagctaatttttgcatttttagtagagacggggtttccacctcgttggtcaggctggtctcaaactcctaacctcgtgatcctcctacctctgcctccgaaagtgctgggattacaggcgtgagccaccgtgcctggctgttcactcttgacaaggatcaaaaacaggaactaagaagcagaccactaactttttccttttttctcttttcttttgcctttagctcaagccaggacagaacagctgcagggacagtgacagtgaaagtgccagtggagaatccaagggcttccaccggagcagctctcgggaaaggctcagtgatgtaagtttaagtaaaaaaaaaaaaaaaaaaaaaattaacgaaaaccactaggccacacacacaccattggttcaagtctgaattacataactttccctcatctttagaactttttgtctacccaagcattgcggttcacattatctttgtatacttatttgagcattgtagttatggtgtcattctaaaatgtcgtttgagcaaaaatgtattttgacaaatcattaggtaggaggaactatttgttaccttagaaacaacaaggccgggcacggtggctcacgcctgtaatcccagcactttgggaggctaaagcaggtggatcacctgaggttggaagtttgagaccagcctgaccagcatggagaaaccctatctctactaaaaatacaaaattagctgggcgtggcagtgcatgcctgtaatcccagctactcgggaagctgagacagaagaatctctgaacccagaaggcagaggttgtggtgagccgatattgtgccactgtactcagcctgggtgacagagcaagaccccatctcaaaataaataaataaattcccgttggatttctggaaggaaaaccttgtgagaatgcgtcatacctcttgagatatctgtttgccctctagatgtgattttcattgttctctagtctgcccaccaacagggcaggttccccctctattacttctgagaaccacctacccctctttggactctcttaccttctttactcatatgtcatatatcagcattttttttttttttttttgagatggagtctcactctgtcgccaggctggaatgcagtggcacgatctcggctcactgcaacctctgcctcccaggttcaagctattctcctgcctcatccttctgagtaggtgggactacgggtgcacgccaccatgcccagctaatttttgtgtttttagtagagacagggtttcaccgtgttggccaggattgtcttgatctctttacctcgtgatctgccttcttcggccttccaaagtgctgggattgtaggtgtgagccaccacgcccagccatatatcagcattcttaactcatctgtacctcaagagcaacacttggaaattcttttgtgaaatggatcaagtaaagagattttttttttttttttgagactgagtcttgctctgtcaccagactggagtgcagtggcctgatctcagctcactgcaaccttcgcctcccgagttcaagcgattctcctgcctcagcctcctgagtagcctggattacaggcgcgtgccaccccgcccagctaatttttgtattttcaatagagatggggtttcaccatattggccaggctggtcttgaactcctgacttcgtgatctgccacctcaacctcccaaagtgctgggattagagctgtgagccacctcgcctggcttaatttttgtatttttagtagagatggggtttctccatgttgaccaggatggtctagcattaacagaataagtgagagagtagcaccatgaaaaaaaagagatagcacttcagagtgtctgagtattaagaataaataaaggatatgtaataagaagcaaaatcttttattttctccattttatttttaaaaaacaccatactctaaagcagtgtgctgttcattatagagtgcaagatgattcattgagttccagaaagaaaatactagtactttttttcttaaaaaaagaaattaaactttactagtattcagtttaacgagcggggaataattgatgtctataatttttaaatacgtggatttaaggagtgtatactcaaaacttttttttactgagagatgtctactaacataaacggttggagaccactctagcacactgagcagttctctatgataataccacatccatctctccatcagccaaggtagacaattccgagatacaatcacatttctgcacctctcatgaaagtttgtgaggtttatgatgagatgttgtatgagatactgtattcttacaggaattaaatggaataaagtataattatttttatgttattttaatatattagttatagataataacctccccttcttctgtgatataatatcaaagttatataaataaagagtactaacagtattttactgtgtgtgtgtttctgtgtgtaagaatatgttttattgtgtgtccatgtgtctgattaattttgtgatggagctatacaaccataaaaccatgacaacttttcttatctaagttgttagcaataataattaatgtttaaatagctgtttttctgagatttttgttatacttttaatgtaagatctcattgactctagaaattattccagggttagtaggtcatatttttttcatagtgtagagaaatgaacgccatgttagtttaggggactagagctgccattggatcttttggcttgtttcctctaactcactttctgttagataaaaagaaattgacaaaagacattccatattcatgaatagaaagacagtattattaagatgtcagtactaccctaagctatttatagattcagtgcaatgtctatcataattccaacaatctttttttgcaaaaatggaaaagcagattctcaaatacatatgaaatggcataaggccttaataaccaacacagtctggaaaaagagcaaagttagaggactcacacttaccaacctcaaaactcactgcaaagctacagttaatcaaaacagtatggtgctggcctaatattagacatacagaccaatggagtagaatggagagcccagaagggagcccatacttatatgcctaaatgagttttaacaagagtgccaagacacttcaatggggaaagaattttctctttaacagatggtgttgagagaactggatttctatgtgcaaaagaatgaaattggactcctacatcgcactatgtacaaaaataaactcaaaatgaatcaatgaccaaaatataaatgtgaacaccataaaactcttagaagaaaatatacaggtaaatcttcatgaccttcaatttggcagtggcttattagatatgacaccaaaagcatgtacaatgaaagagaaaataaattggacttcatcaaaattaaaaacttctcacaccaaagagcattatcaagaaagtaaaaagacagcctacaaaatggggaaaagatttgcaaatcatataagtggtgtttactctacagaatgtgtaaagaactacaactcaataataaaaagataacctaaagcaaaaatgggcaaagaatttgagaaatatttctacaaagaagtacaaagaagaggtacttgaaaaatgctgaaaatcattaggtattagagaaatgcaaattaaaactgtaacgagattatcattttatacctagtaggatggttatgcttttaaaaagagaatgaaaaataagaagtgttggcaaggatgtggaaaagttggaatattcatacattactggtgggaatgtaaaatgacgcagccactgtagaaaacagcttggcagtcctcaaaaagctgaaacatataattaccatatgacccagcaatttcacttttaggtatataccccaaagaatggaaaacatgaacttaaacagagacttgtaagccagtgttcactgcagcattatttatggtagtcaaaaagtagaaacaacccatgtgtttctcaacaaatgaattgataaacaaaatgtgacagcttggctgataggcacacaatggaatatactcagccataaaaaagattggcattgtaatatatactacaatatggatgaactttaaaaatatgctaaataaaagcaagacaaagaaggacaaatattgtatgattccacttataagaggtatctagaataggcaaattcatagagacataaagtagaatagaacttaccaggaatttgggggatggagagtgggagggaggaaagctattgcttgttggttacagagtttctttttggggatgataacaatgttttggaaatagatagtcatgacagttgctcaatgttttgaatgtaattaatgccactgaattacacaattaaaaaatgatctgttaaaaaatgtaaaaataattagggctgtaataatgcttattctgctttcacttcattgaaaatatggaaaatagttataacttttaccagccttgtctactaattgtgtcacctgtgccatttctggtcctgtttctattggttgttttttctcttcattatgggtcatattttcctgcttctttgtatgcctggcagtttttcattggatgccagacattataaaatcctgtcagtcttatgtcaagccagtcaatgaaacacttccgattcatattgtttattatattttaaaattatgaaaaaaatttgtgggcatatagtaggcgtattgttcattaattattaaaattcacactttttgcaacattactgaaaaggaaagaaagaaaaatgacccaaaacgtggacatttactgaaatgttttgagatccctagtcacatttccctcactcatgtgcaggtctgaggttgcagagtcctgtgtcaagcactatggcaatctgaaatctgctgagatgaaagctttttttttttttttttttttttccgtgacacggagtttcgctcttgttgctcagcctggagtgcagcagcacaatcttggctcactgcagcctccacctcctgggttcaagcgattctcctgcctcagcctcctgagtagctgggattacaggcgcttgccaccacgcccagctaatttttcatatttttagtagagatgggcttcaccatgttggccaggctggtctcaaactcctgacctcaggtgatccatccaccttggccttccaaagcgctgggattacaggcgtgagccaccatgttcggccgagatgaaagcttttaacaaaccaacccacagaatggatcttttggataccaaagcaacacctacctgcacaatattttagagaataaagatgccccattttttcttgaaagagaattaacaattaatttatttttttacttttattttagttttgggggtacatgtgaaggtttgtaatataggtaaactcatgtcacagaggtttgttgtgacatgagtttcatcacccagtagtacccaatagttattatttcatcacccagaattatttcatcacccagtagtacccaatagttatcttttctactcctctccctcttaccacctttcaccctcaagcagaccctagtgtctgttgtttccctctctgtgttcataagttcttattatttagctcccacttataagtaaaaacatgcagtatttggttttctgttcctacattagtttgctgaagatagtagcctccagcactatctatgttcctgcaaaagacatgatcttgttgatttttatggcaatgtagtatttcgtggtttacatataccaaattttctttatccaatctgtcattgatgggcatttaggtgtagcccgtgtatttgctattgtgagtagtgctgcagtgaacatttgcatgcatgtgttgttatggtagaatgatttatattcttctgggtttatatccagtaatgggattgctgggtcaaatggtagttatgcttttagcttttgaggaatcatcatattgctttccagaatagttgaactaatgtacactcccaccgatagtttataattgttcccttttctctgccaccttgccagcatctgttgttttttgacattttaatattaataatagccatttgactggtgagatgatatctcattgtggtttttgatttgcatttctctgatgatcagtgatattgagctttttttgtataggcttgttggctgcatatatgtcttcttttgaaaagtatctcttcatgttctttgcccactttttaatggagttgtttggttttgtcttgtaaatttgtttagctccttatagatgctcgatattagacctttgtcagatgcatagtttgcaaatatttttctcccattctgtaggttgcctgtttactctgttgatagtttcttttgctgtgcagaagtgcttaagtttaattagatcccagttgtccattgttccctttgttgtgattgcttttgatgactttgtcatgaaatctttgccctttcctatgtgcagcatagtactgcctaggttgtcttccagggtttttatagttctgggttttacacttgtctttaatccatcttgagttggtttttgtatatggtgtaaggaaggggtccagcttcaatctttttttttttttcttttctgagatggtgtctcgctccgtcaccaggttggaatgcagtggcatgatcttggctcactgcaacctccgactccctggttcaagtgattcttctgcctcagtcccccgagtagctgggattacaggcatgtgccaccatgcccagctaattttcgtatttttagtagagacgatgttttaccatgttggccaggatggtctcaaactcctgacctcgtgatccgcccgccttggcctcccaaagtgctaggattgcaggcgtgagccaccgcgcccagcccagcttcagtcttctttaatgcctatcagagagtgaaaaggtagagtcaaagatgactactggtttttgtttttgttttttctttaaaaattccatattagttcttattatgcttattcttctttcacttcattgaacatatggaaaatagttattacagcttttactgtccttgtgtactaattttgtcacctgtgccatttctggacctgtttctattggttgttttttctcctcactatgggtcatattttcctgcttctttgtatgcctggcaattttttattgaatgccagacattataaaattttccttgttgggtactgggtatttctggtttctataaacattactcattttgggatacaattttgttatttggagatgtgtgtgtgtgtgtgtgtgtgtgtgtgtgtgtgtgtgtgtttttaatgtttgcttttgtactttcttggacaagaccagaacaacctttagtctaaagataatttttcccccattctgactgagtactttgcctaatgcctaacgtcttacaaggtttttccactgtagattgtgggaaaacaaactattccctgccttgtgtgggctttgtaagttcttcctcctccttcccagtggtggttttcctcgccttgggtattttctctcacagatgtgctgactagtcatcaggtagaaactagaggggaaccttctgcagctttcatgattctcgctttctgtgatgctgtctcctccttatcctctgccttggagttccagctgtctttgcctccccttattctcaactgtgtcttcaagactcagggattccacctgggtcacctcctacccggcaatcatgtggcatgaaaactctccaggcagtaaggtgggaaaattttaagggtcaccctacttttttctcttctctcaaatattattgtcctttactctgtcttacccaatttctaaaaactcctgtttcataccttttgtccagttttttagttgcttgaggtgggagaatacattcagtccctattagtccatcatgcccctgactcgtttttcagctaagatgaaaatttctgtcagcctttcacccattttagtgatatttttaggagctttggcagttgagacttactctcaagtgaggctaatcaaaatagtatattattctagctttgtttttttgaattggttaggccaaaagaataagaataaagaattccagtgtagctgtataatttgactcatgcgtaaagcttaaaaacaccaaatatgtggccaggcatggtggctcacgcctgcaatcccagcacttttggaggccgaggcaggcagatcacttgaggtcaggagttggagatcagcctggccaacatggtgaaaccccgtctctactaaaactacaaataaattagctggacgtggtggagcacaggtactcgggaggctgaggcaggagaatagcttgaacttgggaggcagaggttgcagtgagccgagattgtgccactgcactccagcctgggtgacagagtgagactctgtcttaaaaaaaagaagaaaaacccaaatatgctttgcttttctaaattatatattcccagaccatgttgcctggggggaataattggccacaaggactttcagattgtccacatcaaggagacatagtaacttgtttagattagtcactagggaagagttaaggggaataattgaatatatagttaataaatgtttatgatgagttattcacagggaaaatattgcttccaacttaaacagaattttgtaactgaggaaatttgtcaaaagttaggagcaaaacttacttaaaaacttttaataaacaagcctcaaattatgaaatgttaatgggcatttattataaacaggccaagatttaatagaagttctgctatttattgtgtgtgaccttaggcaaagaatgtgacctttcttccccgccaagatggagtcttgctgtgtcgcccaggctggagtggaatggagtggagtgcaatggtgcgatctcggctcactgcaacctccacctcctgggttcaagcaattctcctgcctcagcctcccaagtagctgagattacaggcatacaccaccacgcctggctaatttttgaatttttagtagagatggggttttaccatgttggccaggctgctctcgaactcctgacctcaggcaatccaccctcctcggacttccaaagtgctggattacaggcataagacactgcgcctggccttgttcgcactttcaaatcttcctacctttgcttattctttttatttatttaaaatgaattgcagtggcatgatcacagctcactgcaaccttgacctcctgggttcaaacttttcttgtgccccggcctcctgagtagctgggattatacacaagtgctaccatgcttggctaatttttgtatttttagtagaaatggggtttcgccatgttggccaggctggtctcgagctcctggcctcaggtaatccaccctcctcagccccctcccaaagccctgggattatacacatgagcctccacgcttggcctattttatttctgttcttttttctttctttgtttttcttttccttatgtcagcttcaacctcacttctaccaaacacttcccaacacactgtggaagtaaacttctttaatgctttatttaatgactatatgaatatgactcttttcacctttctctctgaaagaattttgggttgggttgttagttatgagaagacagaaaaatatttaacacctttcaagggttcagatcgttcaaggaattgaaacatctcagaaaataatgaaaatggatcaaagtcttatgagtctaatgctacacagttgtctactcttattattctggtagctatttacagttgagacattttttctgcttccttttgagataccccttctcctacttcaaatcttccctggtctttgggtttttattgatttgtctatcccacagtgccactgttcatccacccatgccagcatctgtcctattctttctttcttcctcccttccttctctccctccctccctccctctcttgaaatctttattgaggttttattccatgccaggttgtttgaccagctactgttaaggaggaaacagacttgagccactaccatgaatgagcttcccacattgttataattagattaggaaatctaatctcgacctgacaaggattcttggtgttttattcctctctttttaaaaaaatctgtgccacattttccttttccttaacagtttgcttatgcctttttccattcctgtcccatacatttatgaattctcctggatatgtcagtatttcagttgccaagaaatgtcaatcaaatttcttttattcatcaggtatagtctgggcatttgaggttgagtggagaacaagatgaaacctctgccctcatgaagtttccattctagtgggagagacaaatctattaagaaatagctacaattttttctaatagaatgttttctgacataaacaatatgaagggcgggagtttgttgctactttaactagtgtgattagataaggcctttctgtgtaggtgacattaaaactgaggcctaagtaaagaaaagaaggtagacaggtgaaggtctatgggaagaacattctgggcaacaggaacaacaagcttagaggccctatcagaagcatgttgtgttcgagggaaagaaaaatggcttgtgtggctacagtagagtgaagtagcacagtggctgaacacgtaacttctagcccatgctaaggaggctgggtgttgtattaatttcctgggctgctttaatgaatgaccacaaactgtatggctggaaacaacagaaatctattatctcacagttctggaggctagaaatttaacatcagtgtgtcttcagggctatgtaccctctgcaggctctagggaagaatcctttttttctcctggcctctggtgcctcccagtgatccttggtgttcctggcttatagatgcatcattccagtctcttctttagttttcacatggtttctacagcagccattggatttacagcccatcctaaatctgtatgaccttaattaggtacatctaaaaagaccgtatatccaaattatgtcattgtattagacttctccacagaaacagaaccacagcagaagataacagaaccagcagaacatgatttattatgagaaattggctcagttttggaggctgacaagtcccaagatctacaatcagcaagctagagacccaagagaacctatagtataactctagtctcaaggctggcaggtttgaaactcttgaagagctgatgtttttattgtgtctgaaagcacaataaagaactgatgtcccaggtcaaagccaggcaaaaggaattctctcttctctgggagagagtcagccttttgttcttttcagaccttcaactgattggataagtctcacccattttagggaggacaatccagtttactcagcatatcaatataaatgttcaactcatctaaaaacatcatcacagaaacacccagaatcatgtttgaccaaatatctgggcaccccgtggcccagtgaagttgcaacataaaattgaccaccacaatcacactctggggttcctggtagacataaacagggggacattgctcaatccatgacaggttattatcttaaaagccactggactatgttaaaaggattggagttgtagttcttactttaaaatgtttattttgcctttgatatgaggaactgtccatgaagacaagagcaagaatgaaatcagaggtagaagccagaaggctgagatgagagttggtgacaacctgacgtgggcataacagaaggttgaataattggtgttggaagtgacgtagcatttttcccacctgatgcttttatcaagttgttgctccatttttacttgatttcttccaacaactatatgcttatttctcaatcaaatatatatatatatattgtgtgtgtgtgtgtgtgtgtgtgtgtgtttggtcggctattagtaatcttatctccaaggtacgtttctttggattaagatttcaggtttttaaaacactactggaagatctgtgaatgagcttgttttgtgacctttgcaagaaatttacttgttcatgtgattcctggcatggtccttctcctttttactcccaagagagaaaagcataacatgaaggtgggtagccaggaatgttgaacacaattagcgatttggaagaatttaaaaatattcaatttaaattagccctagggtcagaacacacattctcacctaggggtggagtacacatgtgtcctgtctgtactcagggagctgtaacagtagccatggcctctctgtgtggatttataatgaatggagcacatctattttagatggataatcaattttgaaatcccttattgtaagtatgctgttaaaacagaaatgttaacttcatgagtttaatgagtagcttcgatgatagcttagtgaagagatggaaggaaaggcaagtggggggaaatgagaaaaggagaacaagtgtttaatgaatatctacttgcagacttgaatgtcagcagcaacattctccctcctggaaaatgtctttcaactgtgcatcccattatgttcctgcagcccgtggtagcatgaagattgagacaaagagagtgtttctaagaaagctctcctttacaatataatgagatggaggtgggtagtttgcagagattgctggagcagtggtcaaatatgaaaaaaaaaaatccagcagaatgaaaagaccatgttaaccaggagatggcttataatgagcccagaaattgcatatcagatagccagctggctagcatttcctcatatccctgtgttctcatgcaaactgctaaaatgttctcctactctattttctcagcctcttaatagttctcatttctacctactgcattgaaaatatgaatgaaatggcaactctaccacttgaagaaataagaatgaagcccttttcagcaaaagtatttgcctaaacatggatggatattatttcaaatgcttttgaaaccaaggaaacttctgtttctttccttaaaaaaacatcttaactttcaagtctcagtttgactcacagccttttcagtattctgtggcctcttttgctatatagtttggacagactttgcttgaagtctccaagcaaaaaaatggaagtcctcccttcttattggaaattgataggggaggcttggcacggcgcctcatgcctgtaatcccaacacttgggaagccgacacaagaggatcacttgaagccaggagtttgagaccagcctgggcaacatagtgagatgctatctctaggaaaaaaaaaatagctgggcacagtatcgcatgcctgtagtccagctactcaggaggctgaggcaggaggatcacttgagcccaggagcttgaggttgcagtgagtcatgatcttgatcattaaggaagagtcttgtgaaattgttcaatagttagggtattatcacctgtctactttcatggttctttaccttttggtgactgtctcttctttggtgactgtgtcttctaaaatgagaaagcagtaccaatccctaaatatacatctgtcaataacttacagcacatttgaaacaatattactgctgtttctaaacattccttttttttgtttttagcatgatctgttgttgcctgtgttcatataatttctgtcttggaaaattattgaagctaccaaatatttgcagctgtatttagatatagactttagattataaatatatgacagagactctttactgggccttttggatgcgagacctcagggatatatgatacgtgttgtgagcctcagctaaagtctgacttccctgtggctggtaacttctgttaccaatactttaatggtggggtcctgttggtgaccaggcgtaatatctcactgaatacaaggccgtagtcagaatcttggggttgtaggactagacaagcagaagtctctttatttaatagatgtcactcctgttaaaattctccagctatgactgaagggagttggcaagtagccaagaaaaatgtggtgaaaagggtttaagaggggaggaaatgtcaatgccatggacatttggcaaagtcgatcacaagagggtttttctacacatgtgttttctgctgatcctgaaatcaaaactgaataccatgcatcttttcccttaaaaaaaaaaaaaaaaaaaaaaaagagtacagtaggttggcacatgtgaatggctcctgatacgagactctgtatgctttctagcaaatgctgaaacaaattccagtggacctttaatgtatatggggatcttgtgtctgtgttccctcgtgtgtctgtgtttgtgtgtgcccgtgtctaggggaggggagttataaggcagggtgcttaaatgctttgttacattatgttaattcctcggcagtgcaatcaaattcatgtcgtaattaaagctgtcagttggaaggcaagccaatcgccatgaaaacacagcataacaaatgaagtgaaatgattctgcgtgtagctatacaatgcttcgccaggcatgaaattaaataagtaatttgatgttgacatcagaaattgaaatgatacccactgttccctcattcagtcagacctgcataaacaatagccagaacaaatatgcacaacaaagccctcttctccacccagctccctgagtaatgtacaatatatatgcaaaacgagcataacagagctttccgagacctgaaggatgtaattttctttggtatacgataagatgatatgtatgtgggggtagggaagtgggtttggtgggagtacttctctttctgggataaaatacatttgcaggaagggaaagaaatgaaataaacaaatcccatggtctctctgagtaattcatcctaaaatgagttcacttcccaggggcatgactccaagctggtggagacctaacttggcttttgctttcttctgctgctgcatggagggctgtgggtgctggaaacaggtgatgctgtcatatggctagtcactggtatgagaagttgtctccatgactactgtggatctccctccataccatttatgggattaagaatgcagcaggattttaaaaaactgagtgcagtgagcaggatcacacatctatggtgcttcattcccctgagcttgtgtgaaacgctgagatgaggaaagttttgctttgggagctgcatttaggaatgccttgaagcatactgttcttgtttgatgtagatatagttacagtaccatgtttcctcctcaaagagcttagcatcaagaagagtcaccatctgctgtatttttatagatgtcaaattctcctgagccatttttcttacacataatccatccattcatttatttatacattcattcaataagtccttattaaatgcatcctgtgtgcaagtcattgtgtgaagctctaagaagcaatgatgaaaaagccagctggttactgctgtctgaagtttccagagtagggggcaggacatgtaggcagaagagctagcagtgaacagagtaactgttgcatcagggcagaggtcattttgcttctgggaaagtataatacccaacccaagctcatcagggaagaagcctggctggtgcagggatgcttagctgagacctgcagacctattcagcatttgcttcaccttcatttcaagcttaatcacaaagaggaagaggatgctaaaaattaaataatttataaagagaggttttaggagaaaaaaagaaacaaaaatcagaatctcaggcaagtttaaaatacattttttgggggggcttcttttcccaaacaagtgatgccctgcattcctttcagaattaacatttttaaattccctgtgtgtcagaactatgacagcctaaactggtaattcttgtgacttaaacccttcagaaaaatggtgcttttcactgctcctcttggcccacacattctctgcattttagtctactaattacgtttacaaaatgtctcatttttgaaaagccctgtgtgtgtactaactgatgcctttagggaataaactggcaagtaggtcatacactggaaaagtcatccaaacccactgggctttttattttcaagtcaatctgggctttttcctcttgcctgcccctttgcggccacaaaactgagtagcttgagaccagggcattgaatgtcagcaagtcagggaggcaagctgatgcgtgtctgtttagtctcagtgcagggcgaaatgccatcattaattcattacccagctgcctgtcaaataaattggcaattacatccaccgcagaagcttggaattcagtaaatagcacgttagcatctctgagttgttgagagatgtaaaggggaaaattaagcaacacggtgtttgtatcagtagcagatgacaaggggcagcatacactggtgatgtgatgtggtgatgaaaagcctgcaaagggctggtaatgagctgtgtggattggaacgtgttaaaaaccattgctgattttccacttttgtctttatgctttattgcagagttcagctccttccagcttgggaacaggctacttcgtaagtctatctcaacttccacatatgtgccttgcattggcattgatttccttctataatgaatgctcattgggatatgaaaaaaaatctgagaatttctctctcagtcctaaagagcagactgatttccattctttattaggaattgttttatttttagaagacatagcctgctgggccctagggatcttaagtaagtccgaggtatatacctggttcctaacgcccaggacattaagctccttacctggccatgtaaggagatacagggaaccctgattagctcatgccaccatttctccacaattacttttttagtaagaagtgtcatgtgggggatggaattcagattatgcattgagataactgatttcttgaataacatctcttcatatacaatgagttgccttttttggtggggaggacggggaatggagatggtattttttaatgaatgttttccctcacagtctgggtagtttgcctttaggtttttctttcagcaataattaatatacttatttttgctaaaatgcaaagtttatttctgaaccttattctctgtcctttgggaaagatggcagtgaggtgacccttcagggattatcacaatattgtgataatcatgaatataaaattcattctcaaacagcagttgtcacttcattatatttatttatagtgaaattctcctttctggatttagtgacccttttcaagatacaaatgaaaaagagtgacaaataagcattatttgtacaataggataacatgtcaatgtaaaagtctgttgtgatgcttaaaggaatctgattggtgttctgagtgatgaacactgatacagtcatgcctcagtattttctgagaaaatagtgaaatcatgaaaatcaaataaagtggaaaataattactaattcactttagttgcttttaacttttctctccaatgctaattactctggttttcttctgcccacgtatttctctcgatacatttacattaaatttatggaaaccagcatcatttcattaataaatgagtattttccaagcttagcaaaagtggcattttctagatgttgacttttttttggtcttaatctgtaataggagaaaaagtataaggatgatttggacctgcttaatacagttagcacacttacccttgctcctacttattgtggctgaatattcatgctaacagaaacaagcaggatacattcagtatcctgcttcagcagtcgaaataacagacgtagccccatctggcatctcttcacaccaggctggatgtaggttgagatgctggaagtaaaatctggagactgcgatatctattctccatccaaaagctaaagcctccccctttgctttcttcagcagaaagaaggccaaagccactaccttagtccttgatcacttctgtactgaacattctagtattttttttttattgtcagtaggatcaccctgaaagaagaaagtcatttctagaaacattgagattttcattatgctttttgcagttatttttctctctagttccaagaatggttatttttattctctaataatatattcttatgatttaaagagtctttaattacatgtctattaataaaatggcttttacagaacattggatgagtataaaagttttctcttattttggtaaaattgctggtagacttactttgcttacataaaagtctgtcgtattattagcttacatggagaagatacataccagatgtgtattcagctttcaactgtgacaaaaatgccctgctaggatgtgtttccaataatgtgattgttatgttatcagagtgcaaaatccattgatattgttgcccagtcctcatgaaaagtatcttctatttcaactttctttccaatagtatcacatgtaataatttcagatactaacttccacactggtgagtttcatacttctaagtggaaatgatatgggcacaacttacattagttctttgccaacatattatttacactgtgctttgtgatttgtgctgtcataatagctttttacttaagcctgtaaagaaggctcagcttcaggtaagtgaaatggtaatttttcaagtctatccttactcctcttcagcatgtctttgaaatgtggatggagggaaatcacctgcagagtccatgagctattagcgcaattgaaccataacatgaattctggtgtaagaaagctgaaggcacttttaacaatctagaaccgttttcttgaacactgtcccaagccccaacttcacagacttcctttgtttctatttagagcttttgtcaacagaggtaagatgctgttcattgtgtttgttaataaaatagacacctgagtatatacatgtgcaggtgtgtgtgcatgcacacacacgcatacacacccttagccaaaaccagtatattttactttcagttcttttatctgtagtgatacattcaagggtttaaaggagaagcctttgtttttgatctggttgtatttgtttatatctccttggttttgtgttccaaagatgtctgcttaggtctgtcacttttccaatccgtttagaagcagaagatttgagaaatgagaacagcagctcaaatcagtatttacataagcatattgcaaagaattcttaaagtagacaaaatagagaaggattggaacaaactttctacatttttgggagcttttgaataatgtgggtgttatacacacagagagacacacatatatattcattacatactcatgcccagctcatattctaaatataaatgaaagtatagactagttggaatcgatttgctttttttttttcttttttggcaagaggactaaaacttgttagagtgtgtgtaggattttcttttttttttttgttttgaacgtcaatgcaatgaacacattttcttttcaatttaaacgttttaggctgtattttctccttaaacatgtatttgaggtttcaatttgcatagtgtataattaagaacttagaggcagaatgatcttttaagactacctgtatgaccttggtccggttattttatgtctctgagtctatttccttatcaatacctacctattagtgttgcaaatattaaatgagataagatattttaatgaacacagaatatcactctatactaccaaataataagtactgccttctgttattcacacaatcgtgtgtgatggagcaaagttggtctcatcaggtggctgtgcaatgttgtgcaaagtaggttttataatttgtacctgtaggatagtagtattttattcttattatattcttcttgtagctttctcaggagcacagcttttgtatttgatcagttatttacattttttctgtatgtgaacataaaacagggtattcatcctctgtgattctatatgaacatgacgatgttggaatgaactgttctattagctgtccacatattatggttgttctctgtaatttgtcagttaaagttacttgtgtattttcttcctcagaagcatttgaagtacttggagcttttaaagactgcttagcagcttttaggattgggctgagagggaaggtacacctgttcaatatattccacttttatgaacttgtatcacatttgctcctttctgacaagaaaaagaaaaattgatgccctagcatatatgaacacagtaactgaaatcagtagaatgaaaagaccagtgagaacatttcgtgttggccagtggtctggtatgtcatcacaggaaagatctggactcattctttatagcacttgactccatgtggagttgggagctacttttggggcaactaaccagccaggcagaacttgattcctgctgtaagggaagtacagccttacttttttccaagtgacatgttctgccttctctggataattttcagccctcttccaggtttgaatctaactgtcttagaaccacagcctcaaatagcttgtatcctgcttttgtaaactccataatttctcttaaggattctcaactaataattttcatcttcctcaattgggtcacatctagtaattgacatactttaaagttatcagggaaaacaactcacttctactcagtgattaaaactgccgcattatatagtaaaggggaattgtgtagtggtatacatcttcagacgggatttgtataattattgttttcctgtgcagttgaattacttaagttgtgtaggtagtgctggtaacaggcagtaggtgcaaaatattgacctgtagctttccatccagggttataaaggtcatagtgggaatattctttgcccctttctaagtttttgactataaacccttgaaatatctcctgttttcctttgctataattttgtataacttcttcttttttctttttgacagggtctcactgtgtcacccaggccatagtgcagtggtgtagtcacagctcactgcagcctcagcctttctgggctcgggtgatcctcccacctcagccttcccagtatctgggagtaaatgtgcatgccaccacacctgcctaatttttgtattttttgtagagatggggctctaccgtgttgccaaggctggtcttgaactcctgggctcaagctatctacccaccttggcctcccaaagtgctaagattacaggcgtgagccaccatgcctggctgtataacttctaaaactgatttggtattctgtctaaccatagttgctttttaaccattttcccatttccccagataatactcaccagtggtgcttgcggctgcaacatttatcttgatgtaactgccagaaaatatcttgcttttattattttcccattgctctagtatattgactttggaaacaaaagacgtcattctactcatagcattctattttcagtagtggtatttccatttataaaatatagtaatttttataaatgccaccatgcccagccacttttaaatatttctgacacattgtattcatttattttctgggggtgaattcttttattagaacattcaaattaataattttgtttggtttgcaagaaaactgatgccatcaaggaagatgaaaagttactacacaaatttcaacaaagatttctataatttataaatgagggctgggcacggtggctcatgcctataatccagcattttgggagactgaggcgggtggatcacttgaggtcaggagttcgagaccagcctggccaacatggtgaaaccccgtctctctaccaaaaatgccaaaattaactgggcgtggtggcatgcacctgtaatcccagctgctcgggaggctgaggcaggagaatcacttgaacctgggaggcagaggttgcagtgagacaggatggcgccattgcactccagcctgggtgacaagagcgagatctcaaaaaaaatttataaatgaggttgaaaattcattttttaatttaataatcccagtctcagatgccctttcattctttgaatttgcatatctctataatatttctctttcaaaattttctggttgtcttatatataataccttgtataagctgatctagcagtggctagataggatcagattcaggtttggattttggcaaggatgcctcatagatcatgttgtgtgcttcaattaggagccacatatttagttctttatttttattaatgttaacagccattgattagacccagtgttcgttaggagctgcaaaatggtgatattgcagttccatcattctgtaaagagaaacatctacattaactacaggtatttggttatcctgaggtacagttaacacactgtatttgaataagagggtttgagctctccagagaacctatcactatttataagatttcttaggggttttagtttcagaagtacagatacatcaacttggtgctgacggcagctccatccaaagcagaagaaactgtcttcttccccacttggcagtacttgctgtgatgctaggaaaggattttgtaattcaagtgttcattcatcacctgttaagtacttatatttaagataaataacattaagtattttaacacttccccccaaataaagaccctaatctttgtatttattagtaattaacactaggtaaattaatttttggccattatatattgacaaaaatctattataatggaaatatttttgaaaatctaaattttatctagaaatccatgaaggatatccagttattattagggcatttggactaattgataaggagttgagttggaaaactactctccagatggagatttcaattcattttaactcacaagtatgacttaaatatctactcttagttcttaagttgcataacgtgtaagcatggctctcaagtcaaagatatgtagctgaatttgaagcaaagcaaactgattggtctatgagaagtgtaagtagagcacttggaagtataaaggagggtcagttaaatgtagcaggcttaaattgtgcagagcttgatggatgtttagatagtcaacaggaaagaaagggtggaacaagtttgaggcagggggagcaacaaagacaagaatacagagaaattgcataatagtgtggattgaattgactgtatgatgtctctggagaaagacgggacttagattgtcagggaatgttggttgattacagggaatgtgggataaagccagggaggtagtcgggtgagtggggaagagatggtttgtagagaaggacgtcaagtaaaggatcaatgactacaatactcttacttggagttagtccccagaagaggagatttgaatgtaggaaaatggtgagtttggaagttagaatacgtagttagaaatttaagtgtgtatttaagtgtaacttaaaatctaggacattaccaatgcctttgaagctacctgtgtactgtgcagaaacatctgggcaaacgaaagttgttgctctcccttatggtgaaacattgtcacattttttaaatgtaaccttcaaaatactacccttaactgtgttttttcctcctagtaacaaaaccagaatctaaggtgcattctgacagactcctccacgtggcgcagataaactctctaatttcaagggccttagacagaaaatataattgtatttcccatgtctaattcttacccttttttggtcatgtttttgatctgttaacattttaattgagggaataggatcagtgagccaggagcagacacaccttgactaaatgaacagtacaagttaaactgtggtgagagacatttaaacatttgtagaatctctacaacaggatgacttttccagcacactctgtagaaattatcttctgcctacacactatgtttaacttcagcttcctcattcagtacaagggaactgagaaatttgacaaaaaataatcaggtgagaaaagatcaattggtgtttccagttgcaaccaataattttaaccctttcattttctcaacatttaaatgagggaataggctgggtatttttaaacatttgctgtctacaggaatctttgacattgctgttgcaaactctttaaggagataagcggaaaacttaggtgctactgatggatgtggggaaatagccctcagccgttatctctctgtcctcctaacccccatctctggcccctcagatttagagggaaaaaatgattttggagaacaaagatttaatgagccactaggcaagagagtggctaaaggaccttaatttctaatatttcaaaatttatgattccagctgccttacaactagatgtctgccatgtgcaaccattgcttgttgctggcctcactgcctttctttgctgtcctttgagccacaggaatgcaaggccatagtgctgcttagtgaacactgttcttcactgtcaacattgaaaggagtcctgatttcaacggagtggccgagtctgcttttgtttgaaagtaatgtattttaaaattcattatgaacaataatgcaattattcataatgaataatgttttatatttgcatcattcatttagggctagtacatagagatactgaagctgttggcttagcctgttccatagctagtagattgatcatagagatgaagcggtaaaggctttagcacagtgcattgacagtcccagagggaatggacaggtcattgccatggaattctgaaaataattttatcttcattttcatctttttttctgacattggctttaaggaaggttgtcttatccttgttggagatttccacattacagaaatttgttgcatttgttgatacaagctatgtaaaatgacccacaggcaatgtcaattccggaggtttactctgattacccacacaacccttattttgatagatttaactagcctggagttttattgactatcactcagaatctttcagatcagagaactcactcctttgcttaactacttaaaaaatatttttgctgaaattgtaaattagatgcctcccaatccattgcataagaaacttatagcttggtgaaacaccaagagtatcatttgaaaaagaggttaaaaaacacaactggggcttgttaaagaggaaaagtggtattttaactccaagtgtcacattttcctatagtcagctctagcagtaaacaagagttattggaggcttagatagtttgagacacttcacttatctcccagtacttgacttcagaagccaaacatttaaaatgtgttttgctcaggtaaaaatgtttatccatttaaaatacaatgtcattttaacaaaagcaccctggtgacaagctgtttagatatagcacagttgataaactgtcagatcctgtacacatacacttgaaaggaccagcgcagtaacacaaggattggcattataaatcactgttaacaaaccttaatttgcttagtaggctaatgaatgatctccaatttttcttcagtaattagcttcgctaacagccatgtcaaagggaccttccttatactgtatttaatctctgctctgaaatctttggtgtctagtttgcaggatgaataaaaacaaacaaaaaacatttcggtctccattggcgactccctggtaataaatccagatgtagggattgtggctgttttcaagtagaaacattgccaaaggtgatgactgtctattagggcttgtaaactgtaatataatcacagatttggaatggagtggtgaagccagataattgcagtgtttcctgtctaaatgtgctgctgtgcgtagtggcctctgattttaaggagctgttaaaaatgcagcaaggcataacagctgtggttcctagaatactcctaatatttcatatgttcatcacatctcataaaatcttgcccagaccaacaaatgactacttatctgtacagctggactgtcttagaaggaaattagagaaagtgtgaatcatgtaggttagcattacagagacccaccaagagctcatccaagcccgtgctgtgccatatttctcttactgctcctcagagttctccctttccatttttagtccccaaagagaacatttgcctcttaccatttgtgagcagatcttatcaataacttactttttcctacctttgtggaaaatagactcaactttgccaagagaacttagggttctggggcagagaaattcaggcgaagttaatatctcaacccaaaatcaaaaagagacaacaaatttagttctcttagaattttttaaaattaatttttaaaataactttgcaatagaactagctctgtgatatgaaaacctggtttttctgggaggaacattagtactaggacattctgggaagcaaaggaagctagtgaacccaaaatgttcttttaatcagatattaaacagctaagcatcatgaccaaatggaagccttaaactgcatttgtacagaggcataatagagtcacaagttgttttcgcctaattgtttctaaattgcccactttactaatttgataattacagtagacctattattttggttttacataggtccagagttacagaacctctaggtcagaagggacttcagaaatcaccttacccaatcaccaatctgagacatgactcaaaaagttatgtattattagagtaggctgacaatttggactgtgaccttgctcatcctggatcctgtccttcagttgttatagttgaaagtcacattaatttttctgccatgccacagtgttttcttgatgtcagtgactgttttcatatgtgatactgttacatcttttttatcaaaaagtctaatggattctgtcttaagaacgagcctttattgaaaaatctctgttgaagtttgtcatggtatacttagtatacttggcttattactttaacttatgtagattctgtcatgtcatatattgttgttgcttttagttccacactggtgaagatcatcaagtgctacaactgtctttgtggcagttaaatttcagtgctactagattttactcattgctcttcttgtaatgccccacgatttgatttacgctggctgagtattacaagtcctatgtatttctttccattggtgattcttatctggagctttaacagaaatcagacattgttcctctgttttggttatttatagatacatctggaaagagttttgagacaacctgtgggcatacttaacatactgtaccttttttctttgtagccatcgtgtacaactgctttaaaaaaattagctggacatggagaagtgtggaaaccattgttctgttacacaatggcaaaataattgaccattaaaatatacctgtgatagacttagttgtgatgtggatgcattcatggtaagcctctctgagttattctaatgtatgtgaacaagcagtattatgtaaaaatagaggaaaggatatgctataaaagaaatacagtttgatacagtatttatgttttaacagatatgcttgagtactttaaatagataaatgaaaaaactttctattatttgtagtaggtctatgttatacacagtagtgtcctgagaaattcttgagttgtgacatacatataaattttgaatacagaagggataagttcattttagaaattactgcaaattttgaattggtagagccatcaaatttgtaaagcttgggtcacatttacttctgtgcattgagtgtcattacattctgttttctttaattttcaaacaaagggttgtaccacgcttctctttgaagaggccttttggtttcagcacatctatgggtacgttgttaacactgtcatacctccagttaaggaatggtacacgtttagagactgctttttcaagtcaaggtgccaattatttcctgcctaagcactattttagtgaactcactttagtctaaaatcacttgttatttatctcagaatgttattaaacaaggataaaatcaatgcaaagccagcgatttatgtaaatcttataaaagtttgattttctttagatttttgtgactaacagcctctcagtcttccttggacaggggagtggttagagtttgggttccctaattctctcatcttacagcctaagctaagcctcaatggttgatactgaagttttgtgaccctcgttcaatgttcagaatctattattttagtacttttagtggggaaaaaaaattctgctttacttcttttcctgctgtgatgtgtacattgtgttatttttctactgggtgtgatttttgttatctttttcagcttcattgaccataattttacttattttaattaacatggatcttattaacagttttctctcctgtacgtttgtgtttgtgacatactcttcactacatacttgaattaagtaattttattatttttcatctttcagcagtatgcttattcttggttcatttactgttttgaagcaatggaattacttacatatttttatttttccttttctctcatcttctgttttccaacctctacctccatttggtcctataacatgataaaagtgcaaacatgagcctgaataataaaggattgcttcactgattgctaaacatatattatagtgctttaaaactcatttcaggtcatcgtggtggcaattagtttgattacaagcatttaagctgtcacatagaaagccttccacttcctagggcttagtttcaaatcatgaaaactgaatgctctatacttatctatgtacacagctcaattttattattttggaagaaagctatgcctgttacaaagatcactcataatttcagaacctggttaaagccagtgtgcaattttggagcagagacacaattttattaaaaaatttaaaatatgcatgtgtacatatatgtaggtagggactatcaaaagagatgtcaaaaccatctatttattctcatttttggatacagtacacattaccaagttgttacaatgtggttatttaaatatcatttgggccaggcacagtggtgcatgcttatagtcccagctgcttgggaggctgagttgggaagatcatttgagcccaggagatcagtgttggagtgtgctataatcatgcctgtaaacagccactgtactcccatctaggcaatatctcttaaaaaaaaaaaaagtaaaatcatgactctcatacattatacaatctacatgtttaaacattttatttaataatgacggaagtaggcagatgttataactttttcaaaggtaaaccaaaagaaaatccacagttatagatgaggaatattgaaatgagtgtgtagatggaggcagaactggcttcaaggaagtcagctgagtctctacctcacatgacagagtttacatgatgttagagaatgtttattttgcattgttatcacttacctacaacttccagacttgtaaaatagtttccatggaatcagaaattaattatgctggagagtgtgctatagacgatgcctagtgtttccttgaagcacatgttttcctatttgatgaaaaatagtcttaaaggaaggtttgtttatttaaatttggcctgatcatttacacgggtgtaccaagaatgttaatttagcatataagccttttaaactttgctttctctgatgtttttacaaaataaatctcctattgcacttttaaaagtattatttgctgtcctaagggtggaaagccaaacccaagaatcacggaaaggatcactgaaaggagtgatcaagcatgatcactgaatggcactctagaagtcttcactcagcccactggtctttctgtcaccggcagtacctgtaaatttgggtgaatttctttcttcttgatgttcccaaaatatcccaaagtaccctaccaagaagtgatctctctttccatctatgtggctggattctgtaaaccagctaccaggctagtttttctgggaggattggtactttatagagataaagtcacctttaattccctgtaagtgtttaatcatatctgattaaatgagcattactcacaaataggacattccagacaagatcttcaagatttttcatactcatcttggtaaataggaaggccaatttttactgaacccatgtaaataactgtgttgctatgaaaagtaagaagacttagagtttttggattctggggtgtcagaataagattccattttaaaacacttcatttcagtttataaaatcagaattgttatgagttataaatagcttaagaaaaaagagagcttccttatattctcagataatagaacactgacataagaccaacaatactcaaaacaatcatccttcatcatttcattgagtcctgtttaattaattcttgctgtactgaatcttgacttattaatctcatcaactcatctcatgaatttcttgactgaaagaagttctggaaatcttgactcagcccactggtctggtcaaagttatttaagcaatgacatcagaaacctgtacccaagagtctattctttgaagtcttaattattttaagtacctggtgcagttttttttttttattgtgggtgctctgaggttgtctttcttatttgaaaaccagaactctgttctactgtgttactgaatgcataactttcaaggaaacataaaagtaaaacaaaaaacggtgtaagtgacagactttacatggctgtggttaattttcacttacaacttttaaaagtgaaaaatatgatgagaatttataacaaaaataatgtaacgtatttgattatttctgtggcatgtaaaacaaagctagtaaagaatgttttacacaaaactatttaagcaaatgagctcatagaaactatgaagattttaacatatttcattacttttcagactcaggtattacaaagcaaggtaaataaaattcactttccatgttctgttctcattatgttctttcatattttggaacaaaataatactttacttcaagactattcatagggtgttccatgaggtcagaactacttccatagtatttctaagatgttattaccatgcagtatgctcattattgctagtttgaaatgaatcagcaagtcagcattttaaatttttttaagttccaatttttaatgttgtaaatatcaatagttaaaacccacacacactctcatagacacaaaataagctcattgaggtcctcaataagttttaggagataactgtaagcggtttggagaccaaaaatcttcagaaacattgcattaggacacaggtgttcttttccttgaaaaatggcagcatacacataattatatttcttagaaactgttgcttctagatatgatgtcaacttcttgcattagttttaatttttaaccaaattaactaacttctatttcacataaaaaaactgggggatagttacgatcttccttttccatatcagcattttagaggagatcatgaataaacataaccaactttctatagccacacacatctcttatgcaccttcataaattgacaacaatgaacacattcattaacttgacccaaagatagtcttctctgtagattataaaaataaaaagcaaaacgatgaaattttaaattatgattagtgctcagtgttttagtattctatcttaattagaaatggtgtaactatccaatgaatatctgttaattaatttaatatcagtctgaggtttcaaattacttaaaaatcttggaaattatgctcaagccaacatagtaagaagcataattactattgaagaaaagtttttgagaatattgatgcagtttggtcaaagaaaaataaagacaaacataaacataaaatagaaataatgctagcttatttggccaggaaaccagtatatttttaggtaaattatctagtgtagagttaaaatgtttactcatgtacttaaaactgataaagaagacttactgtttttattaagccaagatttattaaactaatcttatttggcaaagttacacgtaaattaagtgaacttgagttcataaaatgtttccgaggtaatgtatgcaagaatttattgtttaatttagtacatttaaatggttagagattcaattcttttctgtgaattttaggaatatttagtatatgtaagcacttacactgaataaggctattagaacaaaactcctttagtcttagagactttataatctcattattaataccatctgaggtaggaaaatattgtgcacacaatgaaaggtaaaggtacttttgaattgtagaccctcagatgtgtagaaagcatacagttccaattctagaatttcagccataggtcaagagtaaatacagaaacacaaaaagtttcactagtccaaattgcaaagagctattcctcttcccagtagacatgctgttcttaattatttgagctcaaaacagacacatagaccatcagaaaatactaacagactagaacttttttttctcaagtgttttaagtgatagaaatctaagcttactgtgtggcacatttcttaaagaagcttttctgtgtttaactgtacattttgtagttagcattttcattctcattgataaattcaacagacagcaggccagtcagcctgttttaggttctgtggatatagcagcagtaaataagacaaagtttctcttttcatgacactcatagttaatcaaattaatccctaatatgccaggtgataataggaatctaaagaaaaatattcatgaaaagagttgggctttcagtaaagaataacagggactgaatttattgttctattagaaacaaccaaaacaaaagataaaatacatgacacaatggtttgcatgacactggacataaggcagtaaggacagtgatccctgaaagaaagtaaacaaatgtagtcatctctttgagtgtcccagcttcctgccttgagagaattccaggcctccatgcagggcagagggaattcagaagtaccaagtggaactcagtagactttctgcattaggagaagatactgagagtccaggaagaacaaggtagcaaaaattcaaaggacagagtattaggggggaggggtgatgcacggagaaaggatcccagagatcttcagaggattgctttccgttattcattagagagttaattagctcatgcatttcaacaaacttcctgatgcctgggaaagaaccatccagaaggattagaggcaacagtgccttacattaacccatagccaggaacagtgctgattctcaccagcaggattggaaaaaccactagactcatggggcatagagtcaagtacatagtagggtcttgtctcagtattgagaaataatcagtcattgactgagcagtgctacagtttgccgtgacactttttattttttatctttttgagacagtttcattcttgttgcccaagctggagtgcaatggtactattgtggcccactgcaacctctgcctcctgggttcaagcgattctcctgcctcagcctcctgagtagctgagagctaatttttgtcatttttttagttgagatggggtttcaccatgttggcccggctggtcttgaactcctgacctcagatgatctacccaccttggcttcccaaagagctgggattacaggtgtgagccaccacaccctgccctcccagcacgtttaaaatgtgagttctgatagggtcaaactatttcaagtgacttaactgaattctaaaaccattttatggcattcaattacgaattaccagacattcaaggaaccaggagaataagacccataatgaagaggaaatcagtcaatcagaactgaatcagatgttagaattaacagagaatgatattttaaaaattatagtggtattccgtatgttcagacagttaagtagtataagagcaaaattgaacttctaatgtaaatactacaaggtatgaaataaaaaatatattatatgggattaacagcagattagacattgcaggagaaaagattagttaacttgaattcatagcaacagaaactagccaaaatgaaacatgaaaagattagagaatttgcagattgaacagagcatccgtgagctgtgtgaaaacttcatacagtctaatgcatgtaaattggagtctccagagagaggagggtgagaggacaaaagtaatttccaaatttgatgaaaatagtgcagaacatcagaaacataaagaaaattacaccaacacatattataatcagatttctcaaaaccaataagaaagggaaaatcttataaatagccaggaaatagtaaaaagacataaatgcagaggaacaaagactgacagcagatttttttttttctggaaaaaaaaaatgcactggagcaacatccttaaaagtactagaagaaaaaattgccaacctagaattgtatacccagtgaatataactttcaaaagacatggataagagaatgagatgataatccacaggctaggagaacagttttgcaaagtttgtatctgataaaggacttttatgcacaatatataaagagatcttaatattcagcattaagaaatcaaaaagcctagttgaaaaacgagcaaaagatttgaactgatgtgtcactaaaggcaatatacaaatggcaaataagcacatgaaaagatgctttacatctttaattattacataaaagcaaattaaaaccataataggtatatagtaatatattattacacacctattaaaatggctaaaatgaaaatgactgactacagcaagtgttggtgaggatattgaggaattgcaactcttttacacactagtgggaatataaaatgtacaaccataaactctagtttctctttagatcatgtaaatctttcccctttttaaagatacaaccaattgagagaacagtttgataatttattaaaatgttatatatgtatgtacaatatattctagccattccaatcctgggtttttacccaagagaaaagaaagcacatgtccatacaaatattttacatgaatgttcatagtagctttatttgtaatagccccaaattggaaattggccatatgttcattatcaacttaatgaatgaaaatttggtatattcatacaacagaatactacttagcattaaaaaggaacaatgtattgatacatgcaacaacatggattcatctcaaaataattatcctgagtaaaaaaagaagccacacaaaaaaggtacatattgtatggttccaatttatataaaatgctagaaaaagctgtttaatctacagtgacataaagtagatcagtggttgcttggagaggcaggcacagaattgggagggaggcattaccaaggggcaggagtaaacttttgtaggtgatgggtatgttcattatcatgactgtcaggatggctccacagatatatttataggtcaaaatttatcaaattttatcctttaaatatgtgcagtttattatatttcatttatacttcagtaaagctgttttaaaatgattataaaaactatttccctgctgttgttaacaccctgagatgtctgcctcttttcctatctttctgtgttttaaatacaccagcctactgcactttaatacctctctagctcagacagctacacacaaaacttactctgaagaatgtcaaaatgcatgttttcatcagagaaatatctcatggtcctttgttaaatgttcaaaaattcatgattgggctttataaggcaaatatgtcctgttttatagaattacgggagagaaaatgcatacaaaagagcccaatcctttttttggctggcttttatgtcagagctcaaaattgctctctgataaaatgtaggccaccagattgaattacttcattgaaccactgctgtcctctgttaatggtaattgcacagatatagcagtctttctcggcaacatctcagatatttacctcccactgtttttcaattcaaacctttgatgaaaatattcccagtacttctttaaagcagacatccaactgtctttcttgacaaaagcaaggtctctaaatcagatcctgacaatttgtgacacagcagtctatccaaatcaccttttacctatgtcactatgtcatttcctgaagaaaaaagtgtccatcagacaagcaatttctgtaggttttgggggctggaaggttggtatgccagcaaaaatgagagaggaaaagggaaaaataattttttcctttgacttgtgtggaaggaattcagtgaggggttgaccagatctaataagcaaaagaggggttttgtatatttaaaagatacatttttataaagagagatctatagatatttgttattttcaagatggtaacaattgaaacttgaatctagtgatttctgaaagctgctccctttaaggagacagggaaacaaggttagtttttttttaattcttaactttttctgttagactactttaatatgacaatatttagcagtttattttctcgtcagggattcagctcagtttctggtctacctcctgtcctgaactgagcagactacatttcctcacatgaaggttgtaggttgtacaaacaatgccactggcatgaaccatgatcagcgctctccacttgactcatggtgactttggaggctggagtgcagcacatggtaaccaggagatcagctggatcagcctcagagtgaaactcgctgctattatctctttggctatggttggttgggtgctttttttttcccttttagtattggaaggatataattgatacttgctttcttggatcaaattgtagcatcatatgtttgactgatgggttagttgtaggagctgtcagagcccccctgggacctgctttacaggtttggtgaatgagcagctgacagcacagcaagcacactttctgctgccagcctggttttgttcttcccaggtggatgtttcattataggaatgggcctcaaaataacatttgcccaggaatatttctagagagtggtcatctttggtggcactgttatggtggtatgttgctcatttagagtggtctcattcaagcaagacccatacatcatttggggagaacagtgaggaaaaccgtgggctgagctctggggagggttcgatctgggaataaggcatgtcctagaatctcagtcaggattctactttcaagagacagtgcaaggctcctaggaagttggggccaggaggtaattaaagaggtagaaagagaaaatcttttaaaatcaagtttctgactgcatgggctcttgaatgtggtctttactttgattgtggcctcaacatacaggtggtagcagagtccttgaagggcccttgacttttttttttttttcagagatcagggaatttgtaatttagaaggagaaaactggcactcttgtgccagtaaagcctctgctgatagctgtgtgccgtttgtttttaatcctttctcggtatccgtctctggccatccttatctttactagaaatcaaaggctgtgaagggaccaccagaaaaataaataattcatagcttttcaaagcctgagccccaaatactcaactttcaaagcatgagccccaaatatcccttcccttgggcttgaatttgctaaactggagcctgtgtttactctactagggtaaccaagtattcaagagctcagagaaaaaaggactggccactatacctctttggaggtaagagaggagcccgtgtgagttcatgtgtagaagaatcactttcacctggaatagaatgtcaatcccagaatctcactatctggcaggcaggaagtgataccagtttctggcttggaaaggacatctgaaggatcctgttggttttgttttgttttgttttgtttttttctcctgttggttttgtctgctgacacgtgggtagtgctgacccagtgtctgaccggattgtctccatccataacttcatctagccctgtttacaaaagaatgaacacaagtgacagcctcagtgaacctgcaccatgaggatgcccttacttctcccacactctcactttcttctcttcttggctcctcttcccctgtacttctctctgttgacatagaatatgcaaagtccaagagatgtggcaatgccagtaagagctaagttacttgcagctggcggtgccacctgtgcctatcaaatttcagccaaagcaattgctttcccagaatgccctgttttggggaattggaaagtgaatctgtaggggcggcaatggctgtatagaagagagcttttctctgggctcaaatatgaggacaaaattgtgaagtaggactgtagataatcccaaatccccacttttgcatcttcctgagctcagaggcaacccaagagatttccgagttaatcctttggactttaggtgaactctcagctagaaccatcgtttgcaagcagatctcctgtggaggtgacagttccataacctatcctggtggttgtatagttgagaatgtttgtgattccttctctctccacaagacctcaccacttccagttatgttcattttatttttgtttagtcatttttgtgcttagggaacaatttttcagctttgtactctcacctcataaaagtcctttgtatcattgtgaaaaagcaagtcaaggcctggcgtggtggctcatgcctataatcccagcactttgggaagccgaggcaggtggatcacgaggtcaggagtatgagaccagcctggccaacatagtgaaaccccatctctactaaaagtaaaaaaaaaaaaaaaaaaaaaaaaaaaaaaaaaaaattagctgggcgtggtggcaggcacctgtagtcccagctacttgggaggctgaggcaggagaatcgcttgaacctgggaggcagaggttgcagtgagccaagattgtgccatttcactccagcccgggtgacacagtgcaagactccgtcttaccaaaaaaaaaagcaagtgaaattgacattttaatttagtctgactgcatttttctataattttctaagaatttgtcactttttagtattttctcttttctgataaactgttccagcttttcatcactttttaatcagctttcatcagttttatcatactcaacctctggtatttttctttgtatgctctctttttctcctttttttgttttgttcatgagacaggtcttgctctgttgcccaggctggaatgcagtggtgtaatcttggctcattgcagcctcaaccacctgggcttaagcgatcctcctatctcagcctcccaaagtagttgggaccacaggcacatgccaccatgcctggctaattttttattgttttattatttatttatttgtttatttatttattttttctttaagagatgggggtctctccctatgttgcccagactggtgttgaactcctaggctcaagcaatcctcccaccttggcctcccaaagtgctaggaggcatgagccaccacacctggctcttttctgttgttcattctcttcacccttgtttagatcctaaagtgacccaggcacttcaggatctgaagatagctggatgatgatgagtcttcttaaaaggtagcattttatagcaaacatgatgtagagccactgaagggttttatagttgctgtcctcaggggctggatttttaaactggaatatccatggggactttgaaaattccacctgctggggctctacctcatttgagaaccactaccttaataagttcatggccttacaatgggagtgggaggagaggtgactttggagcagacaattacaatgtgagtgacagttatctctttcatgagtactgctgtacaaactgggaatgcctgatctggttcttggagagggagtggaggttaacctgatttatgtaaagttgtagtggtcatggcgggggaggaggttgcattccatgaagcaccatttggaaagacccaaagtgtggggcctggttatttggaggacctggagatgttgttggaatgcttagaaattacaggaatgaggataggaaggagccagatcccaagtggtcttgacaagtcttgttaaagagttttcatttcatagtgcaagtgatgtagagccactgaagggtttcatgttgtagaatttattagatgtgtgtgagagatagctcactcagttagttttgtggaagatggctgtgtaagcatgagattggaggcaagaacttcaggaaaaattatgatgatgactgggagagaaggtggacaattctagagatgtttagaacacaaaattgacaggacaaagtcaacgagtcaatgtggcagtgatttatagagaggcctcaaggataaccaagtatctgctttattcaaccaagtgagtgctggtacaattcactaagagaggcagtataggggagtgaataagagcacatatttgaatcctagacctgccactcgcctatgagttacattttgggtgtattcatttttaagacgtccatgggatgagcaaagaaagagatcctgtgggagtttgagtctggagctcagagaagcagcctggacctctggtgcacgtgatccatgcagtccatggatcagaactctttcaggaaaaaaaaaatgcggttattaggacaagtgttgagtatgtgtgatttttatttctttgtgatttagctggaggactatagagctgaccagaataaaggcaataaatatataaataatcatctacctatgatatactcaaggcaataaatatataaataatcatctacatatgatatgagtatatcattatctgctgtcattattattagtgaaggcatgttacatatttgtttggaccacagcatactttcaggaaactcttgataaacagctttcttttttatttattgccctgctttcttttgattgcttttgccgtagcatcaacctgcatcttattttaatcatctcctctctgaacattgatgattccgcagctttgttagaatacatcttgggagattccattttttaaaggctctttcaagggcatatggcattagatgattatgatatggcgcatttagaatatgccatgatttctctcctgctgaatccctcacacgtgtttgaagtaattattatcctctctgctagctcatgagacttgttagatcactatttgtgggtgtcataaaatgttggcaagaccccagtgtgaaacgcagtgtgaaatacatgtggttaaacttctctgattttgtatgtcaatcaaaacaaaatggcttaaaacagtagatgaatttcaaaagaaacttcaggattctagagcaaaaatgacacatggaactctttaggtctgtgttttgatatttaattcagggagtcatacacaggaggacgtatgcaatatagtagaatttagatgtgttatgattatatctgataatgttacaaatactgagcagctttttgttacatcatatttggtcccaaaatgtcatgccatgcaatgctgggggtgtttaaataccaaatttatgcatattttcaaggaagaagcagataatcttctaactatacagactgtgttacttatcagaaataatagtttatgaattgtcaaacagtgaaaattttaaaccatgtatccctgataatacttttatgtcttcattaagcatcactaatactgaatatgagtatctatctgatgaggaccttagaatcttattatagttagatataacaagattttatttattgtttttatcatggtgaagggtatataatgtcagcatgatctctcctttagttttacctcttctggtgttttgcagtcttaaatgggtgtctttaggaatatcccttatttctagttttagagctcttacttctagttttagagcttctacctaataaaggtataattagattggtcttttctgcatttattaatcaaagactattcttttacatgtgactttttagcaacatccataatttaagtgatatttgcccaaatattatctgtactcccacctttacaagaggatttaataacttaatagagtatgttatagtaatgagttggatgaccaaatatatttcaactaatagaaagaccatgatgtagctgctgaaatacctgagaaaggtagcttaccatataaagaaagacagctaggattttgatcaccttcttgctttagtgaatgatgctagatcttcctccaacgtaaatctttctgctcactttaattctagatgtgtgaattcttgacttgaggactttgatgtcagatttcacctacttgaaggcccattggaagaataacttctaactcattaaacaattccccatttagccaaagttagtctcatagatgtctgtgatggcttgttaggtggcacagtgactaaatttgatgctcagaaaagatggtcttaacaaagagttctttcttttcacacaagtgtaagctttctgacagttatcacccaaaatgcatcttgttattgttgtcttttctactcatggctgtgagtgtcagacactgtgcttccattcactaacatgaagacatttgtgaaagggccttcatcaatatctgacactggtgaattgaagaataatatactagctacataaaactgtgtttattcttcctaaaccaatcattgctttttgcagcatttccaatgaaattgtgattttttagcagattcttctttgatggagctgtgatttgcaataatcttgtcatgccaggctcaaaatactactaaatgaagacatttgtggaagggaatgattgtaaattgcatgcaaatttcaactcggctggaattaatcaatatggaaacagaacttgtgcgttcctgatataatgatgctgaaactaatcccatggagttctatttccgtgggaattaggcagttattttgctttaaatctatctctctctctcctttttttacccttgaagacaaagtcctgtttttgagttttttaaaagtaacttctttggggatttagagaggttataaaggaaacaggagtaaaatcaagcatctgacttcccctgtggggacatctgacatttcctatttaatttgctgtgcttgtttaatgaatctttcccccaatttttcttgctagtttttttttttcactgaaaattctaaggcttatgagatagtaggtgatgcaatctttattctatgttaaatatgcgacactggtctctaaatgggatgttctttcttttacaccagtttcttagggtgatcccagcttatccttgatgaaagctttttgtttttgttttttaagtcgcttttggaggaacaggtcaccaaccttgactttttaatgcctgcttacattcaaatttctcattttctttgattggcaagattaggtttatggccttttattcttacacttggcaactagatcggttaaccttagattatttgttccccaccttttcttcagctgtttaggtcacaaatttgtagaaaggtcttatcattggcatattttgtaccaccagtgcatcagtgctatactcatatatccttagaggctgacaacttacttcccagcccctttggagtactttaagaatccctttatttatagcccagcttaagccccagtgggtaacactccataaacctgcagtgacatccagtggcctcgtggtgtaattttttacaaacttttctaaaaggaattacaggggcagtatttcctgtcaaagaaaaatactgttggagttattgaagggggtttcctaaatacatttatgtacaatagttactggcatactccttgataggattactaggagaatgattattcattttttggtttttgagtgaaggattaacggcctctgatgaaatcagctttattccaagatcagataaaaaatataaaattgaggacaatatttttaagaggacaatttttaattaaaaaaaatcaacagtgtagaatttcctattctggatagatttaagaaataaaggagaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaaaaaaaaaaaaaagaagtaaaggagaacctttagtttgtgcaactgatcatgaagtttaaaattctatgttgttccccttcttggttcttgtgcagtcaatgtctttgagagtcttcttccactgtgttaactctttaattttctcaaaccacctaagactgctactataaatcagagccaagagattcccaatctgattactgtctttaattgtattattaaacgaaaacatatttttataaaaatgatgccccattattataaaatatttacgtggtagaaaaatgtacgaagaaaatgtgagcacatcagtgcaaatcttacccttttcacagaaataaccagcgttaacatttggtaaacctctttgaaaatgctctctatatgctcttttatattctttccatgcatatatattgatagaacgataaataaattggaagctaagaaataatttcatgatactgaattgaacgacttataacggctgtgtttatttggtttgtaattaccgcaaaatgttatactaggtggggagaggaccaggaagaggtttgctttttttaaaagagatgactttgcctttcttgtgacagggagggctggctaggcaggatcaggtttgggagagggtcaatagagaggagtggtgtgcagccacctcatggctgccagctatgaggtttggtttagataagttaactgaggctggaatgggacagcatagttcatatgtttaaacacccaggacgagatgttcccagagctcagagagttcatacgagtaagtctagcatgtagaaactaagccagtagaatgttccaaactgatgctaggcacattcataccaaagatgagtgttaggttgtggtggtggggggggggggggcagagggggagggagaaggagagggagagatctttagatatctttagcaattgatactgaaccagaaatttgaaatttagatttcgctctgtcatgcccattccccagacacttctcagatacaatgcaaaagccatatgctactgggagagaggcaagaaacctgtttgccattctagtcctaacaaagattagctgctgtgggggaaggactatgaatctccccctgctttgcaaagaaatggggcaaacgtcgtttgcagttgagagagatcattttgcccatgattctgcactaatgcactgatcctctacctctggtagaggaacaggaaactttctcatgcccaagatattccaccaatacaaggcaaaacttggcttccccgtgggagggatgtggggaagaaaactgattgtatttcataccctgaactgagtaggaagcagagattacatgtcattggggtggaggaagaaatgctaagaaagtcatgtacttgagtcccagatgtgcagggctaggctaagactgtgcttggagcaggagaactgagaaattctccttcccccctccaagagccttcaaccataacaaagaaacagtaacaggcttgcagtctactgctagaggagtggcaagagcatgggaagaaacgcagacaccctgcaatgcttatgtgcaggtcctacttaggtcctactgtaagtttagggtggatcctgaacactgagaaaacctttttgacagcaaaaaataaaataaactttcatttctatatagatttagattacaaagttatgcaggtagaattctcgtataaaatcaatctagttttccctgttgttacatcttacacttgtaagatgtagttgttataagtagatgtaattgttataagatgtaattgttataagtagtaaaccaatattgctacattattattaaatgaagtacatactttattcaaattttcttagtttatactttactgatctttttctgttgtagtatcctatctaaagtaggatactatgttgtatgtttagtcattatatctcctcaggtgcctgtaagactgtgacagtttctcagatagtttttctttttgatgatagttttaaggagtactggtcaggtattttagagaatgttcttcgattggttggattaaaaaatttttttgatgtttttctcatgattagaccctcagttggcctctgttttgaatcttctagactcacaaaagactatgtcacagcagtctatcagaggaggaatttttatcctgtggtgcatcaacactagttatagcaacagtaaaatacagacacaattcaactactgagtagatttattcagtccccccatgctaacagcttgaaagaagtagttacccatttccaggtagaaatattatttacctgagtttcttttatacataaagtttgggttcaattaaaaaaattatgacatagacacactcacgtaagataaaaaaaaaaggtgactgttcaagatgtaaaatagtcaacaaaatctgacatgcaaacttcagacagggaccttgaaataactatgattactgtattaaaaggtttaatggaaaaggtggacaatatacataaatcgtgatgtggaattttagtagagtgatggaatctgtaagagtcagaaaaaaatgctagaaatgaaaaacacaatatcatatatgaaaaaattttctgtgggtttatcaacagacttgatacgatagaggaaagaataagtgaccttgaggataggctaataaagcctttcaactgaaatagagcaaaaagagtggaaataaaaaatggagcattgccatagaaaatttcctgaccgcctaacatacttcaagagagagaaaataggctagaagaaacgctagaagagataatggctgagaattttccaaaatgaaagatagccaaccacagactcagaataaatatgaagaaaagcatacctacgtacactgaagtcagactgctgaaaatcaaagataaagaagtcttgaagacagagaaaaaaataaatattcatgcagaggtataatagataaaagctcagtacattttatgtcagaaattatgttagtgaaaagagttggagtgacatctttaaaaaactgaaagaacaaataccctcaacctagaattctgtatccaggaaaaatatattgcaaaacggaaagtaaattaagtcttcgtcagatgaagcaagagaagttttgctagcagaacaggtctatctgaagagcttacaggaagctcttcagacagtaggaaaactcttcagatagcaggagtacgctgctctatagaaagaacattttgttctacacaaaggaatgatggacaccagaaatataaaaatatgaataaacagacaagacattttttcttctaatcttttgaaatgagattagagtatgggttgacaatgagcctggtatggtttgactctgtgtctccacccaaatctcatttcaaattgtaatccccacgtgttggaggaagggcctggtgggaggtgattggatcatgggggcagttccccactgctgttctcatgatagcgagtgagttctcatgagatctggtggtttaaaagtgtgtgacaattcctgcttgcttgctctctcctgctcccctatggtaagacgtgcttgtttccccttcaccttctgccatgattataagtttcctgaggcctctcagtcataatttctgttaaggctgtggaaccatgagtcgattaaacctcttttctttgtaaattacccagtctcaggtagttttttatagcagtgtgagaatggaccaatatgagtcaaatctaacatcaggcttgttttgtgcagcccatgagcaaataatttattttaagggttgtaaaaaatttttttaaatatagaataattaatgcatatgcaacaaagagcatatatggcttgcaaagtctaaattatttactatctggtgctggtttaaagcaaaaataataattctatattatggggtttataacatgttaaaataaaattttggcaataataccttaaaggatgggagggaggaaatggaaatatactgttgtaaggtttaaatggaaatatactgttgtaaggtttctgtacaatacatgaaatagtataataacatttcaaagtagactatgataagttaagaacgtatattgtgaattttagagcagccattggggaaaaagataaagtacaagatataattaacaagccaataaaatgaaatcataaaaatgctcagctaatacaaaagaaggcaaaaaaattaagaaaaaaagggaacaaaagaacagatgactttttttaaagtataatagtacatagataccatatcatccttagcaataattacactaaatataattggtcagttaaaaagcagagattataaaattggatagaaagtaaaacccaattttgtgctgcctgcaaaaaacccattttaaatacagagccatgactattttaaagcaaagaggatggaaaacagtatgtcatgcaaaccctaatcaaaagaaaactggagtggtctgggcttatgcttataatctgagcactttagaagtcggctggatcacttgagttcaggtgtttgagaccagcctggccaacatggtgaaaccctgtctctgctgaaagtataaaaattagccaggtgtggtggctcatgcctgtaatcccagctactctggaggctgaggcaggggaatcacttgaacctgggaggtagaggttgcagtgagccatgattgcaccactgcactccagcctggatgacagagggagactctcaacaaaaacaaacaaacaaaacaaaacaaaaacagaagtggttttgttaatatcaatacagtagacttcacaatattaccaagtataaagcatggtatcacacacaatatagtgataaagggatcagtccatcaagaaaacaagaattcatcaagaaaaaggcctatgtacacaataacagagcttcagaatacataaagcaaaaactaatagaattataggaagaatagacaaatctactaataaagtttgagatttcattgctcatccctcacattgatagaacaagttaacacagattaggaaggacaccaaaaacttgagcaacactaccggtcaccttgactcaatcaacatttatagaatgtgcccttcaacagcaaaatacagttttttgtccaaatgcacatgccatactcattgtagacatattttgagctattaagtaaatttcaataagtgtaaaagcattgaaatgatgcaaattatgttcactgaccacaacagacttaaactagaactcagtaacagaaggatacccggaatgtcctcaaatttttggaaattcgataacatacttttaaataacccatatcaaagagtaagtctcaaatctaatttgatttttacagtttacatgcctcttttttctaggcatttaaaaaatatacagaagtacagtctagactgcacatgtgtatataattgatgacagtgacattctctcggaatttatattaatgtagtgcacaatatatttgaagtacatttggcataaggacgtactaagtcacaagacttgtttggggaatgtgatttctttggataaaattaaattccttgaacttgacaactaatcaggctgaaaaaatacacttgaagctttctgatacattattaaggaagttacagaatatccatgaatttagttagctttacactccagtggtactcctgagtattttgtaattgaactcgttgatcttcagatgtgaattggttcttcagatctgtgaccatcagtctgtctacaaacatttatgcaggctctctgagcaagatgcctttcctcacggtggtttctaaactctcccaatattttcagctgcctgggtaggaagcattagggcagacgcccaggctggaatgcagtggcgtgatcttggctcactgcaatctctgcctcccaggttcaagagattctcctgcctcagcctcccgagtagctgggactacaggcgctgccaccacacctggctaatttttgtatttttagtagagacagggtttcaccatgttgactgggttggtcttgtactcctgaacctgaggtgacctgcccgccttggcttccctaagtgctggaattacaggtgtgagccagtgcacctggcctgctctgcttttaaagaagcagaatttgtctagatgtttttgaagaacattatgtaataaaatagcagtaagagtatgaattctcgatatgtattgaaaattagagtctttaaaagtcttggtgtttagaaattaatattagttttaatatgactctttaataatgaagaatataaagttctctgtgtgctggtgagaggactttttatttttactcctggaaatacatgatttgtaccagtcacttgtgtggccataatatttttgccctaaatattaggtcatcatttcctctttattgttaggtaacccagaatgctaggtattctctaacagaagaaaaaaaaattggtttgcagtcctggtaagctgttggagattttaataatcccaataaaatatttccatttttcaaatgtgtttagatgtccttggcagatttagattagttacatgagatggatagaaaacaggctcagggcttagggtttattttgatgatttttaaaatttgttgaaataagagttgttttatttaaggaaaaaataatatttctggattaagtatttcaaatgcgttatttttggagagatgctacagagcttatgtcaaatgattattaatatatatatattttttttgagacggcatctcactgtgtcacccaggctgaagtgcagtgtcgcgatcttggctcactgcaagctctgcttcctgagttcacgccattctcttgcctcagcctcccgagtagctgcggctacagacacgtgtcaccacacctagctaatttttttgtatttttagtagagacggggtttcactgtgttagccaggacgcttttgatctcccgacctcatgatctgcctgcgtctacctcccaaagtgctgggattacaggcatgagccaccgcatacggcctattaattcttaaaaacaattgtgaccatgatattagcacctaaagcactattccttttcttagccttgggaagacttcatggtcatgaatactattaatttgattttttaaaattatgagtgccatatggctgtagaatgcagaggtttcatgaaatatattcagtgagaaccagaagtgatttactaatgcctcaaactcatttaaatatctaccaattcaacatataaaattgtcttcacgagaaacattacggggtatgattttgtatttgatcataatgcttgctaattatttcctgttagtattactggtaaaatgggggttggcaaattctagatagtgatgccacatatgtgtggtgtgggttccttacaaaactttatttgctgcttaattttgtaacattgcatcattccctaaatagcctcaagatccaaatacaattgcagtaatacttgctgaaaattggaaactattaaaaacattcatttgctgggaatcaggagaggggagggaatttcaaataatagaggtttttttttattaaaaaaaaaaactcacaaaatctttgatccactgtctctcaaaaggcaatttgatagctaaatgcaagtattttttttttttttttttgagacagggtcttacttcttcgcccaggctggagtgcagtggcatgatctcagctcactgcaatctctacctcctgggctcaagcgatcctcccacctcagcctcccaagtagctgggtctacaggcatataccaccgctaatttttgtatttttgtagtgttggggcttcaccgtgttgtcaaggctggtcttgaactcctgagctcaagcaatccgcctgccttggccttcctggtgggattacagggattacagccactgcgcctagcctaaatatattaataagttttaaagttttatattatttccatttctattttggtagtaaaggtaaatgaacaagcattatagatcacagacatttaggttaaaaggtccaagctctttgagatgggatatactagggacacgttatcttttttttttttttttttgagatgaagtcttgctcttgtcccccaggctggagtgcggtggtgcgatctcagctcactgcaacctcactgcaacctccacctcccgggttcaagcgattctcctacctcaccttgccgagtagctgagattacaggtgcctgccaccacgcgtggctaatttttgtatttttagtagagacagggtttcaccattttggccaggctggtcttgaactcctgacctcgtgatccaccttcctcggcctcctagagtgctgggattacaggtgtgagccaccgcccccggccggggcacattgcctttataactctatttaattcccttgcttgcacgttgaatagatctaaatgactgggggaaaagtaaaaacatagtctttagtccctttcattgtggtaaattcactgaatgatagacggaaatttcagccttcttgggtctactgccaggttctgtagttatttgtatgtctcatggagaaatcctcattgattacactgtatggctaaactgacttaaaacagataactgagcctatttcaaaattgaaaattctttaaaatggaaagttagtactctattgttcccaaactgttggattgcatgccattttcccaaactcacagacgttgataagatttcaggcaaggggaacaaggaaggggtcacagtggaagcgaattcttcccctttttctgactgtgtttgcccacctgtcctttacccttcgcagttctattctgagaggtatgtgaggaagatgggagccactgctgctagattgttgccattaaccagctttcatggcttttgtgggagcctccttttcattagtatttgcaacatgttcaccagcaaaatgattatgttaggcagagacatcacatcacttacatttcatagctcagtgcaattttcataaactgcgaggcaacatccaaaaaaaacatgactcagaattagagtttcagaagattattatatagacattatttccctcaggtcacgggctttagtcaaatttggaggagaatgaaattgccaacagtgaaaagcagacagaaaggtatgagttcatgagcagagaaataacattttcatttgttccttccccatgggaaagattcagcattccggtaaatggagacggttataagaaatgaatttttgtcagcagggatgtgattttaaggctcacttatccattggcaatctagatttctaaccccaggaatctgggaaattgctacagaatgtagtctttattataaacaagtttttttttttgggggggggtagtttttccctccttcttttcttggtcagagctttttaagacgaaggactacatttctttctgcatttctggggtcagatgattgcagatttcccatctgccctgagtttctctccattgctgttgctttgtgatggaaaccctttctttcctcctcaccaagcttccctcactctgtcgttgcttttcctaacccccctgtgtttatccagcacgacactgacaatattgaaagctgcaaacttcctatatggccatggagtggtggatctatggcctgatctctctgttccccagcatttacaggatgtcttgtgctgctgctgattctatatcctcagttcttttgtgtctgtggacctgaaagagcaaggcaggaaatacagctttccaggtagctctcattttaccaggtataaagagcgaggatttgcaaggtttctgtaaggtaatcccagacaaccttcttcgtaattaaagaacgttctttcatgggaaattttattttccttcttcgatttcatcagatgcttctcagcccatcactcattcagattctatgcaatggttctttttctagctagagtacatccttgagagtagaaaatatttcatataatctaaacccttcatttctagagatgcagatagattctgtaacattaatctcacctttatattttttcaatttttaataacttgaaaatatgtatatctaatgccttctttccctatgcacttttgcttattttaatatttctcaacaccataagctatttgcccagctgcatccttattagacagtgctattgcctgccaaagctttttgagagcaaattgcattgccttcattattattatgtctacaatataatgattatgaaacatcattattatagttgattaataaatgataattgatgactctcagttcataggatttggcccatgaaattcatcacaatttgtaaacttttctccaaaccttcaaggattctaaaaggattgattttgctgcaaagtatatgcgattacattttttgatacctagtaagtagtagtggttgaggattcactggcctggccagagtgagggtgtatactaaatgtctgtggggtttcaatttcttcctattgaattcttttaaaatgtagagtctcttaccactgggagtttggggaacttcgcacagtggctcatgcctgtaatcccagtactttgggaggccgaggtaggtggatcacgaggtcaggagatcgagaccatcctggctaacacagtgaaaccctgtctctactaaaaatgcaaaaaattagccaggtatggtggtgggtgcctgtagtctgaggcaggagaatggcgtgaacccgggaggcggagcttgcagtgagccgaggtcgtgccactgtactccagcctgggcaacagagcgggaccccgtctcaaaaaaaaaaaaaaagaaagagagaaagaaaatgttgacggaaggcattctatctcagtctctgcaatgagccattcgcattttgtggaatcctttctggcattaattgggggacagaaacagcatctggcatatttacatgacagtagcatgtacttctcttttatatgtcattcattcgtacttccaataagttcttttctaatatgagcatacattgctttattgtgcttggcagatactgtattttttacaaattaaagttttgtgtaaaccttacatcaagcaagtctgtcagcaccgtttttccaacagcatatgctcacttcatgtctctgtgtgacattttggtaattcttgcactatttcaaacttttttattataattataactgttgtggtgatctgtgatcagtgatctttgatgttactattttagttattttggagtgacataaacctcgctatataagaacagtgtgtgttctgtttcaccaacctgcctttcctctctctctctctccttccctggccttcctattccctgagacacaacaatattgaaattaggtcagttaataacactacactggactctaagtgtttgagtgaaaaaagagtctcatgtcactcacttgaataaatcaaactctagaaatgatttagcttagtaaggaaggcatgttgaaagccaagatgggctgaaagctaagtctcttgcacctgttggccaagttgtgaatgcaaaggaaaagtgattaaaggaaataataggtgctactccagtgaacacatgagtgataagaaagtgaaacagcccttttgctgatatggagaaattttaggagtcttgatgggagatgaaaccagttacaacattcccttaagccaaaacctaatccatacaaggctctctgttcaattctgtggagagtgagagaggcaaggaagctgcagaagaaaagctggaagctatcagagtgtggtttaagaggtttaaggaaaggaactatctctagaacagaaaactgcagggtgaaacacaagtgctgatggagtagctgtggcatgttacccagaagatctagctaagatcattgataaaggtggccacgttgaataacagagttttactgtagacaaaacagccttctattagaagaagatgccacctatgactttcaaagctagaaaggagaagtcccatgcctagcttcaaaggacaggctgactcttcgtaggaggctaatgtagctggtgactttaagttgaaaccattgcttattttatcattccaaaaattgtagggcacttaaaaattatgccaaatctgccctgtgctctagaaataaaacaacaaagctgggatgacagcacatctgtttacgacatggtttactaaatattttaagcccgctattgagacctactgcttggaaaaaaagattccttttaaagtattactattcattgataatgtacatgatcacccaagggctctgatggagttgtacaaggagataaatgttgttttcatgcctggtgacagaacatttattttaccattcatggatcaagaagtaatttcaactttcaagtctcattatttaagaaatgcatttcataaggctttagccaccgtaattagtgatttcctctgatggatctgggcaaagtcaattgaaacctttagcaaaggattccccattctagatgccattaagaacattcatgacatataggaggaaatcaaaataccaacatgaacaggaatttggaagaagtttattccaaacttaatggatgtctttgaggtgttcaaggcttcagtagaggaaattgctgcagatgcatggaaatatcaagagaactagcattagaattggggccttgaaggtgttactgaatttctgcaatctcatcaccaaaattgaacagatgaggagttgcttctttatggatgaacaaagaaagtgttttcttgagatggagtctactcctggtgaagatgctgtgaatgttgttgaaactacagcaaagaatttagaatattccataaactcagttgataaatcagtggcggtatttgaggattgacttcactttttaaagaagttctatgtgggtaatatgctatcaaacagcttcccatgctacagagaaatctttcatgaaaggaagagtcagttgatggagcaaacttcattggtgtcttactgcaagaaattgccacagccacccaaccttcagcaaccaccagtctgatcagtcagcaaccatcaacatgtatgcaagaccctccaccagcaaaaagattatgacttgccaaaggatacctgcaaaaatccatccaccagactcaggtgtttgttagcatatttttagcaataaagcatttttaaaattaaggtaactacattgaatttttagacataatgctattatacacatatagcctaatatgtctattagttttagacataatgctatcaattatgttaataacttaacataatttttgtgttcactgggaaaccaaaagttcatgggacttgctttattgcaatattcattttattgtggtggtttggaaccaaatctacaatgtcttaggtattcctgtattttcattaagaagtagtatgactatctcacataaaggctgataacctggaagacacttagatttcaatatagtttggaacctgtctggattccatgtattacttcaacaggagtgaagaatcccatagtctgatgaatttttgcaggtattctcttcaccataatgaggtttcattagggttactgctagaataggattgtttgttattagtttccaatgaaggatggaatattctcaatgtaggaattcatagtacgtacaagaaagctatagatattgttagtataataattatacaatagtagtagtataataaaatattcaagcaatcacttaataattacttcaagtctcactgtctgccctccagaatcaggagcaggatgtctgaactcctcattctttacacttttactcaaaagctcttaactctagagacagtctttaactttttggtatttggtttcttcttttgtgcaatggcaatgattctgcctgtgcaaacaactgtcaactgtttttctcagcagtgctagtgtaaatgaagttgaatattaggaataattaaccttccttgcttacatatgccatttgataatgctcaatcttctttgttaagaaaacaatgcagtaaaatctttgttaattgagatgaagtgttgtttatttaaatttggatcattctgaaaaatatatttgttccaacaggcttattcctgaaaatctttctaaaatatgttcagtgtctgtctgccttagaatggtccccaaatataattgaatctctctctggtgatgggttgtcttgcacagcctaggacccatcatactggagtgcttttctctctgaatcaagcagcagataacggaatttggactgctttgatctcagatcataccctggaagttgtgttttaataagtaaatttcttatatgaattgttttcttagtgttgtacctcattcttcataaaagtaaaaagtatattagcaagttacagaacaagaagtatcatgttgcctaatcaatgcaaaatatcatcatttcctagacaacttcacaggagacatagcatgattagaaggtcagacttgattaaatcccgtgctttgcccttagttttttgaaatttcaaaggaggcaatctctctgtcaataaattttcaaattttataaataatagtaatcctgatgccagcaagcagttattgagctttgtgtgccaagtactgttctaagcatgtttcaagtaataactcacttcttcacaatgagcctttcaaggaggtactgttattgacatcatttttctagtgaggagcctgaggcttagattcagaaacctgtgagtcgccatatagctagtagctggccgagccatgatttgaacttagctgtgctcaaaaccaccacaccatgatacctcagagatgaatgtgtgcgtggtggttatgggagaagagaaccacatttacttattttttgtctgggtcttgcatggtgttttagatcatttcatttctgttatttcattttgaaacatttctactataattattatccatattttacatatagggaatctagtctcagaaaaactgaagcttataaccaatattttacagctagtgataatgagggagcagacatttgaacttgacaacctaaattcaggttctggctaggggtttcgttaaggaaaggaaaaattccctccaacaaaggtcatttttatgatgtgtaagtgatttaagctttctgtataccaccccaccccttacaaagatttgtgttttcatttttaattaaatctgtctgttctgcattctcattgtttggacttttttcaaatcattgctaatacactggttcttcttcctgttagtggtttgtggttgactggttcatcttctaccgttaacataattctgttttttttttttttttgaggtggagtcttgcgctgtcaccaggctggagtgcagtggcatgatcttggctcactgcaacctctgcctcccgggttcaagcgattctcctgcctcagcctcccgagtagctggggctacaggtgtgtgccaccacacccagctaatttttgtattttttgtagagacagggtttcatcattgttcttatttttatttgtcattcctggaaattaattttgctttgagtttgggacccctaacatgatgtcctttagccccgtgaagagtgaatgtccctgtggtgccattagccacttgtacagtgtcctgagaatattttaagagaaatatgaatggcagtaccacttggataccaattaaaaatacttttttttttcagtgaaatacgtctttaaacctgcaagacacagagggttggttctcttggtttccttagtcattattgacatcatctataactttctgttgaaataacaaggatttttatggaaagctgtttttgttcctgttcctgttgccagttttcacatccttatatattattaaagatacagaatgggcttttaatagatcctacaggccaggcacagtggctcatgcctgtaatcccagccctttgggaggctgaggcgggtggatcccatgaggtcaggagtttgagaccagcctggccaacatgacgaatccccgtctctactaaaaatacaaaaattagctgggcgtggtggcaggtgcctgtagtttcagctgttcaggaggctgaggcatgagaatcgcttgaacccagtagatggaggttgcagtgagctgagatggtgctgctcactccaacctgggcgacagagggagactgtctaaaaaaaaaaatgtaggtcttatggagtcacagagtcttaatgaatctccattgttatatgacagggtcttatggatgtcttttggaatgcccagcagcaagtgggcagcttcttaacaacccactgtgactcatgaggaagtgtgtctttgtgttgtttatgactgtgtttttatgggtaggacttcccactgtctcactttcctggcttgccttctcttctgtttaccctggccccacctttggctcagctgggcactacgggttttaccagagtcagttggaatgcaagtgcatcacaccagctctccatctccctgtggcattttatggctcagagaggattggaactaaaccttgggtggctcatgatcggttgtacccagccaagtctggagaaatggagaaaatgcctgggtttgttagtctacatgtccttcacattcttacagacacgtcttttgagtccagagaaatgtaaatcttttcctttttgtttttagtggtttatttctcaggccctgaagcatgagttttggtcacccctacagcaggggagatttcttcaaaaacagctgtgattatccgaaggtgttacattgtgcttttcttttcatgcatttttagcacctgcacatcatagttttcccgggaacctccagcagtgtcacctgctaacttggcagactggagagactctcaaagccatgtctgacttctgtgtccatctggattatttctgtcacatgatgatttggcagatgttttctgcagatctctagctctggtaaacaatggtgaactgggcccatatactcaacttgtaaagagtgatttccccaaaaacaggagacagacatttagcaagataggggctccttcatgtgaaagttgatctctaaggttagtataaattttctgatctagagggaattataggactctgaggcccacccttactagcttgccaccaggcttggtataaccttcattgcaaatgctaggattcatgctttggttgtacatgaaggggattatttctgggtggtattttatctcctactctcagactctttcagatctagctggatgttcaacataagccttttgtgtaattcccatgggctgtagctctgtggcttgagtagtggtcacaggagctctaatgccagaataaatgatgctgctaacagaaaaaagtagggctcatttctctgcaaaatgctgcacaaagaagactttctttgcttcttctggtacatgtggtaagcgtagaaatagtttattatggaagtctttcagccacaggtctttctaaggcaaaattgtatcctccagggaaactaaaataaataccagcctaataaacttcagattttaaaaaataagttatcatattgcatttctgtaagaagaaaaatatgaaaggttgatgtgtgtttttattccactttgatttacttcccaagctgtcctgtcccaattcaatcttaaaatggaagaaaatactttatcatttgaagaaggatgaatgtagtacagaattcaatttttaagaattcaaggtaggggaagtaaattttgatgccaactttcaagtttttaaagaataaaataaaataaacacatacacacacagttggctttgtgttggaagttaatgatagatgtcttctcggtattctttgcaaaggaagtcttccatccaggctttccctcatttgtttttaattacagtcatggtctacctggccttctcactagcactagctccctatgccttttgctttgctcttaggccgggcttttggtccctccctcctcatctctggttctctcgctattccttggctcctcttgtcttgctgcccagtttggctcaggtacatgaactgcaacctacattctgccatccctgcagctgcacaagcctgtcgttttccatactattgtattttcaggtctaacatgtcccctttttactgccctttctcagtctactttagtggttattatcttgtcatcaatctctttaaatatggctaggctccgaagattcctctattgactattgtgtttgctttattttataaaatttattattaaataaagctaggaaatgtaatataataggcttccatttacccaccacccagcttgaaaagcaattctgaatttgctatttatgttactaatttctttatatatttttcacatatgcaaatcaacaaatatatagtatgcttatattttggaaaattgtatcttattctttatgtgcttttttaactttttaaatggaagatgatgcttgtgagattaattcaggttgctatgttttgctcttccactactgcatagtattctattttaagcctatgccaccatttattctatttatgagcattcagattgttttcatttttgttattacgaacaatgtttctgtgaacatgcttgtacagatctccttgcacttctgtcaatttattatttcagcatattttattgagcacctattagtgcttggcgtgattgatacaagactgctaaaacaagtcgtatcttgaagccatatgctttagagagacaaacaggcaaattctgttgtaggagtcttctcacctatcttcttatttttatttcactcctcctttgtcatatttcacagttctgctaaagttaacttttttttttctttttttttttgagatggagttttgctcttgttgcccaggctggagtgcagtggcgccatctcggctcactgtaacctctgcttcctgggttcaaggattctcctgcctcagcctcctgagtagctgagattgcaggcactcgccaccacacccagctaatttttttgtatttttaatagagacggggtttcaccatgttggccaagctggtctggaactcctgacctcaggtgatccgcccccctcggcctcccaaagtgctgggattacaggcgtgagccaccaagcccagctgagctaactttttttttttttttttttgagatggagtctctctctgtcacccaggctggagtgcagtggaatgatcttggctcactgcaagctccacctcccaggttcacgccattctcctgcctcagcctcccgagtagctgggattacaggcacccgccaccacgcctggctaatttttttgtatttttagtagagacggtatttcatcgtgttagccaggatggtctcgatcgatctcctgacctcatgatccgcccatctcggcctcccaaagtgctgggattacaggcgtgagccaccacgcccagctgagctaactttttaaacatagttttaatcattactgttattgtcaaaaacattcaaagtctccctgttgcttatgtgataaagttgatactcctcagcttgccattcaagaaccatcctagcttaaccttttctcctgtttacatctcacccatacacctttcagatgccagtgtcatttccctttcatgcctctcagtgatatttctttacccttagctatcttgcctgttttgaactttatccaggatgttgaggctttactcagttttcaagatccaaatgaaatagtttattattcctcttatacccttcgtctaagtgtttattgcagatagtgggatatgcatttgtttagctgactaggagcaggaaccatatggtaattgcctccaacatagtaggacctcattaattaaaataataatttataatcaaatcgaactgaatggatcatttggttctcagctttgctgttaaaactctttaatggtcctaatgggaggagggagtagaaatagagtgaatgttttagttttctgttgcttttcaaatgtttctgactctcaataagtgcttgtagcttactaaccgagcaaccattctaagcgggatccttaccacatcaaagtgggataggttgagaagaaaactggctttagtaagagagacagattcttcataaaaaaaaaaaaaagaccatattctcaccttagtaggattgaactaaagcatacttaaaccagcttccattctcatctcttggtcacctcctttctgccttttgggtggcaatacacgttgatggcctgtcacctatcatgcccttctacttatctccagtccccagggtagaaggcagatgtggctgcatgtgaataaggggaagcccgagtccactgtgtccgcgtttccattttgaaggaaaatgggagaaatgaggccagtggtttgataaattatatcaaaaatagtcccttcatgctaatggagtgcgaagaagctgatgtactggagatgatctataatatttcatatttctctgaggagaaaaatgataaacttgatgatgtgcaatttattcatgtttcttcagatgagaaaaaaaaatcctcaagtcaactaactgcctgtttctcactcctggaagctggcatgtggattttacactgggattggaggctgggcttgtttagagaaatgcctagagagactttgattaatcaccagacctttggcagttggttgggagagggtaattacgctagcattgccactattttatcatcgctattttatggctctacaccgccaggtgacaaatgtgttaattattgcatttcttatcctggacttctcttgcctgccccctcccctcatggttttggcccttagtccttctctgcagctcagccctggacggcagtaacttgtgcaatcaaagagctgttctttgggagccatgctgagagggacagggctatcagccctgctgtgtgcagacgctaaccacggggagctggttaattccctttcctcttccttctgcccatcaccctttgggtcaagtgctgctcagagccagaagctccactggcttctttaataactgaaaatagcacccctggactgggccatttcactctaaatagccccctggaggaggttagaaacagaggttgtcttaggcaaagagatttaggaggtaaaattgtcctttttctgtctttttcttttttttttttttttgttgccccttctgtctttctgttacccagagaaagcttcacaagcatgcctgtaatttagttgcaccattttattacagctgaaagaattgaatgtaaagaaggaagtttaatagaacatataattcagcagatttattgatggggaggtatctattgtagtttggccagtgaaggcaggtcatagaggaaaatttaggtaagtcggattttctttaaaaagaggcccaagagttagtacctcaggattttgttttcttctgttccttgggcatgctggaaatttgttagctcttaaatcaacaacttgttattgacagtcatctttttgctggagaacgtattaaaataagtataattatggtgcctgacctcaaaaagaaaaccagttggttatataactctaaaaagatgagtagccacagagtgtagaaagccacagagaagagcaaatgccattgttgggaagcagagcctatgctgggtaaagtttcctgggagtttcatcctccaagaacaagaatttcttcttctgaccctccaccttctctggaaatggggtgccacatcttttgccttctggctaaatttttgtttattatatgcctctttcactagaatgcaagaacatgactacttggttatgttcttgcttgtaatccttgtttttagaacaagacctgacaactcgattatggtcagtatatatattttttggatgtatgaatgaataaatgaaatgagatcttaacatgtaactatcttcttttagactacacagggttttgactataattgaaatttttaggcttcttcagctctctcttttttgggtccaaaggatgtctcaaaccaaataagaaattccttcttattgatctagtggttacagacaagagacgccagccttctttgtcttttggaagttaggagtgtgtccctgaggaaactatgccctgggaaggttctttatttataatacaaaatttcttttttgtggttgagctagatacagatatttttcaatttttcctttcttcgaaggctatattttggcttaatctgtacttacagcataactattcatgctaattataattcatatatgaaaatgcaccaaatatgactattagaagcttttgaaatactgtttgatactttgcaatatagttatttatgcatatctgcatttgattttaaacttcttgaagtaatgttttatttatttttgtatctccattgctcagcaaagggtggcacatagtaggtccttcatgaactaatattcactagagcactgtgggaacttatttgcaacacccttggcatctctcttatccattggggatagcaagtaatttgaactgtcaaaaccagtggtgttgctttgggcctaaatgacattaaactttttttttttttttttttttttttttaagaaacgaggatcttcctatgttgcgctcgctagtggtcttcaacctctggcctcaagtgatcctcctaccttggcctcccaaagtgctgggattacagttgtgagccaccgcacctggccccaacattcaactgttttttctgacagtaactaagaatgggataaatgcctctctgaggcctttcccagtttgtgaggccacttgtcttattatttgtgattgcaggaggacatgcatcatattcatctaaaggttgaatacatttatttaattgtggcttgtgaagaaagaagagctaatatgtggtcacgttttatgctatttaggatcgaaaatcagtcagtcatgaagccatttcttttcattctacttttggagatcatattatgataagcttttcagaagcattaataacctagactcaagcctatgtagtttggaccttcatgtctttacatgtgtagaatcaaagagcaataggagttggtgtatatgtgacttgagaagcctcacatcattcttggaatatgttgtcactagtgtcatcagtggggcctacgtgccctgcctgccaactcaggaaaggcgtgagattgagggatctagatttagcatttattgaggaaaaagtgttgtataaactattgaaattttacataaaaaacaaatagatctgttttgggaaatgaagattttcaaaagaaatatggtccattttgaaagagataattgcaggatatattttagtgtggcctggagcttaccaatcagaatgatattttgacattcatggtgtcaaaaggtaatttctttttgccttgaatcttatgcttgaagtatgttattcatgtagctatatataatgggattacattttaggggaacttcgggatgatatgtaaaaatcctgaagaagttgtctttgtgttttaaaacaagaaaaacttgacacaaactggcttacaggaatgtgtttcttgcaggtttcccttagaagccacacaggaggcagttttcattggctgatgatgtttatgggtataaaaaagaaactttgggaggatttgataaagtctcttttcagcttaagataacatcattttactcacgttagagcgtttgtgtgtgattggagttttgatggtggttatatttttggctttttttaatgtttgttgcttactgccattcctgaaccaaaagataagttgttcagataattgcaaagacagattatggtaatagtgatactaatatctaacatactacattaaatatgtggaatttaatttaattttttgagatggagtctcactctgtcacccgggctggagtgcagtggcgtgatgtcagctcactgcaacctccgcctcctgggttgaaggattctcctgcctcagccttctgagtagctggaattacaggcgcccgccaccatgtcccagttaatttttgcatttttagtagagatgaggtttcacctgttggccaggctggtcctgaactcctgacctcaggtgatccacctgcctcagcctcccaaagtgctggcattataggcatgagccaccgtgcccagccaatatgtgtaattttaattatttagcacttatagcaattttataagatgggtactttgtttatccctattttttagataaggaaactgaggcagcagaggttaaagaaacttgcccaaagttaggtagctaataagtagtagaagcaggattcaaactgaggtattctggctctgtaatccatgctcttctatgcactgcctttgcaaatctaatttcaacttgaaatgagttcagtggattgatagtagattagtaggggagccattccaaagagtttcttataattaagtgaacttgagaatgtaactggcaacagtgaagagattcccactctatttcatctgtaactttctgatcttaccgtggtggtcacatttgttgtaagaatatttatggtggtgtttaggataagtttaaggaaatgttgatcactttttgtttgatctgagatattgatagatatttatatactttataaataggtaattaggtatatatgtaaatatgtaagatatatacctattaattacctattaaatcattcatgctggcctctgggtatttacatgaatttttttcagtaagtcttgcctttcagatatatataaactagattatgcttaaatatttatttggacaagtgttttcctctttagttaagaggccatcttctgaaaaattagactgcagtaaagcagtaattccgcctcagttttccatgagggaagatttgtcatggctactcctacttttggcattataatcacgtgaacttattattcaaattaatggcttcttggcataattttcagaggtctctactgcaaatctcagacatctacaaatcagtacatgtcataataaaaggaagaatacagactgtcagacatactcaactagtcttctttttttttttttttttttttgagacggagtcactagtcttcttttggaatcacatcaggaaagggaagttgttagtgcttatgccaggtagctggaagacatctttgtgatatttatgaagatcagccctgttgggcaatcgttgcctctgccagaatgacttacccatttatctaataaagggaaacatctaaattcttgaacatgtaataattcacttgataaaattcaggtttttataaacaaatcatattaaaaccccaaaagttaattaacaggtgataaaccttgcttttacttccttgtcccatcacattcattcatagtcataatacactgacaattattgagtgcctttgatgtgccaaaagcacttgctaaatgctttgtttggaaagggatgtttgttaattggggtggtacctcccaaataatgaaacatacacacttttgttttattgaggatagggttttatcattccacagctgttccttgagtaagatccgggcttgaaaggccaagttcttctacaggggcggatctttgaggaggaagaggcaggtagctaggaagggctaggaggctacagaggttaaaagtggtctgagattagggagaatggctaaaagtgagtgagattttctctcgtgtgtgaataattgtaggaagagattctggacaacatatgcagaggaacaaatggagggatggtctttagtcagtggaagtggaaatccattggatcatccatgagcccatctgaaatcagcagcccgttaggtagaagcttgaaaaaaagaactgttgtgtttggtgaatatatcacgattttggagaatgatgagggcagaatcctgcatcctttctagctttcttgagaactttgtacgagagtcactcttaccatcatctaaatataagtgatgtgtcctgctgttaaggaattccaccatttgctagctagtggacataaatgggcatcttgttttcttttctttctttctttcttttttttttttttgagacggagttgcgctctgtcgcccaggctggagtgcagtggcctcccaaagtgctgagattgcaggtgtgagccaccgcaaccggctgcatctttttttctttattaattatttatatgtctggaagtctagatatatatttgtcttcgggaatggaaaggtaccaataggaaattttgagtaagccagagtattctagcaaatataggaattacgccaagaacagccagaattgcccagcactagtgataacctggtgaaaagaaagaccatcaatttatgtgttccaaaaatgatgtcagcattgcaagaggagagctgactgcgtaggctcatcctcatttctcaggagagtgtgcctgtaaatgaccaaccaattacaagcagatgataatgaagcaaaatgatgtaaatcaagatctgaggagtgacatttatggccaagacttgataaatatggaattggagaaagaagataggaaacaccagaggaggacagcaaggactgtagttttttttactgtggataagcccaactccctactgtggcattgaatcttggccaggcaatagtttgattgctgatttccttagaagggaaggattcttgtgtaggattaaagtaaaagtaattccatgacaacttgttactgaggaagacagccaaatacatatttcatgagtaagcaacagtcattttggtggaatatggtgtgttacgtaaagcttggtgctagattaatgcccaggtgaccacttggaggacaatcagtgtagccctgtgaaagatacaaagtattgcctgcctaagtctcagtttctttgtctgtaaaatgtgtgtttaagtggagctgtgagacaatgagaatatatgtaaggtgcctggcacttaacagttgttcagtttctctctcttgagcatcctcaaagctccttttattgatttctttgatgctgaaagaaagagaataaattttgactgcacgatgagcttcattttttgaaggtgctgattctcacccccatttccagctacattgactatcgttagccacttgttacccatctagtgaagccatcttctatagtgcagtgtgtgttagtaggaaaggcttatttggccttgaagggctcgtttggccttgatccggtactgattgtggtttgaggttgagcatgttaaggatgaatagtagctggaatggtccatgatgtgtgcttagtatccttcagaatgtttacatagtcatatttagattgcttctgagaacaagagaatacagaacaaaatgttatgttccaaataaagatcacaataagaagaaatattgcccttctagcttggcatcctttttctgccatgatttccctttgcattttcttcccataccttagctttagccaaggatacagcagtaagtgttgcttggtatttaatcaaattaaaacctgtgctaggtaatgcctcatagattttattttgccaagatagatgtttgaacggaaaaagaaatagtgtatattaaggactaaagggggtactcttgttttctttcaaatatgataattagtataaaactgtctttttcctgccagttggctcatctcatctcctagcagctgttttaaattccttaattgtctattgcttactcagctatcatttcacaaatttcctcactgccgcattttcgttgaagcaaattctgacagtgggggatgctcacctcacaggctgggttgagctgagttctagttatcctctttgagtaacaggattaactatcattagacagtgcattcgggtaaggtgatggttccctaggtctctttggagttgattactatagaaatgggcatctggtggagcctcaggttgccaattgcattactcttcattttactgatgtttcaattctgtttaacccaacgtagacttttttttatgcttataaagtaataggagtttcctagaggatttgcagcgtacactattgtataatctcattgcttataattttttttcagaatgaaggaagtgggtattttaaccatagcattttcattccagtatcattaaccatttaaatacactttgttaaatctatcacattttctgttaaaataatgtaaaattctagtagaaattttaacagtatcttactgtaaaaatactgtaggtaatagaccctgagataagacagtctgctgctttcagaagcatcaacacagagcattcctcaagcatttgatttaagtaaatattattgaagccttactaaattcaatttcagatattgtgctctttgatagcacaatgacagcttacatatgatgctttcaaatgtcatccacttatttctttttttttttttttttttttttttgagacagagtctcctctgttgcccaggctggagtgcagtggcgcaatctcggctcactgcaagctctgcctcccgggtttacaccattctcccacctcagcctccctagtagctgggactacaggtgctcgccaccatgcctggctaattttgtttttgtatttttagtagagacggggtttaaccatattagccaggatggtctcggtctcctgacctcatgatcctcccaccttggcctcccaaagtgctgggattataggcgtgagccaccacacccagcccacttatttcttaatgatgggaaaactggtaatacaagaccaaatttttgtttatacatcaaattatcaactttcatgtcttatttcatagtcatgcattgcaggaatgtgcgtactgcataaagtgacttgctttatcaggtttgaaattcataatacagtcagaagatgattaacagatttgttcaaatttttatgctacgatatgttcttgtccccatgtgaataaatgcaacagattgtttgtaaccattttaattgctctgattttacatggacaatagttttgtataagaaaagacaaaaaaggccaggcccggtggctcacaactgtaatcctagcactttgggaggccgaggtgggtggatcacttggggttaggagtttaaaaccagcctggctaacatggtaaaatcctgtctctactaaaaatacaaaaaaaaaaattagctaggcgtggtggtgggtgcctataatcccagctattcaggaggctgaggcaggggagaaagaaaaaaaaaaagaaaagagaaaagtagtcacttggtttaaatgcctggattttgaaacctaactccttgttttacctctgtagttttaggcaaatcacttaacttgattgaatctcagttactctcactataaaaatgggaccagtaataccttcttcaatgtgatcttgagaagattcactggaataatggtgaaagtaccctatcacagaatttatagtaggtgctaaaaatgttgtgtaccttcctttccttcccttagaaagacagtctcttttatttattgattgtacttttgccaccacagggggaaaaaaatccctgtttcttataaaactttctaggaaattcatgaatttagtgtgggccctctaattctgacaaatacaatattgattttgagtttgttgctttaaatttgccaaatgaaacgaaagttttacggttttccttttaagtcacttctgatatgtggagcaaacaagtctgtatttaatagtaagtagtttgctaattgcaaagcactaccaacttaacacaacttaaaatgagaagctgagagggggccagagcatgaaataagtaagtaggttaagaactgccacacagtccatcatgcttgcagagaagaatgtgagactgtccgaggctacagtgctggtcaccttagcctgtgtaaactctcactttctcagttatcagtggaagacaggggttaatccttattagtctgaacacatcacattgcaatgatctgaaagctaaagacatggcataaaggaactctgaagaaaccacctccactgagactgctgatgcttcgaatggaatttgggcagatggaatgctcatttaaggagcaaatgacatggacggggggagtcaaaatgataaagggagcctccttgcatttgttgtatcttacttctgtgtgagttctggcaaaaagcaagcatgactagaaccctagaaaaacaaccattaggtagatactagttatagtcaatcagagaaagccagtatgtgcgaagagagaagagaagaaaaccacatggtaaaaatgtaatcaaccagtgggattcttttagttcataattgtaatcatagatggcattccactacctttgtcttccatctggaccaagtatggctgtgtctagaggttctgttgtactatttctgtggtccttgaactctgatggcaacctaccttgacaaggccaaaaacctacacaactctgagcctttcttggtagtggcattatctaaacgtatgcatttgtaccttatcaggcttaatgagggaaaagaaacggcttttgaagacactaatgggaaattattataagtcaatgaagtaaaaatgcaaatagatttgtatcttaaaacaggaatactgctagaagctaaaactgagtaagatcttgctctgtgccaagcacatgctattttgcattaaaagagacccctgccttctacatagtatcctcattttacgggtagaaatcttgaggtttagagacgtaaagtaaagtaactcacctaaagttacatagctcatgagcaatgtggcagatgtttaaggacacctcgtctgatttcagcgcctaaatgaagagccttttacaaggatgatgatttttgcagcaacaagacaaagatgtccagcaataggaaaaagattgtaaagaaatgttaatccctgtagagggcactgttcagatttaactcatccaacataattttctaacatgataaagcagacctgcgccagctcctgactgtttcagataggtttgcctctggggaagaaagtgcagtgattcgtgtaacctactgtcagtgttatttaaatctcagacctaatctagaatttactttaataatcttttattattttcctgtatattcttatgatttctcccttctcaatgaataatgaatttagcataatgaattcagttagttctaggcttcttcatatctatatttaatattcaaagcactttcttctcttttattcctgatttaccaaaatctgtgattgtgccatgaaaagatgataaaggagaccatctcttggatctggaaagtgctgcgtgttagtttataactgggcaaatgtaagcataacgtttggccagggttgggtgcggtggctcacgcctgtaatcccagcactttgggaggtcaagatgggtagatctctttaggtcaggcatttgagaccagcctggccaacatggtgaaaccctgtctctactaaaaatacaaaaattagctggatgtggtgacagacacctgtaattccagctactcaggaggctgaggcaagagaatcacttgaacctgggaggcagaggtggcagtgaaccgagagtggcactgcactctaacctgggcgacagagcgagaccctgtctcaaaaataaataaataaataaaaaataaaaaaagtttgaccagaggactacctccattgtctttcttttctacaatccagtttagatactttctggactaaccataacttacatgcttgtccaggagtattggccagagttagagtggtcacattaattctaggcaagggtgaagatgaaggagtagagccatgtttccttgaaggacagtgatgatgctttttagagcttattacgtgtttgctatctctcccatcccaagcagtcaggggttttaactttgaagataataataactgtcttcagtgggtgaatttacatctgttttgacccaaaagataatttaggatgacttatggaatctgaagctaaatgtcaaatgtaattaaatgttactgttgtgtcttgccttaagaagagagctggtgagttctagcagggtttgggaactatttggattaactgctttgattctttcccacattatataagaggtgttatctcagacagcacagaaattgtccctgggggacagggaggcatcacatttcagaagtacctataatatttcttcagcatgtctttgggcctggctttctcaatatttctaccttttcttgaaatctccacttggatatggctctggaagatggcagaaacgccatcttaaaatatacataatatttttaagaaatcagttttgaaaaacaagaagtctcttttcctgacggtccttcctcaatatgcttaaattattgaataggaaagcttcagtaagacacaactattaacataagtgctaaggattaagaaaaagatctgtcacaaattatgtctgtctgtaggaaggtaaagttgtgcctttgatatgacacctacccctggaaatcatattcttttccaagatataaacccaaatcagaatagggagtgagctgttaatatgaatactgaatctggacaggcacggtggctcacgcctgtaatcccagcactttgggaggctgaggtgggcatatcccttgaggtcaggagttcaagaccagcctggccaacatggtgaaaccctgtctctactaaaaatacaaaagaaaattagtcgggcactgtgctgtgtatcagtagtcccggctacttgggaagctgaggcacaaaaatcgcttgaacttgggaggcagaggttgcagtgacccgagattgtgccgctgcactccagcctgcacgacacagtgaaattctgtctcaaagaacaaaacaaaaccaaaagaattctaaatctgctctgaatagtagaagacaatgggagacatttatctttggtagcaacatattccaaagacttaagagtttaaagaaatcatcattttcctatcgcttccttcctttctctctcaatcctaaaatactctctgggcaatcaatttcggaattctttcaaggaaaggaaaccttgattcgtctgcctgttaactactacaaaatgtgtagattcctgctcttccatgttactactcagagtaataacgaaacacctattattgtcattatctggagaaaagaagctcctatactggattaaatgatgttgctgtgcccataagaaaggcaggtattgggcagtaatgaaggtatggcagcaggaatttatactttgtctctttcatcagagtagctcccccctcccctttttatcctgtaggaggaaattgtggagtgagagaagaggtctgatctgtttggggaaaaagtatcacagcctattagttagaagcaatgaaattgagacagctttgggactccattaagtgtgtggtgtttaggcagactgtgtccctgggtaaagtgtgctgttgaagaggatagtacacaatgaaataattgggcttgggaaatcaactgggcttcagcagcctcatatctccttgtggggaatgggtgagggagctacagctttccctcccttcttttagcataaaagctataccgaataaaatagaagggaatttcttgctgagtagatggactgtgaatatattttgaataacacaaacaatggagataattaaattttgtctggcacaggaaggattcagagcatgtcacttggaaccccctcatgccatgttcttctctaggcgtctggatatatggttgcagcaactgaataaaaataactcagatttgatcagtaatggcagcatctatagggacatgttttaatgcactgatgtgtatgaaattaggttcttaaataaaacattattcctggatattttcatttcaaaggataagctgaaattcacgaacagtgtgaactagactgacttttcccactgagatttactgataggcaaacttttgtgcacattgtggacactggttgagggtaggctcactagttttggtactattaatggtcagttgcctgtagaacttgtgaagtaagaaaaggtatatctatagcaagttcaaggttcagataattgttgttctctcttaagaaaaaggttttgagcggttgtcttctttacacttagtgtatgtaatgatagtttggctaaatatgaagaagaaagagaaatagcattactactgtttattaataacttttctttgtgccacacatttagctattcaggcactttgtgtttgtgtgtatacatatacattctcttatatacatttgcgacatgtggtaaaaggccctactttttggagtcagaaattgtgctcatttctgtatctgccaccttgtagctgttggctcttgaacaacaactaagcctctactttgaacatcaattttctcagtaaaatgagggaactagactaaatagttgccaaaattcttagtccacacacacacacacacacacacacccattttgtacttctaaagacactggaaagaagtttacggatggaggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaatagataaaaccacaaagatggggaaaaaacagaacagaaaaactggaaactctaaaacgcagagcgcctctcctcctccaaaggaacgcagttcctcaccagcaacagaacaaagctggatggagaatgattttgacaagctgagagaagaaggcttcagacgatcaaattactctgagctacgggataacattcaaaccaaaggcaaagaagttgaaaactttgaaaaaaatttagaagaatgtataactagaataaccaatacagagaagtgcttaaaggagctgatggagctgaaaaccaaggctcgagaactaagtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaagggcaaccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatattctttgaaaccaacgagaacaaagacaccacataccagaatctctgggatgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaactcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagacatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatctctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaagaagtttacggataaaagaatgagaagtagactgacattgtacttttcattaacgtgttgaatgcctaaagaatggaaggaaaataagcttaaaattttgaatctatgataaagaaaactattgattaaccatatgcatatttgacattaaaataattcataattaggactaacagatttctggcttaaaaaatctaacaattactttaagaagcaaaagacatttccagaataaagtagggggatatatagaaaagttggtaccttttttaaacagagtcttcttttgtaaggaagtagaatttattcatcaaaggagatttatgaaaagtatggtggtatagtgagtggcctcactagttttaatgattgatatttgaatatagcttagtcttataacaactccccaaataaaaatttaaaattcatttgtatccctttgattttcagtgctaaaaactagattgtgaatgtcaaggaaatatttaagttatttctgaactaatgtatttgtagagagaagaagggagtgtgcacgtgatcgagaattatgttttgaaaataaatgaatgattggctattaaaaaaatttttaagccttaaaaaaaaaaaaaaaagacactgtataaatgttagttgtttgagcatttttgtatatacgtgtatgtccacacacatatacacaacattttaaaataacatcagttattttccctcttttatgtttttattttcctaataattcataccagtgatgtaagatagtggtacccagaccccataatctaagaggaatttgttgccatttgaacaaggaatgtgttgcctcattcatattttcaaaaggatataaatacattgttgtatatctttaggggaaatatatattcagtattttaaccagagttctcactgctgtgttcccacattgttaatatcaggtagtttgcctagatgttcacagtagaagtacagggatgtagaaacatggtctttcttcccaaagaagtcatttttctttaaaatttgtgaaataaatgaattaattgagtcagcctttaacatagtaatccattttgcattattcagctttgattgaaagagacagagaaaatatgttttgtcggggggtggggagaatgggagatagagatttctcagaattaacagggtgctctatagctcaataagaggccctgtatatacagcaggatagatttgtagttagttaaggaaatcttaagtctaaaggttgtaattcccttagaattcctgtaagttaattgtttttcccccactgtaatgcatacccttgaaaggcaggaaccttctgtttatcattgtatcccaagggcctatcataagcacctggtaaccaataaatgttgaactgatatatgaaattttcctgatcttagagattaagtattatcctcatggtctaggggaataaaacatccacacgtccaaaccatagtaattctgtttccatattctgctatctatgggtttcattattttaagtattctaaacttacagagagcaagactaatactttaaaattttattttggtctatagggaaaaaaaaaggttatttgagtttggtgactgtgtccatcactttggtttaccactgaattcacagcagatactaagaagtatctgcattgttttgtttggtttggttgggtttttaaaacagggtcttgctgtgtcacccaggctggagtgcagtggcatgatcatagcccactgcaacctcaaacccagagtgaatggatcttcctgcctcagcctcccaagaagctgggacttcaggaatgcaccatttgtgcctggctaatttttatttttttattttttgtagacatgggatctcactgtattgcccaggctggtcttgaactcttagcctcaggtgaccctcctgcctctgtctcctgagtagctgcaatcacttaatcctttaatagtcccaccaatctattattatctctgtttgacaacttatgaaactgaggtcagatagggcaaatgcagtcatgcaccatataacaacgtgtcagtcaacaacagaccacatatatagtggagatccaataaattataataacatatttttacagtacttttctgtatttagacacacaaatacttgccattatgttacagtactgtactacataggcaactatgctattcagtacagtaacatgctgtagaggtttgtagcctaggagcaataggctataccatagagcctaggtgtatagcagactgtacaatctaggtttttgtaagtatactctatgaagtttgcacagcaacgagatcacttaacaatacatttctcagaacgtatgcccattgttaagcaaagcgagactgtaattgacctaaggtcacacagttaacaagtagtgaggttttaaactaaggcctttgaccagtgctcttgatcattacagagtggtaccaacatggtagcataagctttaagaggagggaaaacttggttcccgtggctttatcagggaagacttcttagaggaggtagcagttaagctagcccttaaagaataagtcttatcttgaactgaatgtatgctagagtcagaattatagaggattagattcagaataaaaggccatctgtttcaagttcctaatttgcagaggagaaaactgggatctgtgaggttaaataacttgttgtaggacatatggctaattaagtggcattagaactgttctcttccctcctctatcctgtgttattccctgtccccctccgttaatgcacactagctcatgttaagtctgttttttcatcaacactttctaataagagttcctaaaaacattttacagcttgaaagtggaggctttcttgtgtatctatgtatggtgatgaggttaaaccaggaaagggtcagggcaggcatggaaggagatactagagatacgtggagacatggagagacagaccttttctatctgttttttgtttttttttcctagcattttactttattgttacatctgtttccttccataagtatagataattgagtgttgagagaaaggggacaaatgaaattctaatgagaaaaaaatgatttaaaattccacaaaatctatggaatttcagcctcttaagtaacctgggatgtttttaactttcactaatgtttattagccagtgtccttcctgccacccacctacaaggatgtctcaaggatgaaatgaggtcatatatgtgaatacacacttaggatacaactgccatgtattggcagtcttgtctgttccctgggcctacactgttccttgcctcaaaatgtagtactatcaggtagtgttgatgtttcattagccaagtggttatatcagatttatgtactgctaaacaattgatctgggacttgggtaaatactcattggaaaaacatttgttgtattctgagtgctccctgttaatcttctcctcctcagatagcaagctagatctgggacttaaggtggatttttttccttatttttttttcctttgttttacccaatgattgaaaatataaaactaaacctttttcagtaaagtctgaatcagcagatacttacattactttggcataggctttttatagactagctagaagaatacagtaattagcatatgcatttcctcattaaaatgtcattagtgaaggctttgttcttttaaggtccttcaaataaggtttattgcattgcattccatcactaatattttaccaggagtcagatatcttacttaggtgtgttgaagcaagggttactttggactttctatagggtaatgacctaagagcagacctggacacacataaatctctatgcttacattgggtgggccctactttatgtactagtaataattaccagtctcttctcacactgtccattcagaatcctttggatatatagacatttagcaaacctagacttgtttgaaagaataaactgttatctgcactaaactgttttccttggttatcttggtaggatttgatttgaaaaaaatgtatgaagaattagaagaaaagaaatttataatgtactataatcatttgagatacagtattatgcaggagtaagaatacaggctttagaatcagaccattgaggattcaaattcttgcttcatcatttactggttgtgtaactttgtgatacttagcctttataaacctcaattgtctgaatgtaatacggaaatatgagtggtccataccttataggaatgtttgagaattcagttagattatgcatgtaaagtatttagcactgctgcctggaatatatgatctattattacattaccggctgggcatggtggctcacgcctgtattcccagcactttgggaggccgaggagggtggatcacctgagctcaagggtttgagaccagcctgaccaacatggtgaaaccccatctctactaaatataaaaaattagccgggcatggtggtgcatgcctgtaatcccagatacttgggaggctgaggcaggagaatcgcttgaacccaggaggcagaggttgtagggagtcgagattgcgccattgcactccagcctgggcaacaagagtgaaactccatctcaaaaaaaaaaaaaaaaaaaaaaaccaacaaaaaattatctttataatagaaaaaaggagtgtgtgtattttcatatgtattgtatctgctttctacacatctttgacttaagaaatcctaacatgaaatttcaaaacaagtaagaaggtatttaaggagtggtcattaatatcattaattggcttaaggcaaactttctttaaaaagtcacacacatggtgtattcaaaataaactacttcacttaatcattttaacatttctgctatgcagcgtgactagcaacttgaaggagcaagttaggaaatgcctttgatgaccccatgacatcactatgttattaaataactggaaataaactgaaaattatgggatagtctttaaggctttcatgacatttcagcattttagggttgcagtattccaaggacttttagagtaattgcatgtcatcctttgtgtgttgtgggcaaatttgggttagctaaaagttggtcagttaaaaaaaatttatattaagcatctactctgagccaggcattgttcttttttgctgtgaatatagtgctgaacaagaacagaagccttgctgtcaaagacgtaacattccagggtaagaaaatagataactcataaagaaggaaatgattaattcagatacttgtgaggctatggagaagataacctaggctaacgtgatagagatgggtggtgaggatgtgagttaaggggaggccttttgcaggttgttgggaggagatgcaagtgttccaagcagaagaaagaagaagtacaaagtccctgatacactaacaatcttggtgtgttcaagggacaggaaaaaggccggtgtggctggaatttggtgttcaaagcaagagaggagagataaaggaagatgagtcatgcagagccttttgaaggctgtgggtaaaatgtatgttatacggaacttagttctaaatctagttgcagtggattaacctggagagtgatgcaaactgagttttactctggaaaaacactgtgactgttgtgtggagaatatgctcccaagtgtagaaactagatcaccttgcatgggccaagagagatggtggtagtttaagactaggattgtagcagtgaaatgtaaagtggttgcattcggacatattttggatagagatttgacaggaggtaggtggattggacatgggatgtaaagtaaaaagaggaagcaaggatgacttccaggagtttagcttgagcagctggatggctgatatcatgtgtaggcatagggaaaggttgtatgaggaagaatttatagggtgtgagggtgtgaagcagggaataattttgttttgacatgttatgaaagaaatgccaattgacggctaagaaaagatgtcatctgggcaggtaaagaatctaggagattgggaaaatgtccagcgtggaggtataaatgtgaaaaccatcagcatatgggattgaaagctatggggctgtttggattccctaggaagagaatataaataaagaagggggctgagaacagagtctcatttataatatcctgataaggaagaagacccagtgaaggagatgaagaaggagaagccagtgatgtaacacaagcatggatcatggcaaaagagaaaaaggtgtttcataaacaaggatgcttggtatggccacctgtgtcagtactgtgaagttgaatatgatcaggacaaataatattaattggggctttatatttctcctttactacaaccgattaatgaaacaaaaaattaacctagcacccaaggtgtttcttatagttggtctctccagtctgttttagtatcatttgttagttatttccccaaactaatgtttagcttctttctccaaaaagaatatattttttttcctggttctgcttgttggaatccccccctccaccatgatataaaagtaatggggcttattgtaagaaaacagaaaatacaagaaaataagggacaagatttttaaaaatggattcaattctgggaacaacaaatgacattggggtataggaattaaaccgtgtgcattctgtctctcaccccaattttatagtcatttgctggggaccttttctccccagggtacttgcatagcttttgtcaagaataacccttctcacttccccacctccttcttctacatgcagatgcagcacttttctgggtaaagttttagcaatgccttccttctaaaatgaaagcattttctcctcacgattagcatctgtttatagaatagttcgtattttcgtaattagatcctgcatagaaatgcaaaggctgctgtgtaaaaggataatgaatctttattgcacagttgaaatcagatttgtgcaaaaggcactttgaaaacagtaataagcagagacatgtattaaatcacccagataaggcacccactttatattttctatttataaatggaaattatgactacccagtggattccatatgacatttcctattaccagcaaaggtttttagctttgaccataaaagttatctaaattcaaaagcctctgtggattcatggctctaagaatacttctggaaggggccaagacagagtggaaagggtcctttgtctttttcttttgtgtgtgtatgcactctgcagaggggaaggttagcaagtggtagaagaaagaagccatttgaaataaccatgataagatctaatcaggaaacccagtgtccattacacacatgtggtaacattttaagactcttctggttgggctccttgagaaccaagctcgtgttcttataagctcatccttatattttcccattgtatgcatcgttgcatggcaaacacaggatttattcccaagctaaacctgtctcttggggtttcttatcttttacctccttggtgagcctcgggaagctagagcattgctctatggagaaaggagggtggcattgggaggaagggtaggaaaaacattattgggaagcagagaaagtcaatgtcaaatgaactgccaaggatgaatattatggctgctgggagcctcggagagtatcgtgtgtcttatgtgtctatttcacagtcggtgcttcatgtgagatggcagtctcgcctggaccgtgcttagtatcgatttactctcaggcatgccagaccattttagcattgctgaaggaaggaaatcctatgtatttccccttataaacagacatatcaaaagtgtatcttttaaacctttttctttctgtcttcttactgttctttctgtcttactgtaactcctcctccctccctgatttaaaagaatttttttttttttttttaaaagaaaaaagactttctggccgggcgcggtggttcacgcctataatcccagcactttgggaggcagaagcgggcggatcacgaggtcaggagattaagaccatcctgattaacatggtgaaaccccgtctctactaaaaatacaaaaaattagccggatgtggtggtgggcgcctgtagtcccagctactcggaaggctgaggcaggagaatggcgtcaacctgggaggcggaggttgcagtgagccgagatcgcgccactgcactccagcctgggtgacagagcgagactctgtctcaaagaaaaaaaaagaaaaaaagaaaaaagactttcttattaagagagcattatacaggccaggcgcggtggctcatgcctgtaatctcagcactttgggaggccgaggcaggtggatcacgaggtcaggagatcgagaccatcctggctaacatggtgaaatcccgtctctactaaaaatacaaaaaattagcggggcgtgatggcgggcgtctgtagtcccagctactcgggcggctgaggcaggagaatggagtgagcctgggaggcggagcttgcagcgagctgagatctcaccactgcactccagcctgggcaacagagcgagactccgtctcaaagagagagagagacagcattatacagagaacaaattgagtagacttttttagaatgatagagtgtcagtaactactcatacctgtgggggaaagaaaaaggcttcaaactttgcacacttctagcccttccatgaaaatagaaggaccttatttgaggctagttttgtggtggtgggatctgagcactgctgagtgttaacaaaagggaataaattgatgccaaatttagagaccaaaaatgccatcattttcacctgcctgaactcttctgttgttttccctagttgctgccttgcgctttttccgcagtacagggagagaaatcagttgtctggctgtctaaactcacggcatctgcttagcagtttcaccagctcatagttgggactcatccctctgtcagaatcctttgctccattagaagggagactgggaccacgttcctgaattgatttgcatacttctacgttacctagctcagacaacatatggccatgtggagcacttggatttatttctgtttcctcaaattaaattcctaaaaaattggataactccacagtttgtttggtgttacaaaaaattttagttccttttttggtcggcaaagcaacacaattttggcattaaaaaaaaatctctggattactttaaaaagagtgttgatttgatttgcttcccctcttctcttacccctttcaggaaaaaaaaaaatgtatgttgaatcttaaaacactgcatcatgttgcaaaatgtccatttaggcacactgaatagaaagtatcatcgagtcatttttattcttgtaattcagtaatcttgtatcttttgcctttttctttttccttaatgttaattgtgtaactaaatgtctcaaacttgggacttttcactttacacatccatgtgtaaaaatacatagatacatacagtcagatagaagaaataagactcagtgttaatagatcagtggttggggtgggggaactatacttaacaatagtatgttgtacatttcacagtagccaaaagagaacaattcaaatgttcttaacataaagaaaagataaatatatcaggtgataggcattctaattactctgatttgatcttcccacattatataaatgtatcaaattatcacgtactccccattaataatactgtatatcaacgaatttttttaaaaaaagaaatagatatcatacaatgaataactggattaatgtgaaatgatagaaaaagttaccattttaggctggatgtggtgacccacgcctgtaataccagtactttgtgagtctgaggcagtaggattgcttgaggccaggagtttgagaccagcctggttaacgatacaagaccccctttctaaaaaaaaaaaaaaaaaagccaagtgcagcagcatatgcctgtagtcccaactactgagggcatagaggtaggaggatcatggatcactggatcacttgaggagtttgaagttgcaggaagctatgatcctatcactgcactccagccgaggtgacagagcagcaagaccctgtctcaaaaaaaaaaaaaaaagttactattttaaatgcacttcaactttgaacagtactaatgtatgaaaatcatcttgtcttctttaggaaattctttgttgcctaaattagggataggtatcatacactggaatgagctctaaaacgatggctcttgctatgggaaacagttttatttgggtactcatgtcttctctcttaagggatcttaggaagaggctacatggtaaagaagaaatagcatgggctttagagtcaagaggcctgagttttaattctcaggctttatttgtccttctgcagtggccttagcaaatattataacctccctaaagttagagttattgtaattgtcgtacatacaatgttatcataagaaaacagtgagataacagatatcaaagtacctgggcagtgtttgacacttggtggtctataaatataaatatcatttcattcctgaaggtaactgcagcacttttgaaaggctggtttgatgctaacacaggaggattagacctaattatatatttctaaggtcttagaaatggggagctaggtttttcagacaatatactgtattttgtttttcctcccttttgctttaaaacagaaggcaatttgtttcaaactctgtgctccaaactggtggcttaattaggcaagtttattgactgtcacagaggctgtggttaaaaactggcaaatatcatgtgactatattagtatctctgagcaaataaagggaaaagacaggattccacccaaccacatttttttctttctcttttctcccaagctcattcttgcactgcaacattccacttataatctgttaattaaatcatttcactccattttatataatttttaatttagcattcattttcaacttagcttttggcttcatttactgataataaacagtgttgcatacaacacatgttccacaaaacactcagtcacacacatacagatgccaataattttttccagtatgtcaggcatattaaaattaaaggcagcatctcccctcaccctttccattactgaatgtgcaccctgtttgaataatacatactccccgacagccagcagtggtctaatgtgtaaaaattatgtgtagcgtgtcactagtacctttttttaaattcgtggttttctcagacatgctctgtggaaggtttctggaatggtcacttcgataccttggatctgtatatttggcttaatgtatacaaacagtaatattttctagacttattactttatgggtttatagctatgtgatagttattgagaaagaaaactctagtgtagcattcaaattacttttcttgtagcttattttttgaatcatagtctgaattctaaatatatgaatatctttaaccgtagatgatatccagaagtttccaagactgcaagctcaggggtttatggaccacttttaaaagatagatactaagccaggcacagtggctcacgccagtaatgccagcactttgagcaagcaagatggactgatcccttgaggccaggagttcaagactagcctgggcaacatactgagaccccgtctctacaaaaagtacaaaaattagctaggtgcggtgacatcttttagtcctagctactcaggaggctgagaggagaatcactggagtccaggagtttgaggctgcagtgaggtatgatcatgccactgcagtccagcctgggtaacagagtaagaccctttctctaaagaaaataaaaataaaacatagatacctgtgttgttgttatagctgttcatatccttagaattaatttaccttgtctgctcctgcatattatttgtctcctcataattagcaaagttccacagggccagatatcaccaaatatgaatagtagattttattctaaggtcagtgagaactgaagaatgttaggggctgactcaatcagatttgtttgtatttatatttggaaaaatattactctccggagaatgttttggaatgtttggcagggtggttggagagacatactacaggaaagaaatgatggtaacttagttggcagtgggaaaagtgagtagtgaattactcagagctctttgggggtgaaatggactggacttatatcagttgaacttgagaaaaggagaagcatcaaggatgatgtaacttttaggtttctggcttgagcagttgtgtaggtggtagtaatttttcatggtgaagatgatgaaatactttttgtacctgtctcatgattgctttctgtacatcaaggtcagaggtcataagctcataaaatgcttggtattagaattcttacataaaggatgtcttctgttttagtttagtaatacaatttggcttaaatcacagactttctctaatctttgttttgattgtcatctgccgagagcttaagacagcaactcacaggttggcccattgagaatctgacaaatgaaaaattataaaaaaaattcagaatccctatattgtagcccaactttctttagcacttctatccttgaatgctagggcagtgttgtatactgtgaagatctttgtagatttttctactctgtaacattttaatagttccattttggggtattacagctgttcagtcctccccatacctcaaattatagttagtctccttcaagtcccaaatttccagtgtacatatgtttcatcttatgtttaatctggacagagtgttggaacgaaatatggaccctgaaaggtgtatgacgggcttgaagtctcagccctactacttgcttaatgtttgatttgctaatccaaacaattataatctgttaattaaatcatttcactccatttcatataatttttaatttagcattcattttcaacttagcagatgctcctggtgtcccacccatacccctctttcccttccactttagttcacaatggccctccttcctcccgctaggccttatattcattcatcttcagggtttgtctagtcaatgaattctgctttgcctaaggagtaggcaggaagtaggtgaaatgaactgctacctgagcaacccacagtcaatgactaatgagagttgttgtataaatacaccagcttccttgcttcttaagtgggataactttgaggtatacattctacactggcttccggagtcctcccagtggcatttgcttctagttgcccatagtggtagttggctgaataattacataccctttattccctgtctgctgtcatgatcttactttcccagtctcctgctattgtttacctcctaaataaacttctcattgtctgcttctgggagaaccccagactaagacaaccactgcgaacattggtttcctcatctttatttattattactgttttttgagacagaatcttgcgctgtcacccaggctggagtgcagtggcacgatctcagctcactgtgacctccacctcccaggttcaagcaattttcgtgtttctgtgggacgtcttacataggcgtattttttttttccggctactaccactatttggactaattattctgaaattttacttgccaagtttcagcttttattagcaagaaaaaatgttatgtccacagtttagaataaaatcacagagaagaaaagttggatgaggatattggtttgcagtcttctgtctgtgtttctgtcttctgagcattcacagatgttcctatccttctttccactggtgttcacataacctgggatcttgtgttgtatgcagtcactctcaaggtaggaactggaagataaagtatgtgggtgacatggactacttagaaggaaactgaagtttacatgttgagcccaattagaagcagctgaagagaggagagaaaaaattaactgagaagtttaataggcacttagagcatggcgaataaagctgagtggcacccacttttcatttcctagttcattctagttgtgcttttttaactgcaaagactaaaaaacgaaagcctttatttcccagtctgtcttgcagctaggattctgggtgtgaatcaggtatatttgctcaagatttggaaggtcgacatgaggtaaaggttattcatcttcagctttagctctttttatctgattagccagggcaggagaagtatgatttttctgtggtgatgtttcagttttcaactcagcttcctagatgttgaaaggcagttatgatgcgatttcctgatcccaggttgcagcttcgctagtgcatttgtagctgggctgctgcaacaatggacttctgtttatggcagaagaaaggccatactttaaccttgtctagtgattttttgtaagaggttggttctctgtattaaatcacttcctacagaaaatttcttaagtgttttctggtttttgtttgtttgtttgtttgtttttaccagaaccctaactgatatagatggttgaagcaaactttatgctgtaaaggtccagacccagataaaaacgagagacaggaaagatgcagcaagatggtctgcaggcctgcccatgcatacactactccatgatctggtgtctgcaagaaaacaaagcaactgctcattaagtaacagggcagctaatgctttagctcttgaggccctgtgtcatataacttctaattcctctaattcatccaccaagggggcagtgaggcagttctctgtttgaatgctacatcgtttctgacttagtgctttgaagtggatgacatcttacttttttttcttatcttagagataaggtgaacagaggaaaaggagaatgatttgcccaacctttggctaaaggagaaaggaaagatttagagtccagtgcttctgacttccctctgatgcggtaacaaggataatatgagtatctaatatgctggggcacagtaagatggctctgaaggtatgcacagtagagaaagccatggtccttgccctcagggtctgtgatcggccactgaggcacacatttccacttcctgtgttccattaattatgctaattttccaacaagccccagccccacctctgtcaattatttttgtctcagccttctaattacaacattatatgaccattcagactggtactaattaaatcattacttaattcacaaagtgtgcgataatgctaatgcttcttgtcagctgaaattacaacatggcacctactttcttcattcttggtagatggggccagggggttgctcttttaccaaacatcttttgcttaccctctgatagccacctgaccatcagccagaacctaccttcttccagaactgggaaaacagtgcagtagacctagcgatatgtacctgtaattcatcactatcatatgaaatcatcatcccagttttgtttgtggagtaaatcttgatactcaagaaaaaaaaatagtagtaagatttagagtactatttgctacattttttgtcatttgttctgcgtattatttttaacagagtaaacagtagcttgtctctttttctcatttctaaaacagatttgttttccactcaattagacttgtgatcacgagaacacaaagtagtatttttctccttctggagagagacataccgtatgatgggcaaattgtcaggaataattataccaaatgatggaataaaatccaatggaaaacatctctctcattgctagtgatacatttttatttaagacacaatgagcatcaagcacatttatgacaaggtgaaattgacaagtggccctctgccatgattttatttttaattgctagtaaactaattagccagaacaacatgttgtataatccacaaaactgtcgctcatgcgttctccaataaaagcaagatatatgatgtggaaaagttctctaagagctagccaaaaaaaaaattatttcagaattttgagtgtatagacatcacagtaaaagatgtctcctcaccagtggaagaacatttgtatataacatttgttttgagatctgaacagaaattaaggacaaacagtaaatttttttcttttccttttttttttttttttgagagagagtctcgctctgttgcctaggctggagtgcagtggcatgatcttggctcactgcagcctctgcctcccgggttcaagcgattctcctaccgcagcctctcaaatagctgggattacaggtgcttaccaccatacccagctaatttttgtatttttagtagagacagggtttcaccacattggtcaggctgatctcgaactcctgacctcttgatccacccgcctcggcctcccaaagtgctgggattacaggtgtgagccactgtacccagcctgttttttccctttttaagatcaaagtatgcatcaaaatagccaaccactttcttacatgtaattaagttttatgtagttgagtcacattaagtctaagacatacattctaggactaagactttacagtcattcagtagttacttatttgtgcaaggcttggcaaccttttcctttaaagggacagataatacatatttttgtctttgtgggctgttcagtctttgccacaaccactcagctctgatgtagagcagccgcagtcatagataacgcaaaaataaatgtggcagtgttccaataaaactttatttatggacacaaaaatttgattttatgtaatttttatttgtcacaaaagataattctttgatttttttcaatcatttaaaaatataaaagccattcttagctcatgggttatacaaaaggcaggggtgtggatttggcctacaggctgtagttgccaacctttcctctgtacctgctgcatgccagcgtcactcctcattctttagtatcagacgtgtgttaggcagggtgctaagcatcgagggatattcagagatagagcaaagtcccttccctgatgaagcttacagttaagctagaaaggaaccatagatgggacagagacacataatattagatgttaaatggtgtccctctgtgacaaaagccaccattgctttacaagtttaagagagagggaagtcacttcagctgatttaggtgatctgctaagtaagacatgacctggctagctacggatgcatggaaatgatgggatatcagctggatcctgaagaaaaaggctgtggacctttgaaaaggtaacagggcataatgcctccttttagaggaagggggaactgaggatggcgaaaatgtcaaccatgagtcacttattcctatcatttttcccccaattctttctttcatgtcttctcatgaaaatttcaaacatatagcagttttaaagaatgttacagttaatacccaaatactcaccatatagattctaccattactattttgctatactgttttattgtatatctatcctatcctcttttgttttagaattctggtctcgctctgtcacccaggctggagtgcagtggtcactacagcctgcaactgctgggctctgcctcctgagtggccaggaccctatgtgtgtttcaccaccatgtttggctaattgtaaataatgttttgtagagatgaagtctcactatgttgcccagagtggtctcaaactcctgggctcaagctgtccccctgtctcagcctcctgcattgttgggattacaggcatgagccaccacacctggctgctttattatatatctgtccttctgtctattcattaatccattttatttttggtttattttaaattaaatttcagacatcaagatacattttcataaatatttaagcatgcatatcattaactaaaatttaatgttggcttatagtttttcttcttttggtgtaaaatttatatacaattaatcgtaccaacattaaatgtacattctctgagatttggaaaggctgatccttttgtagcctaaattggaagatacataaagttttcatcacctcaggaagttccttctgtcagtccttgcccccagcctacccctggaggaaccactactctaattttctctgctttaggttagtttgcctgttctagaatttcagagaaatggaatcatacagaacctatcattcggtgactcacgcctgtattcccagtactttgggaggctgaggtgggcagatcacctgaggtcaggagtttgaggccagcttggccaacatggcgaaacctcgcctctactaaaaatataaaaattagccgagcgtggtggtgggcatctgtaatcccagctactcgggaggctgaggccggagaattacttgaacctgggaggcagggattgcagtgagccgaaatcatgccattgcactccagcctaggtgacaagagcagaactgtgtctcaaaaaaataataataaataaagaatctatcatttgggtttggctttttatcatcatatattttgtctttacttgcttagtatctagcaagaatataaatgcaattattttgccagagaaaagtatatgtttgattaaggaaaacataaaatacaactttgtttaaatatctgtatgtatattcttaaattattgtaaaattaaattacctatggattaaatttttcacattaacattacttagtctattatgctccagcattttacatatttatgttatttaattaaaatctttgcagtagatatttcccattttgaagaagaggaaactaagacagcgaataaaataataaacaatattatttcttacctcttactgttgccacttcagtgtcagggaggaagagggatagcaaatgtaggaagggtgtttgcaaggtgagtgaaggtgaagctgctttgttacaagttttcttatcaagaaatggatagaacataggagtagagaagttcaataggaacatgcaaaatttgtctattgtaaaagaaggaagaaaactggagaatttaaggactattttttaacatctatgattaaaatattatgaaacaatatctttttaaaaagtgatatttttcctctagtataacacaagttgttagaaactaaggaatcaccctatcttctttagtaaaagcctacaactggtagagtttttttttttttaaggatctcaagatacttcatgaacctcaaaagactttaagttctctgcaatgttaggaaatgacttcatgaatatcacagttcaaggttctgctactgcttttagaagcccccaaagtgtgaagacatctagtacagtatacagtaagaggagaactggcttttattgctcacaataggaatgttcccatctatctgtttgcaaaccaactcataaaatatttgaatattcttcactctgctttatgataatatttcttggcttggaaatttgctttttttttttttttttgagacaaagtctcgccctgtcacccaggctggagtgcaatggcgtgatctcagctcactgcaacctctgcctcttgggttcaggcggttctcctgcctcagtctcctgagtagctgggattacaggtgcccgccaccacacccggctaattttttgtatttttagtagagacggggtttcaccatgttggccaggctggtcttgaattcctaaccttgtgatcctcctgccttggcctcccaaagtgctgtgattacaggtgtgagccactgcgcctggctgaaatttgcattttcattaatagatcatccttatttaacaatgaacttcctatgtgtttgtgacacatggaaaataagtaggcagcatttaatgtcatttgggaagcagtgcttatagtagttcggtttacattcctcatacagccatgtgccgtatagtgatgtttccatcaatgactgcatatgcaacagagtcccacgagattataatggagctgaaaaattcctattgcctcatgacatcatagcctggtaaggttatagtgcaacaaattactctcacttctgtgctgatgctggtgtaaacaaacctactgcgctgccagttgtataaaagtacagcatatacagttatatacggtatataatacttgatagtaaaagactatgttactggtttatgtatttactatactgtaattttacacttattttagtgtagtccttctactagttaaaaagaaaaaagttaactttagaacatctcaggcaggttcttcaggaagtatttcagaagaggcattgttatcataggggatggtagctccatgcatgttattgcccctgaagaccttgcagtgtgacaagatgtgcagctggaagacagtgttattgatgatcctgttcctgtgtagtcctcggctagtgtgcatgtttgtatctttgtttttttttttttttggttggtttgtttcttagaaggggtcttgctattttgcccaggctagtcttgaactcctgggctcagtggtcctcttacctcagcctcccaagtatctgggattacccacatgcaccactgcacctgtctgtgtcatagtttttaacaaaaacatttataaagtaggccatgtgcagtggctcacgcctgtaatcccaacattttaagaggctgaggcaggtggatcacttgagcccaggagttcaagatcagcctgtgcaatgtggtgaaatcttgtctctacaaaaaatacaaaaattaagtgggcatgatggtgtgtgcctgtagactcagctactctggaagctgaggtgtgaggatcacttgagctcaggaagtagaggctgcagtgaactgagatagtgccactgctatccagagtgaagccctgtctcaaagtataatacaatacaatacagtacagtacaatacaatacaatacaatacaatacaatacaatacaatacaatacaatacaatacaatacaatacaatataataccatacaatacaatttaataaaagaaaggttatagaatatggatataaaggaagaaagtatttttatacagctgtacatttttaagctaaatgttattaaaaaggattcaaaatttgaacaatatataaagtaaaaaacattacagtaggctaaggttaatttgttattgaagaaagaaatttttaaataattttagtgtaaccaacatgtacaatgtttataacatctacagtagtatacaataatgtcctaggccttcacattcatgcactgctcactcactcactcacctagagctacttccagtcctgtaagctccattcatggtaagtgccctatacaggtgtaccattttttaatcttttatactatatttttattacgtcttttctgagtttagatatgtttagatacacaaatacttgccatcaggttacagttgcctacagtattcagtacagtcacatgcaagtttatagcctaggagcaataggttatgctatgttgcctaggtgtatagtaggctataccatttaggtttgtcgaagtgtattctatgagttcatacaatgacagaatcatctaatgacacatttctcagaacatattcccatcgttaagcaacacatgactgtgcttagtcttctacacaggcttagtcttccttgttaattgaaactctatgtttcttctcagtttaagaagcttatttcaggactaattttcccccttttagaataagtttcccacatcacttggttacatgacaaaacaagttaaatcactgtccctttttgggtttaatatgtccagatgcaaattaaagaaataaaatcccttagatttttctgtatcttgtctcccttcctcattttctgcagaacagtttttaaaagttaatttaggaaatctccaaaatattagattagcatgacttcagagctataaggttcctgaaaagtttatgtagaaatgttgtttttagtgctttaatttctcttatagcatcttgatgggtagtcattctgcctaaaggagaactgaactcatcctgtgtcccaggagctttgtcatatgaaaagttgtaatccattctggtgcttcagatgttgaaggcccagtgaaattctacaagatggctgccacttgagctttggccttgcaagtggttaggaagatgttggtcctttaatctctgtacaggggttcagaagtagttgatagtttactaatgaaaaatgttatatgtagcaaaacacaagcaaaaaaatcaaaaacactgatgacttatataaattattaacttaaggaagattatggtacttgaaaaattattttacaaaaaaagattgtattaggaattttttctgctcttttttctcaagttagtaccaatgtaacatggctgtgttcatgtaatttcttttctcaatttggttcaagatttgtgtagctcccagtggtagattttgcggttgtattgcatgattaaagtgtccatcaaaatcttacagttggtaaacagtattaaaaatccatctccagcctctgtaaactgtacagagagctatgaatactagaagaaatggaagtattttaattaacccaagtaggactaatcaaagcagagcaaccagtttattcaattgaacatgtaaatgtctattcattcttgacatggcagaacatttatgtcatctattaaaagctattctgttgcttgtatgattataagctattgttcaacggggaactgaatcttgtaaaggcttccccaccccactttttgtttttttgagagggagtctcactctgtcacccagtctggagtacagtagagcaatcttggctcactgcaagctccacctcccaggttcatgccattctcttgcctcagcctcagcctcccaagtagctgggactacaggcgcccaccaccatgcccggctaattttttttttttttttttgtattttcagtagagatggggtttcactgtgttactcaggatggtctcaatctcctgaccttgtgatccgccctccttggcctgctgaagtgctgggattagagtcgtgagccaccatacctggcccccccttttaataattacatattacagattattttttaacatgctttttgctgtattcaggccacttcagataacccagcttcttgcatgaaagaatacagacttgggtaacttggttcagctaccctgccatcacctctttccttcaaagggttttctcttcttcatttcttcataataattcttagtaaatatctactacatgctgggtacatgtattctaagcatgttatatgcagtatatcatttaatttttgcaactatattgttattttttccattgtatgatgaagacatggaggaagagtgttgcatagtgctgtaagtggtagaaataggatatgaacacaaatctcagaagatccattgtgttgaaatgaatttgagttgtaccaaaggtgattgacattagacaccaggaagaaatttttgaaatgagtggatgctctaaggagccttttaagtgagtacagctaaaaggggttggggtgaaggtagtttcctgggattttttattaccattaagacacgtaaaaacagtttgtataaaatcccatttttcatgaattagttacattcttaccttgagccaggaagttaaactagatggctgtctgaagacccgggtaatacatttaatacagtcttatatgtgtataaaaagtggaaacaatgattcttttaacttttaaatatgaatttttattgcaacaacaattagaaaatataaataatacttacacccctgccattctaatgtaacacttagttttgggcctacttttttctggtcacttttctcatgcatttaaaaaaaaaaaaacaacctttttaaaggttttaaaaacgtttcttaaaatgtagtgtattatatttatgcccaaaaatctatccatgttaagcatataattcaatgagttttagtaaatttgcagagatttgtaaccatcaccacaatatgatacagaacatttgcatcattccagaaaggttcatgagcagtctctcttcttctccattctttgatttcttaaggtggaagtgtctgttactggtttactgtttcttcctttccaacataggtgtttatggaacttctttagctgaagtcatgaaaatttgtatattctatttttatttctattccgttcaaaatatcttctgatcgctcatgtgattcattctcttaactcattggctatttagaagtctattgacatatttcaaaatatttgtgaatttcccagattttcttgttgtttgtttctaatttaattagcaatacagaaaatatactttatgtgatattagtcattttaaatttatagatagttatggcctagcatatgatctattttgatgatgtaccatgtgtgcttaaaaggagtatgtactatactcatttggggtggagtgttcttaggtcagtttgtttgatagtgttggtcaagtctactatattcttgttggttttctatctaggtgtcctgtttattatttagagtggtatatcacagtctccagttatttttgcattgtttgtgtctccctttagttccgttagattttgctccatctgtttcggggtttgtagttaggtatatccatgtatatcattgtatcttcttggtgggtagacccttttatcattataaaatctctttgtctctagtaacagttttgctttaaagtctgttttgtcggacagtattctctctcccctttattattaaactacatttaatttgtattaaactacatttattgttcacatactgtttttcaatcttttttaaacttatttttgcatttgtatgtaaaatgtatcgcttttagaaagcatatcattgggtctcttttgaaaaaaatccagtctaacaatctcttttttttgaattttaaatttatttatagttaatattattattgatttgattggatttatgtctccattttgattttcatctttttttgttcagttgattttcctttactgcttcttttgtaactaaataggtgtgttttagtgtatcatttttattacttagttcatttttgctctatgaaaatatttttttctgaatgggttagggtttatacatgcattctaccttaacacagtctattttagtttaatactgactttgtattaaactttgtcagtttaataatgactttgtattaaagtctgtgcagtagtatgcacaaactttgcttcactatagatccatgtcaccatcttttatagctattattatcacatacatctatatatcttatatacccaacaatgcagtattgtaattattgctttgtataacctatgcttaaagaagttaagacaaagacaagaaaatagaaaaatgtatgtatgatttctttcaacatataaaaacctatatgcttactgtttccattactcttcattttttaaatgtggaattgatttatggcttggtagcatttctttggcacacataactatattctttctctctttctttgtgctactattattatatatattaatctttctatattatatgtcctacaacacaattttacaagtactgatttatgtagctcttttttaaatcgttagagacaagaaaagacaaaaattatatagcctcctatagttacctacatagttacctttaacaatgtttatttttcttcatgtggatttgaattaaggtctgttgtcattttgtttaatcctaatgaactttatgttttgtaaagcaggtgtgctaacagtgaattctttcagtctttaataggggatttcttaattttgccttcattttgaggaatatttttgctagatacagaaattttggttgacatctatttgtttctttgagcacttgaagacatcctcccactgtcttctgccttccattatttctgattggaagttggctgttcatcttattttgggtgccttgtacatagtgagtcatttttacccttgatactttctagatctcctctttttctttgcctttcaacagttatatatgaaatgtgtagatgtggatctctttgtgtttatcctacttagaattatttgataattttggaagtttagattaatgtttttcattaaattgggggaggtttttaccattatttcttcaaatactttttcagaacctttttctcctcttcttggaatctccattatgtgtgtgtttgttatatttgaggtgtgctacaggtctgttatgttctgtttattttcttcattttttccccctgttcttcagatttacaacctggatcaatctgtgttgaaatgcactgattctttcttctgccgttcaaatctcctggtgaggttctctagtgaattttttatttgttactgtactttcagatttcagaatgtccaattggttctatttaagaatttctacccttttattgctattctctatttgatgaattatgacatcatgcttcccattaaatctccaaactttttcggaaggggatctttgaatgtgtttataacagctgatttgaagtctttttctgttgagtccatcatgtaggctccctcagagatagtatctattgacttttttttccttttggaatggtaaaattttaattttttgcatgcctaatatttttgctgaaaactgaacattttagataatatattgtagcaactgtataatctgatttccccatctcttccctcacacatacctagagttaatggttgtttcttttttgttttttgtttttgcttgttttgggtttattactttagtttcttactggaatggttctgtgcagcatgtttccctcataatgtgtggctgctgttgtctctactccattgagtttgccaccacccttaccacttatataagcctagctttctagggaccacccctgaaatcaaaatagttgagtgctcagttaaagattggctagagattgtatctaaacacttagaacccctaaatcactgccttctgcttttatgatggatccataaatgatttggggaatgaatcagcagtcagcctatttaccagtctggcccaaatcttaatttttgtgttgtaaggcctcatgctcagcagaaataagtagcttactaaggctttctgcaggctctctgagcaagtgtgcagctttgtgcatatgcacagctttccaggccatcagagataagtaggatcgcatcaatgccctctttcagttcctggatctgcctattaattttctgactggcctactggtttgttgcttgcttcagtcagttatgagatttcagggtagctgcagtgttgtcctttcctgattgtttgcattaagatcactattgtttttgacaataccctttgtcatagaattttccacataaaatcagtcatttctaggatcagagccttcatcttcacagcacacccaccccgacagcacttctgcatcaggaagcaggggtggaactagggagtgggagtagcaccgcactaaagtgctatagactctcactgttgtcaatgaggttcggtgagttttcttgaagaaacacttctcagtttattgcatgcctttggtcaatttccagtgtcctttagagattgtttttgacaattttgttctgtttcattgtttatttttgtggcaaggatttgccaacctcctcactcagccattttggaaggtctgctgtcttgggtatgttgttgttgtttagaaacatacatgctacaaagtacactcttgagtatacagctaaagatttcttacatgtgaaaacacactcgtaatcaccacccagattaagatacaggacatgtccagcacccgttaatctttccttcctagccttctagtttcatcccagagttaaccactgtcctgacctctgtcattacagattactttttgtaatctgtgtggtttttttgttttttgttttttgtttttgagacagagtctcactctgtcgcccaggctggagtgcagtggcacgatcttggctcactgcaagctccacctcacaggttcacaccattctcctgcctcagcctcccgagtagctgggactacaggcgcccaccaccatgtccaactaatttttttgtatttttagtagacacagcgtttcgccatgttagccaggatgatctcaatctcctgacctcgtgatctgcccgcctcagcgtccaaagtgctaggattacaggtgtgagccaccacacctggcctagatatgaggtttttttgtttgtttgtttgtttgttttgttttttttcttgagacagagcattgctctgtagccaggctggagtgcagtggcgcgatcttggctcactgcaacctccacctcccaagttcaagcgattctcctgcctcagcttcccgagtagctgggagtacaagcatgtgccaccatgcctggctaatttttttgtattttagtagagacagggtttcaccatggtagccaggatggtctcaatctcctgacctcatgatccgcccacctcagcctccctaagtgctgagattacaggcatgagccactgcatccagcctataatctgtgtgtggtttttaaacttcatttgaatgaatatttaaaatatgtcctctttttcctctagcttcttttactcaacatagtaacttttgaaatttatccatgttttaggtgtagcagggatttttaattttttaattgttgtataatactttattaatagatatgccacagtttccttattgtgggacatttgggttatttccagtttgtggctattattaatgaagctgctatgaacatcctcctctttgtctttctatgagcatacatacgtacagttttaacgtggtcagcaacataatgcatgtgtaatttaggctcttgctcttttttttttttgagagacagagtcccactctgtcacgcaggctggagtgcagtggcacgatcttggtgcactgcaacttcccccttccaggttcaaatgattctcgaacctcagactccccagtagctgggactacaggcgcataccaccatgcccagctaatttttgtatccttagtagaggtggtcttgaactcctgacctcaggtgatccgcttgcctcggcctctcaaagtgttgaggattacaggtgtgagccactgcgcccagcctggggtcttgcttttttaaacttagcattatatcaagtgtttttccttatctctgtcattgtcatgacaagagtcattattttttcaggtaggtataccgaaagctatttccatttctatttttagaaaaagtcaaaggcctgtatttaataattactcttgacaacacaggtagcagttgatgctcaattcaataaatatttgttttcaacttttaaagaaaaactccagaatcgtatgctttttaaaaatagtatttgattgaagattaaacaaaacttactgctttttctgccccttgaaatgttccataactctatgcaattcacatattagtagtatcactttttaaatgtacaaaagcagacattactgagagccttggcctcaaaacattcatttgattgcctttctttaaaaacatatttcatactgggttatggaaaactcagcatttggttttggatataaataaagccatatgacctttcatatttaggagctgaatccctcttgtagaaacttgtgatgttgctttgcccactttcctaccctccctaccacgtcatccaacacatgtgcacttatgctcattcacatacacctcgcaggctctctgtgtcctgggacctacacttcacatagtacttggaaatattttctcttgaggaaatggatattagagttgcaatggtataggaactgtatacgtttttcctatctatactgtggtttttcttttcaaacattgtcgagatttctgatggataacagtagttgtgaaagacacaaggagaatgggagggaaaggaattgcttaatggacctcacataattgtgactatgactccaggtctgctgcgtttagaaatggaattgcgggcagatacatttgtcaaatttaacttaatcccttggcttttatctgatgtatatttttccattaacacagtatacctttcatctctactttcacacagtcaaacagcgtctaatttttggtggactttcttttcttcttttttgatgctaacattatccccgtagggtcctaatcaggttttagactatggagagaagaccataagaatcaccaaagcggaatttcccattgctggtaaagagatgcccaagatgcagaaggcttgaaataaatcgggcatgaaataagtggcgttacagccctatactggctttaccgcaagggttaaatttgctcagtgtctgcaatttcacctttcctgattgtcatacagagtgagatcattgtccaaaggttgatcatgtggaggatgtatgtgcttttgaagtgatcaaactaaaagagaaaacaaagctcatggctgaagtcatcacacctgaataccatcttgtgatgtcatggttttattggtatgaattctaaccaagctgtgggcatttaagtcatatttgtggatcagaagccatagatatttgcgcttctcataggctgtgcttttctgatactttgatcattattatatggtaactaacatatattaatatattaatgtattatatcatatttatttagaccccagtatggatactaaatgggataaagcatatgccaagattttttaggtcttgggattatttaatttttttagaactggcgttcattgattgtcattcacgtttctcttcacttccttatgaaaagtttctcaactcttctctcagtattttcttttcccctgtgagatatgtttccttttacactttttcattcctctaccaaatagtaataattgcaaacatttattgcatgtttatgtgtgtaccaggtgctatgccagttgtttttatgtgtattttctcagttgctgtcttaacggctctgtggtatttttatccttggtttacagatgaggagactgagcctcttttggtctctttccccctttaaagataaactcctcctatctccttaaactgagcttgtaacctggacctctgattcaacagcccacaccccaatttgtatttggctatttgtattgggctatttgggtggtggtcctttgaatgttgttgtgctaatggaggcctaaacgttgaatcccgtgaatggaaacctcttcacatctttactgcttgtcctgggatcttcacacctggaatattgatcttcaccgagtaatttgggaaaaacagaggcagaggctggaagctgctcaccgtcctatggcagggcaggtaatgtccttaatgagatgggcttattccagtggagcagtggtggggaagcaaaagcttggtgttctctcctcatggttgcgaaaatattcacataaaagattcactagctactgttaataattgaaggactttcctcaaaatccatgtattataacggtttaatatactaaaatgatttggaggaaatcggcctcagcattggtgaatgtgttgacatatgaagctattatttttataattcttattttagagatggagtctcactgtctcacccagcctagagtgtgttggcaagatcatagctcactgtaacctggaactcctgggctcaagtggtccttctgcttcagcctcctgattagctgggactgtagtcacatgctaccacccatggctaattaaaaaaaaaaaaatgtgtggagacaggatctgactatattgcccaggctggtcttgaactccgggcctcaagtgatcctccagccttgtccttccaaagtgctgagattacaagtgtgagccaccccacccaacctaaagttgttttaagcttattgtgtgcatgttggttgtgtcaccagccgggaggggcttataggctgcaacactgttttctttcctatactacctttattatcacgtaataactaaaatacgtactatctgtttttaggtggatgctctgcttctcttgatagatatgaaagcaggatacctatcttccacccctgtgtttttcttttttcttttcttttctttttttttttgagacagagtctcacactgttgcctgggctggagtgcaatggtatgatttcggctcactccaacctctgcctcccaggttcaagtgattctcctgcctcagcccaccatgtagctgggagtacgggcacccaccaccatgccgggctaattttttgtgtttttagtagagacgggggacgtgatttcactgtgttggccaggcttgtctcgaactcctgacctcgtggtccgcccaccttgggctcccatctactcagatgtcctgtcttcacaggggccctctttgaccaccctctgtaaaactgtactcatattattcactattctttaccttgaccctgtattttcttagcacttatcactattcgatataacattttatattcttcaccaccaacccagactagaatgtcaggtccctgaaagtgaggtatgtgccatactcaccactttctccccagtatccagagtggtgtgtggtacatagcgaaactcagtaagtattattgaatgaatgaatgaacacagatgactagaaaaatttctagaaaattttaaaacatgggcatattagccatgaatttaatttatagttttgttgttttcttttgggtattcaaaaatataatttcatttgtttatatctctaatgagatagtacagtatttgtgattcttctagtgtgatggcatgtacagtttcattggtgagtatatgtgacctactgtgccaggtggaaatggagtgaatgaacattttggggggaactaaaaagcaattttcaacctttttgataagctaggttaatactgtcttctcaataaaaagtactttttcttcctcttataatgttcatggtcttcatctgtatgtgtatattgccgatttaggaactaaagccgaaatggatctcagactatttcccacagactggtagctgtatcccctctgtcagcaagtatttgatatcttcagtgaaaattgtttctttttccacttttagcttctgtttagttttacaagtctaaacaatttttggcaagtgctaggggctcacctgatgcactttttaatgcattccactcctcgttgttattttctctgtccagtacacatggtgctccttccccctcattgccatcccactttggcagaaagcattatggatgctgtgtatgtagactcatcacccaagccagcatgcatgggagagggggcctctagaataataattgttacttggtgttctctgtactactctgtttaatctccctgcttaccacttactgccttcgtaaagtaagctcaatacaattatttattgcaatttgtgtagaatgtcagatgtggaacagactttgcacactcatcagatccagcccctttgttatttagatacaaagactgagccctcagagaggagtcttgcactagactctagacctcccttgggcaggggactttcttgttcactgttgattcctgcttgtctaatacagtgtctccatgtaataggtgctcaataaaaaatattgcatttttcaaagtctcatatgtaagtagtgatggcagggccagaacttgaaccttgcatctcctagttatttgttcattgtcactgccacaattatctcattgtagtttaaagagagtcagcttccagtcttttaaaatacaattacctttaattcatctgtggtaaacaaacagcagctgtctctcattggcatggccgcagttccaccactgagcaattctagaaactgacactattaaccattctgctaaaaaggactcttctactcatatgatatcctggctgtgtccaaagtgtaatatttaattgcattttcttaatctttaccactgtattgctaagctttctaataccttcaaaataccaaatctcaggcttatcctaattaaagaatctcaatttaatccataatgcatgacaattcaatttgttgattgctttttctccccctctttgtgaaattcccgtcaaatgtattaattcaacatgatgaatcctgtattcaacccactggagtgaataattaaaattagctgataaaactttcagcagaattactttgtgaaattgctgaacagatgtgtcattttaatgaaaatccacagacaagctccttctccccctcggcaggataaaaatattatcccctcggcacatacttaatttggtggtaaatacactcggagcgattgctggaagggaagaaaaagcaacttgtcacacttagtaacttgatttttccccagcatgcagtaacagctatctacagtaattcatagtgctctattgttgctgcaagtcccaaagagaacttattaaaatgcaataatctcctatttaaacagaaacaataaccattaaatttcctgtggatccaaaattgagcacaagccccatctggtaagagtgattagaggcctgatgagggaatttaatttgcaacattcaaagactaaatctgagcagatcttgtcacctgggactcgagtgctgcttgctgtcttcttaaaaatctcgacctaaactgaaaatggaatgtagaagtgaaaatgttacccaggggccacccccaacagtattgtgtttcattatgtctccagcaggcctagtgagcagaggggattttagtgctgtccgctttagctttgccggcaaggccttttgacaggaccaacactaatgctgtcatttcctctactgccctgtgcatctgtcatgtggctgcccctcttagatcgtggactgcctgctccctcccttcttatttactttcctcttttagcttagcaagtcctctctctaactttaagagttctctagatctcaccagtctccctttcctgtccaaggagtcagatgctttcagcaggctactttgagcaccactgtatcatgctttacattttatgtctcctccttgcctatagacagtaccccctctgagtttattattagtgttttttttttaactgtaggaggactaagatttattgcatgttattagtaaatacaaattgtcattttcctcctcttcttagcttttctcttacaatcccccaccttatttatattacttctgagctccagagaaacaagatatgcgtgcactcatcatcagagagatgtgtttctgtgtatgtgtgtttgtgtgtgtgtgtgtacatgcacttgtttgtgtgtggttataggcctgatcagacagatgtcagtttatcaattagtagaactccctaattaagtatttgctttgagcaatagagctcttattggttgtgaggtaacttggcaggagggaggcagttaccgatgtaatagagatgcctgagcagatagtttcgttgagcagatactatttgatgtcctttaatcatcagactcctccacttttccttcttctgggctcctgatttatccctaaacaatcagagcctctcctccataattttatgaactacaaaatttacaaaaatgttttacaaaccctctgcctccccagtatcttctccagcccccatgtcttggggcaggccacatcaggtctctctggctgcttcctttcccaggccctactacctactctggcccatcatatgtcttttgagaagatgatttttcagttcttttctttagtttagaaaatcagaattaattgattaatttttaaccccttctacctttctcctcccctaccatatgaattcatgcagagccagccctgcaacctaattttttttgttttgtttttgagacagagtttccctctttttgcccaggctggagtgcaatggtgcgatcttggctcactgcaacctctacctccggagttcaagggattctcctgcctaagcctcctgagtagctgaaattacaggcacccaccaccatgcctggctaattttgtatttttagtagagacagggtttccccatgttggccaggctggtcttgaactcctgacctcaggtgatctgcccacctgggactcccaaagtgttgggattacaggcgtgagccaccatacccggcccctgcaacctaatttttaaggagaggtggtaaggttcattccatgaatcataccacttggaattcttgaaaaattaattgcatttattgcacacctactctctgtaaggcaatgtacataagaatggaggagatactaagaaaattgagtcccactcctattgccgatcgggaaagtacggcataagcacatgaatatttagaggtcctgtggtttaagtaacggtaggtaaggaatcattgggccagatgggatcagtgactcactgaatattataatcagagatgtgagtgcagaataaggaggagatatgactggggactggtgtagttcttagaggttgcctgagctggctagcgtgacattcctactaagcaatgagcctagcaaccagaatctcccagccccggtagccaaggagcacaggtggtaggctatagaaggagatttaatgcaacacagctgggttcaatatggtgcctctttcagagccctggctacaattgatgtaacctggtaactagtagctttgactttgatgtcagacacatctggttgtgaatattccctgaaccactcttaagagtttctcaactctttgagtctgagttttcttgattgtaaaatggtgtttgataatacatatgtggttttcatggggattttgtaaagtgcctggcatatggaaggagctgggtaaatgatggtagtacacttataatcttaagggcagaaggaatgaattaaatacagagtgaggcctagggactcttgctatgctccctcctgactccggtctagtattactaacatctttccagaaaccattcttctttatgttggttttggccctttgtgtccccatctctagccctttattcagttggtctgctcaaggcttgcatgccatttttggcattgaacatgtgatcctctagtttaatatagcatgtgcaatatggtaatttaagaaaataaatgtctgtatgcatagaaaacacagcatcctcctttaattcatgggtttatgggagattacagttttcttttagtttaagcctacaaagtgtttatagtaaaaaagtttcaatgaaatgatttccaatttatatttccttttcactcaccaccacaagtcagaaatcaaatcttatgcttagaagaaagcaactccaggactgtatccacttcgggttttgaataacaacagtaaggtggtctgactccaagattaggtccttgttgtttggacatatctaacaaggaactccatccccaagtgctggagaatccatgaagtcagtggtgtcttatgaagcttgagcaattgggaagccttcccagtcagctttttggcctcctctaggtcttaattacaaagcggattcatggtcctgcctgaaatctgattgagacatagactcctctatcccaaatgatatcattatcaacattggttccctgtggtacacatttgtcatattcattatgatttgtacctaagattccaggccacaataatagggtaagagtgtataatgggaaaaataacacaaatcgttttgattttctttaaggaaattcattgccttaacattacatacttgcctttgttttaaaactcactctatgccttatctaagaggagtcaatataaaagattttaattttagccccatatgctgtagctatatataaatgttctgtaaaatatatcccctagataaaagtacttactacttttttgaagttttttttaaaacctttcttttggtaaataaaagtctttttagctttgatgtgactattacacccttggtttgggttctttctccattccttcatccctagcccctgtgggacccctgtaagaaaaatgggaggggagagaagcatgaattccttaataagtcccaaaggtaatcaaaagaaagaaatgcagtatgaacaaactcacaaaatattcttgtgcttctttggggaatacttaatgcacataaggtcaggcctttgtaatgttaatttgagagtgttaggaagaaagccatcattttacaggcaatgttgctctctgaaaaaagctttgatttacagagaaatgctgttctaacacacctgcattaaaccagtgcctgccgactttgagaggcctgagttgcttgagcagaggaaatgcttcattgaggatgcttagggcatttggctgaagtggtaggaagtttgccagaggtcctattttcctgtggtcaaaacaacctgttcagtttggatatggtacagcccctattctttagacatgtgcagagtgacagcacaattccgcaatggcctcctttccaagattggccttagggagggaagtcttaccagacacagtggcaacatagttagtataggtatcttggttatagaggttagacatgaatagcctggtttccacctcaggtggttgcccgtgccttctcatcaacttgtaaacctccatactgtgtagaggagattgtgtggctagaaggaatggattcatcccaaacccccaaaacaggattcggataagtgaccatccagcctgcaccagagcattgccagagactggccattaattatcttcagaggcctctcagttcatctttggctctcctctctcatccatttctgtttcttccttcttccatccatacttcccctgctctttcctcctgccttttatattggtctgtattctacttttgggtgttatacaaatcagaaaacatttttatgttaaaacaaattaaatatgaatactctttgtgaagtgcctgacatgcagtaggcactcaattacttcctctcttccatcctactgtgtgataactcttctagtaattgagattatgttatcatgagactacatgaaaatattatcatgccccttctgagttaatcttattcaacctggtttctcatcccttcatcttcttagtctccctgccctcaaatagtccactgtgtgtgcacgtgcgcacatgtgagtgtatcttaaagtacagttttcaaaactagctgcacttccctatgttgggtctgatttgccaattttttatgaaggaataagcaaaaagaaagagagcaagagaggaagaggggagaaatgccgtgcttttctagaggagcaaatatatggaaattacccttgtttcttctctaaagtagtaaaggtcacagcagtagttgcaaaacccgtaggccgcctactgccttccacacattcagcattactattcttgcctattttacccttaggcatcctttatttcttgcacagatggtctcactcaggcctaacaaaatgttttaagctttgcataaattaaaacgaggtctctgagtacaaaagtgcaacttgttttttacttgaaaacaactatgctggcatcttttacaaaattacagcctcaagccaggtttccataatcagttttcctttaaaaaatagagaggaaagaatgtatccttgtgtgtgtgtgtgtgtgtgtgtgtgtgtgtgtgtgtgtgtgtgtgtgtatgagtatatatataatatatgtatgtataccaaacacaaatggtcctaatcaatgggattatggcttttatgatgttctgtgttcctttgaaggttgatcaggcatgagtggtggatgattcagtttgaataaatagatttggaaatattattttgggggtccaggatttctgagtttcttcattagtttagtacatgataacaactgttgagacatttcagtgtgcggagactccctcctagaactctttactatgtaccttataacagggttttactcaggctaaccttgactgtgctcaattgaaagaaagtgatgagtcagctcaaagagaaatagtctgtttctcccaactctgcgataatgtgtcccaaagtagtgacacatggcatattccattcttaagataactggcagacaatttgtacaatcttctagacacattgcttccctttgattcacacatcatcaccaaaagggtaatgctacaaatcttttctctattcatgactactcttaacagggatatggcttgtaaagaagcttattgatgtgctttgcttgaaatagaatcattagactgggcctgccctctcatttttaccttgacagtaatagtaagagtatgggagatactcttactcttattattactataactataatagtaatactattacagtatagtaatactattacagtaatagtaagagtatgggagatactcctattcttactgttactgtcaaggtaaaaatgagagggtactgtgtgagttattttttatatattgtcatcttttaataaccctatgtgcccactatagagaagttggaaaatatagaatagaaagaagaaaaagttatttttttattttccacagttaatattttcacatattatttcattatgtttatttcctcacacactagtgatcatactttcaacagatcatactgtagatattactgtagatgttatattcatttgttcacttaaactaataatttgaatatactttactattattaagaactctttgttaaagatcaaattgttttaaaacttaagttagagaggcatttatagcattagataatgccagccaggacatatacactatctttaaaaatgaatctaacccttaaatgaaatccagcagccaatctaatgtttctttgtaataagcaaaatatttttctgtgttattgcatctcacaggaatctattcctaaaggattcaatagtaaagatgctcagtaatcatgctctagagtttctcatccctctaaagaacacacagcagttctgtgaatgactaaggatcagcaggaatggatgtcaggtgaatgttggcactactggatacaattgatatgctttatggattttttgtttcaatgtgattctgcatagatggcacctgtaattatgaccatttggatcatgtgaaaaatgataaattttcggtgaaagggaatggtgcttgatccttttctttgtctttgaactgtttagaaacactaaacttaactgataaaagtaagtgcaagatggccgggtgcggcggttcacacctataatcccagcactttgggaggctgagacaggtggatcacttaaggtgaggagtttgtgaccagtctggccaacatggtaaaaccccgtctctactaaaaatacaaaaattagctgggtgtggtggcgcatgcctgtaatcccagctacttgggaggctgaggcaggagaatcacttgaacccaggagatgaaggttgcagtgagccaaggttgcaccactgcactccagcctgggtgacagagtgagatcctgcctcaaaaaaaaaaaaaagtgtgtgtgtgtatatatatatatatatatatatataaaaaataaaaaataaacaaaaattaaaaagtaagtgcaagacatcttagaagtattgcagttttttaaagctcttgacagagtaactttattcatgcaggtaaattctagctcttttgagcaatatgttaataagtcactgctaatggcctaatagtttttaacttacaattaaagacccatgatggaaactggcagcaatttcataacccaccagtctaattgtttcacagtgaacaattatttgccttgcgaatacttacagtaaacatttctgtaaagtttatctttgtttcctaaacagtgatatttgttttgtacattctgtagatggaatatattctgcagtttggtttttctgctgcttagttgctgagaattgactgtgttgttgcacatagctgtaatgcattcattttcactgccctgtagtgttccattgtatgaatatactatggtttacatataccttgtattgatggacagtggacatacaggttgtttccatttttgatttgttagaaatagtgctgtatgactgttcttttatgtgtctcctggcacatatccttgaaatttacttagcattagaattgcttgggtttagggtatgcacataaggaacattactagataacgctaagttgatttcaaaattaattgtaccaatttccactctaactagcagtgtagaattgttgccatcgtttccacattttcatgaatactcttatcatacttcatatgaaataatcttgtgcacatgtgtatgtgtgtgtgttcaacagcctcattgtggttttaatttgaatttttctgccctggtttcctcttctgagcatgttcttttgggttttttaatctatgtctttattttaatgttgaactttttcttattcagttataagagtgctttatatattttgatcactattcctttgtgaataatgtgtgttccaaaacatttcctaagttatggtttatcagcgcattctgtttatggtgtcttgtgataaaaagttcttaatgatagaatagttgagtttatcaaacttttcctgtatagtttgagtcttgttttgagaattcatccctactctgaggtcataaaagcattcttacatgttgttttctaaaagtgttctagttttatcttttacacttaattcattgctttatctggaattaatcttcatgtatgatgtgaggtaaggtaagggttcaactttatttttctccatatggacaagcaactataataccattaccataatatattttaaaagtttcttcatctctcagtgatctgatggaccaactgtcataaattatgcctccaaatttgcctaggtttatttctgagttttctctttcatttgtttgctaatttatataacaacacaacactgttgaaattattacaacttttaattattgcttgatattttaaaattcagtctccctcccccacctcttattatttttcaggtacacattggtgactcttgtcttactactcttccgtgtaaattttagaatcaactcatcaagtttcatattctcaaaaaagtgaaattttcattggaattgcattgtttattggataatttagaaggaattggcatctttatgatattgattcttctagtccttgaatataatatttatctttatttatttaaatcttttttctccttccggaaaattttatggtttttctctatatgttttttttattacctatttgcaaatttctattagatttgttcccaggtacttgattttttttggtcctattataaatggtgtcttgaaaaaccatgttagcagcagttctcgttcttcgtatatacccaaaatcattcatagcagggactcaaacagatatttgttcaccaatgttcatagcagcactattcagaatagtcaaaaggtagaaataactcacatatccattgactgataaaaggataaacaaaatgtagtatatttatacaatggaatattattcagccttagaaaggaaggaaatgttgacccatgctacaatatagatgaactttgaagacattatggtaagtgacacaagtcagtcactaaaagaatactgtataatttcacttatatccagtgcctaccactgtcaaagtcatagagacagaaagtagaatggtgattgtcagaggctggtgggaagagggaatgggctcttattgtttaacaggtatgaggtttcagtttgggaagatgaaaaaatttctggagctggatggtggtgataattgaacaatattatgatataattaatactattaagctacacacttaatggttaaaatggtaaatttcattttaatgtatattttaccacaataaaaattatgtgttctaaaatttactgctggtgtatagaaatacacttgatttttgtatattgattttgaatctagcaaccttgccaaacttaccagttatagtaagttttttgcagctcgtctagatttctgtatatgcagtaatgtcataatgagcattttgtttcatcttttccaatcttcatacttttatttatttatcttgggttatccagttacctatgacattcaataatgtcaaatagaataataatagcaggatttcttgccttgatcttaaaagaagcgcttagaatgtttcccattaaatatggtattttgttttgttttgtttttaggtagcttttatcagattaaggaagttcccttcatttctagtttgctgagatttaatttttatcatgaatgactgtcagatgatttattgaaatgatgatgtgattttcttctaatctgttagtgtgataaactacagtaattgattttccaatgttaaatcaatctgtaattcgggggttaaacacaaattgattatgacatattatgcctttcacacaatgctagattcagtttgctgacattttacttaggatttttcatccaagttcatgagtccagttgtcttgtagtgtttttctcaaatcatcattttgaggattggtatcaagattctcccacctcagccttcctagtagctgggactacaggcacccactaccacgcccagctaatttttgtatttttagtaaagatgttcagtaaaaaaacatcattttgccatgttggccagattggcctcaaactcctgacctcaagtgatctgcctgcctcgacctcccaaagtgctgagattacaggcatgagccaccgtgcccagccatgtctctgtgttttaggtatgtttcttataggtactatatagattgattttttttaaaatttttttctcagacctcacagggatgaagatgttttaaaaagctcttctgaccagataatatttgtctgttaaatggagctttttgtctatttataattatagatcagttagaatttattttgtgcattctatttttgccctttctacattttttttctgatttcctgcttttctttgaattgtttcttcttacttcatttttttcttctgcaatttcagaaattctgtaaaccattttcattcttttggttgttactctagaaatttaataaaaacatttcaaagtctaaagttactcaggaggaaaggaaagataatgatgaatacagggacttttgaacactttaattcccatcagtttgttatcatttaccttaattctgttgtatacacccagcagatgatattgttcagaattaaccacatattttcccatgttctactcttcatttttattgctttcagaccattcatgttggatcacttttattctagataaattatattttttagagaatttttactatggaaagatactttttactctatgatattttaagttaacaagtttcactttgaatattgaagatgtcattctagtgtcttcaagattctacactgttactattgaaatataaggtgttatttaattgttgcttcctttaatgtaatttgttctttttctggctgcttttaagtctttcttttgtctttggtgttctgcagtttaaggtgcatttaggttgaaattattttttgcgtaacctgcttaggatttgttgtcttctttttttaattttaaattacgttttatttaacccggtaggtccaaaatatcatttcaatatgtgtcatcaaccacgctgcaagccctcaaaagccacatgtggccagtggctaccacactggaaaccatatgggacagttctatagaatggagtttagtgcgcattagaataaatgggaaatcttacttaaatgcaagctcctggggcgcgttcttagaggctatgattcagtaggtcagcaaagagaccctgggatcttcatttttaacaagtttccccaagtgactccaatgagagtggtctgcagaacactctttgagaaacactgatgtaggagattgttcagggcaaagcagaaggttcacctgactctcagggaaccagaataacctagtaaccatgggatcattgttacaggatccacatccctaagaggatgttccactgcagttttcatttttctctgactcaaactcagtaagtggattagatacatgcaggtgatgatgcaggtgcccatatgggacataaaaatttcaagttgggtccatttgttcttgcatcaaattatgttttaagtaaaatattaatattttaagtaaaatattttaagtaaaatattaatattttaagtaaaattttattttacttttaaaatattaattttttacttaaaacattaatttacttaaaatattaatattttacttaaaacataatttgatgcaagaacaaaatattaatattttacttaaaacatttaatattaagtaaagtattaatgatcctaataaatggggaaggagctcagacagaaccccattcccttcaaagcaagacaactttgaatagctgtgaatcttcataatggcttctctttatgaagccattgttttattcaaggatctactaattgggtaacaccatctcctatgcacaaacatgccctaaacttggactcagttacaaatagggatgaaggtaagaatggtcagactgtctggattttccttctcttagtgtttctcaaagcatggtctaaggaccagatagggccatgataccagacatgcaatagacagacctgcacatttgcagcattctcctccagagacagattcacatggtcaggtacagacccagaatctgcaaggtctgccacccacctccattctctgcccctggataattctgatacaggggattagggtgaaactagtggaacccatatataccacgctgttctcatcagaatgaaactacaaaattcactaacatctctcttgtttttaattttaattatacatgtactatttacaatagcaaagaaatggaatccacccaaatgcccatcagtggtagactggacaaagcaaacatggtacatatacatcatggaacaccatgcagccactaaagaatgagatcataccctttgcagcaacattgacagaggtagaggtcaccatcctaggcagaccaacacaggaacagaaaaccaaatactgcaagttctcacctatgagtgggagctaaacaacaacaacacacagacactaggaggggaataacagacactggggcctacttgagggtggagggtggtaggagggagaggatcaaaaaactatcaggtactatgcttattacccaggtgacaaaattatctgtacaccaaacctctgtggcacgcagcttacccatataacaaacctgcacatgtacccctgaacccaaaacaaaaattaaaaaagtatacatgtcatatgaataaatttccagttataaaatatttctttttttttttgttgagacggagtctcactctgtcgcttgggctggagtgcactggcacaatcttggctcactgcaacctctgcctcccaggttcatacagttctcctgcctcggcctcccaagtagctgggattacaggcgcctgccactacacacagctaattttttgtatttttagtaaagagagtgtttcaccatgttggccaggctggtcttgaactcctgacctcatgatttgcccacttcggcctccaaagtgctgggattacaggcgtgaaccaccacacccggccaatataaaatatttcaacaaatacaagtaaattaagtaaaaagttccctcacctcttctctaaatgtactcttcccccggggtgaccacttttatcagttaaatttaaggatttcttgtcttcttgtatctttggattgatatttttcatcagttttggaaaattgtctattcagtttcttttcaagtattgccaactcctcattctctctttcccttcctcttctctgggaactaagattatatgtttgttagaccttctttctcactgtctcttccttgactgtcataatttctgtactacattccagatgatgttttattttagcttccagtttgcttgttggctcttcaccagtacctaatctattgttaattctgattactgagattttcaattttgattaatatagtttttgtttttataatttttttaaatttaactttttatttggaagtgatttcaaatttgaaaatcattgtaaggtcagaaactgtgtgaataataccatataccctttacctagagcctctgattcttatttcactccatttgatttataatttgttttttctctctcggatatatttttttctgaccatttaaagataaatttcatacattatgacctttttcactaaataatttaggttatatatttcttaataggcatattctcttacctgattacagtatagttatcaactgtgaatattgctgcaacgaacatgagaatatagctacctctttggcatactgatttcagtttctttgaatttatatcagaagtaagactactggatgataatgtaattctatttttaattttctgaggaactttcatactgttttccttcatggctgtattaagttacattcccatgaacaatgcacaagggttctcatttctccacaccactgccaacccttacctttcatccttttgatatctcattgtggctttaactttaatttccctgttgatcagtgatgatgagcattttttcatatgtctgatggccatttgtatgccttctttggagaagtatctatttaggccctttgcccattttttgactgggttatttgttttattgctattgagttatttgagttccttatatattttggatattaaccccatattaaatatatggtttgcaaatattttctcccaatctgcaagctatttcttaactctgctaatcgcttttttttgccatgaagaagatttttagtttgatacaatcccacttgttaatttttgcttttgtagtcatattcaagaaatcttttcctagaccaatgttgtggaacgttttcctatgtttttttccagtagttttacagtttcagatcttacatttaagttttcagtccattttgagtttatttttgtaaaaggtgtgaagtaagcatccagtttcattgttctgcttgtggatatccaattttcccaataccagttattaaagagactatcttttctccattgtgtgctattggcatctttgtagaaaatcagctaaccaaaagtgtgtgggtttatgtctgtgttctctatcctgtttcattggtaatttgtctttctgccagtaccatacctttatgatcactgtagctttgtgatagatcttgaagtctaggtaacgtgatgtttctttttcattttttctttatgtagtcaatttatgaattcctattttcctaagcagtcttgaattcattactaaataattttagtactcatttcatatttggccagtggtgtccacatctaaaatggctcctgtaacctagtgatgtgctcatgtcattgatttgagcagttgtttatgttatggcataacaagatgtcattttgtatctactctgccttagtcctggaatggaaaaaagaaattttttgaattcaaaactgttgattctttatttaaaatctttaactctgttagtacatactaggtggtgttgattttttttgagactgttattcttcttgagacattacatatacttagcgtgtctgaaatttcaatgtctgaagcatttccaatgatttatgtatctgattgttgttatctgccagctttcactcatccttttgcctttccttacttgtttggtaatttttactgtgaattgcttatttccctgagaactttgtgtgagtattgcttgtttttcctggaatttttaggaattctttgacacctgggagaaggtggtttttaccagatatttgattatttcatgcctctagtgaaactacctgtgtgagaccatcttatattctcagggtgaggtttttcttttcagaccattttatgtaaattaaggctttaaaactctatgagagtcagcttgtcattatgcattatcagaagagattttttttttctgccggcaatactatttgagatgagaaattttcattgcaatttacttgagggagagggtagtttatttttagttcatctagcactgaatgtgtagtaggtcttttgtgtatagctctgttgggatcttctactagatgtcttacctggggtgggggccatgtgctatgctcttgatccctggatttgtgaagacttgaagccaaagctgaagttctaactagtttgggaaatattcataagaggaaacaaaaactaaattttttttcttctctttgctttatttttgacctgagtattgcttactttctgtctagctcatggatgtagattagaataatattttaaacttcattctgtttagtttttaaatcgttttcagtggaagtatcagtcttagtacctaatctcccatggcataaggctggaaatagccatgatcctgccaaacacggacactctgcaacctggaacaaaatattctactctaaaaatcaagtaattatgtcttttttcaataaaatataaagtataatcattaatgtaatttacttctttcattccagtcttcactcatgctttcaaacatagattatattattccaacccttcttaagtggaattagtatttcattattccataaggttctacaaatacctacaaagaccatcatgaattccaggtgctctgtaacctgatcaggttggagaactgctgatgcaaccaaatttaatcacttaatgttcttactaagcactcatttgtttttctgcttctatgacttgctctcactgcttgctatcccaaacactgtccgtttgtacatgttccaatgtcaccattcctttttcgggcaaatgcttcaaaagctactgtttctataaaactttcctttacccttctcttttgacttgttatgagctccttttgtagtttgtaatctccttaagagcaaatttcacaaatgttatatttgtaatatcttatgtagcagagtattctcacagtctagaacagatggttcttctgtatctgttgaaagaaatgggaagatagcaaagcaacataataggataattttatttttgcctactagactatctcaggatgtatgtgttttaaatcctaaaactggttagtggtatttcagttgaaaaggtcttgaccctttcccttctaacataacaatcctcatcataagtgagagagaagattgggtgagtagggctcagtgggggaagctggttcctttcacccaccttcagaaatccaggtatggaatacaggggttgttctggacctcaaaattacctttttttttttttttttttgacggagtctcactctgtcgcccaggctggagtacaatggtatgatcttggctcactgcaacctatgcctcctgggttcaggggattctcctgcctcagcctcccgagtagtggggattacagggatgtgccaccacgcctggctaatttttgtatttttagtagagacagggtttcaccatgttggtcaggctggtctcgaactcctgacctcgttatccgcccgcctcagcctcccaaagtgccgggattataggcgtgagccaccacgcccagccacgaaattacctttaaaaaggtggtctttaaaaggcaaatagggagatactaattgcaaaaaaaaataatgatgaaataagttatctttctgttttccactttttctgtggtgttccttttgacatttgcattccaaaccagagccccacaaataactgagtttgcactcttttggcaagcaaggactgctctcagatgtattttataacttcagcttatatgggaagaacttttctttccagagacggtttcatagtaatatccttcaaaagctcacattgtagaatatgacttttttttttctttgttgttatgtttgctttgttttggtgggttttattcatcatttcagccagcttatagaaagagatagaacttttgttggatactaaatcatgtctatcaaaagcactattgaccttgtgttgttaaaactaaaaatgtaagaacaaaccattttctaaggtttttaattatatgcactaaaacagagtaaggcctagatttattaatcattgggttatggtttgatgtggaaagaaccagcctataacttttccctttgtttaacaacgttattgctgaaaactttaatagacttaagtgtactggaactagggagtgaaatcttatctttccctgaacaccagggctgctttgttatggtgtttccatttgtggcataatgaatgtgtaggacgctaatgatgtggtctctaggtgttctcctactacacagagcactgataatgagctgcgagtaatctagtacgagtccctgaagatgaatcctgattaccttcatggggccattccgctctgctcccttcctccttgatgtttctgtaaagagcatttggattttgaagagagtattgtgtatttgacttttaattagatttgcagtgtgttgggttaataaactagggcttcttcttcttcagtttcctctaaagggatgtgtgtaaatgttgcacagtgggccaagagaacagagggtcataacaggcagcaatggtggtgtcgcccacttcatgccccagtcctgaaaagaaggcttatagtggctgaaggttgatttcatcccatggtccatagttacaaatggcttccaagctgccaaggacctgctaaacctattgcatctgttctgtacgaggaagcagtctcagaatgaaatatgacagttgtctgtcagggctgccccagagtcctgcaagttggtattatctgcttgcgttcagaaaacacatcaccgtggctgaccacagctttgtacttactgtgatcttagggctcgcatttttagggacaacttgccctttatgcctttggtccctttctgccttctgcttttgtttttctgccagttgggttcatttatcttctttcctgtgtgttttgccatgcttttcttattatagctttcagattcatcatggacagagatagaaagtactctagtgtctttatcccacctcagctctcagtctggtgtagagctaagggaaggagaattgccttcacagtcaactttcagtgtggtccctgaactttttattttgttcagtgaatccagcacatctcatattgtgccccagctataatgggtagtcctttcctgatcttctaagaaaattagatgcctggcttctgccttgctcttcattgttttttaagcatagtccttacatgatggtccgggccttccttacaggtctaattgtgtggctgggccttccttctgcatgcctattctgttttttagtttttgtttttcttttaagaattggggtctcactctattacccaggctggagatcagtggcataatcataactcattgcaacctcgacctcctggactcaagagatcctgccacttcagcctctcaagtagctgggactacaggcacacgccaccacacccagttcattttgaattttgtttttgttgttgttttgagacagagtcttgctctgtccccctggctggagtgcagtggcacaatctcggctcactgcaatctccgcctcccgggttcaagccattttcccacctaagccttcttagtagctgggattacaggcacatgctaccatgccgagctaatttttgtattttaagtagagaagagatttcggcatgttggccaggctggtcttgaactcctgacctcaagtgagccgaccgcctcgacctgccaaagtgctgggattacaggtgtgagccactgtgcctggcctgaagttttttttttttttttgtagagacggggcctcactgtgttacccaggctggtctcaaacttctgggcctgagcgatcctcccaccttggcctctcaaagtgctgggattacaggagtgagccatcatgcccagcctgcctatcctattttattctgaggctactactactccttatgggtagatccaaggatctgacatcattttcatacatcctgttcagtgtgtgagtatagaattgaggtaggctgacaacacaaaagtgggcagaggtttcccactcatccccgacagggattctctgttggcataggtgggctctggtccaactcctggccgacatgagcatggacaatgtggcacagttgtggctctgcatcttgtgtgtgactgctgccctgtttttgtttagcaagctgctgtgccaatttactatgcatgttgttacatattctgctctaatttgactgccattttgcttcagcgagacgatgattgtttatggcagggctgtaatgtgttgtcagcacaggttactcgctacttgttggcaatggcctaacattgcctgagacatggtgtcactgtgaaatggtttgacaatgttgagactgtagttatgttgagcagtaacaactgtagaggtcaagaaagggcatctaagaggaactgtgttcataggggaaagatggagaaggaatactaagtaggacagtagcaaatgtcatcaaagagcttcattttcacgcaattttcataattcagtctgttttctgtgaacagtgttggttcagctgttgctcgggagtagaagcacatttctgagttagaaatgaattgtgctgatcatgaccctatcattttcttctttgaacatttttagaaagttatccagcttgctgaagaatgcactagatccttgtccatgtgtgaggcaagggactcattgggccaccttcacagggtttcatttttggaacatttatctaaggactatcttactaccctgagagaccaagatgtaggctaccttaagtcgtatgaggctgctgtgaaaatggcatttgtttttttggctctaagaaattttcaggacctagtcaagcatgtgacaacaaatatttaatgatagtggacaaggtaaacttcaaaagtgactagaaacccttgtggaatctaagacagagggactctaacaagcttgatgacattttgaatacgttttgtattgattactgactcttttcccaataatctgtgaagctggctttctgtttggcaaggcagccccaaaaggaaccttcatcccatacctccatgcaggagtagcacagaacagcacccagcatcgggccctccagagtctgggagggttcggttgtctcatgaattatgtggtgcccttcaggaactcactttgacctctgatgcctttcctttcaagcaagtggtgtggaaaaatattaaaactctcagtaatgacagtttccagatatgcatatctttgagtggacaatgaaggcaacatttatattctgtccacgatgcgagcatggtatgcattctgcagctgtcacagagccttccttctggtaccaaataccttacttcctgacaggtatgacctctgagacctccctaacccctttctttcatttcatacaaaaatctagagcttggcttttttttttttccttctttttttgtaaaaagaggtttttccattttaaaaagccttttcagttcttaaacttgatcattgatatgttccacctcatcaaaaagaggagtgcagctaaactgacaatcagttcatgccattggcctcactcatcatcatgtcaaggacctggcatgcccattgagaagggcctctgtgcattctgtcctcaccaagcctaattccttcccctgttgatggttttgccagattctttgcctgttgatgcccatgccagggccacggtgcttatgccaaagcctttgacagaatgagtcaaatctggtgccagtcacccttggcatatgccaccttgttcttgaccacttcctaccagggatgggctgaaaagaatagtgtctgctaagagcttgtagaggacttttctgttaagtgctaagtgttgacattactccagtttgaatcagatcatttggaactcttgcttggatctctcaaagctgttgactcatttgtatcttggcctcacattagtggggtagataggagccaaaaagtttgagtgaagtcagaataaatatattttaagtgtggatctgtggagaagaaagaggtcccaagagcataatgaaaactgtggttaaaactgtgaatcaagaggtttgttttaatttgccattttcttacgaagttttaaaatattttctaataaagcttcttatttattgccttagtacattttctgttacttataacagaatacctaaaactagataatttatggccaggcgcggtggctcacacctgtaatcccagcactttgggaggctgcagcaggcggatcatgaggtcaggagatcaagaccatcctggccaatatggtgaaaccctgtctctactaaaaatacaaaaaaattagccaggcgtggtgttgcgcacctgtggtcccagctactcgggaggctgagacaggagaattatgtgaacccaggaggtggagcttgcagtgagctgagatcacgccactgtactcctgcctgggtgacagagcaagactccatctcaaaaaaaaagaaaaaatactagatagtttataaagaatgggaatttatttctgcagttatggaggctgaaaagtctaaggtagaggggctggggctgcatctggtgagaggcttcttggtggtggggactttctgaacagctccaaggcagcacagggtgtcacatggtgagggggtgagcatgctaacatgctagctcagttctcttccttttcttataaagctacctgtctctcaatattgctgcattggagattaagtttcaacacgagttttggagggggcatttaaacgatagcatatatatagtgcagcagtcccactcctaggtatttacccaagagaaatggaactatatgcttacacaaagacctgtaccctttttacactttttttttttttaagacagagtctcactctgtcgccctggctagagtgcagtggtgcaatctcggctcactgcaacctccgcctcccgggttcaagcgattctactgcctcagcctcctgagtagctgggactacaggcacgtgccaccacagctggctaatttttgtatttttagtagagacaggtttcaccatgttggccaggatggtctcgatcccctaaccttgtgatccacccgcctcgggctcccaaagtgctgggattacaggtgtgagccaccgcgcccggccaacctgtacactttttgtaatagccaaaaactggaaagaagcagtatacattactaggtgaaaattacagcatatagagataatggttatttctaagcacaaaaaagaatcaaactgatattcctaacaacatggatgaatttcagaaacattgtgctaagtaagagaaggcacacacaaaaaggtacatacttaataattccacttgtgttaaattctagaaccaacaaaacttatctgtagtaacaaaaagtagttccatgttcacctgggtgcaggggtgggaacactggctacagagttgcatgagggaacattgtgggtgatggaaatgttgtttcttgattgtggtggcagttatatagatacagacatatttgtccaaactcatcaaactgtatacttcaagtgggtacattttttcttttatgtgtattatacctcaagtataatgaagttgattttaaaaatatatttgttgtaatcccacttttgccacataaacagggtccagagaaatattaggtattccttctctctctctcatgtatatcctgatcaaaacatttatatgaacatattgaaatcagatttaaatatcagtttccctaatggactcagctggactcaagttaattgacttaataaaatttcgaatctcatttgttcctattttctcctccctacagttgttatctttactgttatttgaaggacttgaataagtgaattttgaattcagataatacactatagggagtaggaaagcagacccctggcctcaggagcgcctctttgatcatgaatgtctatgactgccattttgttctctagattcatgtctttatattgtctatttggcttatagttttttctatcaccatttttgttttcaactgttttttcactaaaagacaaaatttgattttcatgctattaatttcgtactaaaaagagcacagcaggcataattaaagcattttaagatgtagtaatttgatttaaaatattttactaagcgatatattacaaaaagttatttaattatctgtaaactttaaaagcaggtattagcattctatggctattgtctttaataattacattttaattttaattttagttttttaaatgtatgtttctttttgttgttgttgttctgagatggagtctcgctctgtcacccaggctggagtgcagtggtgcgatcttggctcactgcaacctctgcctcctgggttcaagcaattctcctgcctcagtctccggagtagctgggattacaggcacctgccaccacacccaaccaatttttgtatttttactagagacgaggtttcaccatgttagaaaggcttgtctcaaactcctgacgtcaagtgatccacccccctccgccttttaaagacctgacatcttagttgttactgtgaaattgattttcttgttttctcctcatcttaaccttgttttatatatcaaagtaaagaagaggaactgttaaaacttatatgaagtatggctgaatcttcaaaaagatatcaaatatttagaaactaattttaagctgcatatgttttatgaatggtagcaatacaatttataactgtcatttctgaaatctccggatttaggtctccattgccaaaaaatgtaaaaaatagaattatgacaagtgatctcttgaattaaaaccaaatgtttttgtattacaatacctgtgatgatgattccaaacaggcttctctttaataagtggccacagtagagtcatgatgttagcccttatatttataatgaggacaattctgggtcaccaagggcctggatatgggacccttggggcccactgtgatatttatggacatgaaatacagtcataggccatttatcagatttatcaaatttggaaacttccaaataaattaatttgacaaatatacataaacttcagtaaattttattagttttattttttgccctgtgtatttgcataaatgttactaggaaatatatttaataaaagtagaaggattttttttttttgcgtgatactcagctatattcttccaatagttgtggaacagcttagtgccttcagcagtggcagtctcctaaaacgattgtctatcagttaaaggttaactgagtatttggaccaagtagcaaactagaattcttttcatctaatctctgtttaatatagggatatccaatataacatccttgggtcagtgtagtacatcttacgttaagttttgtctctaatgaatatttatattacataaatgggaaaattggtgggttcccttggtagaaacatgatattggtatttttaaagtaaacttaaataggtcagaatttttatcctctagagaaaatttcacgtctgattaaatagtttacataaacttaatctttttctgctagatgcattataatctcagatattattcatgtagctattcctctgtgaaccataaaatgttcatttcttcaaaatgaatatgaagctcaaagcattagtggtcttaagagcataaaaactttattactttgtgcttcacatttttcaagtgactttggaaagccgaaacaaattttgcatttagattaatggaagatgttttccatgtgaaggaactggcaagggagcaacaataacaaaaatcccccaaggttaaaaatgtagtgcttttgattcttcccagaactgtgttagcagaacaatcatttctcagcatggaaaggtatcataattggtctatacagtggcaatactgaaaacgagtatgcttcagagaaagctaatatgactctacttaataatttccttcaagagcctgaatttgaatgtatgttccacccagcttgaggcaaacaatttgttcctataagttctagtggaagttaccggggggtcatgtaatttatttttgtcttgaagttttcaaaactgtgtagaaataaagacacgtttacttgcattgttccactagtaatttgatccaattggcaatgctcctttctcttcttctcaattctattatgttggaagagtggaagcgttcataaaatgttgtgacaaacaattcttcctagagacgtttcctctttctgtttgaacctctgatccacttgcgaatgttagcattctttttgtttgtttgtttgtttttgagatggagtcttgttctgttgccagactgcagtacagtggcacgatcttggctcactgcaaccttcacctcctgggttcaagcgatcctcctgcctcagcctcccgagtagctgtgactacaggcatgcaccactacacccagctagttgttgtatttttagtagagagagggtttcaccatgttggccaggatggtcttgatctcttgacctcgtgatctgcctgcctcagcctcccaaaatgctgggattacaggcatgagccactgcacccagccaaatgtttgcattatttagtaagtggttttttattatgggtctttacttacatgtgctgttattgtccttttcactgggattatctaggttttcaatctgtttctttgtattaattttttggctatgggactagttttaaagccctaccacagaagtagagggtctgtagttggagtacggtgagtaacatgagagaatgtttcctttttttccttgaagaatggatagttttaggggaatgtgtgcagatgtcagaagatggctacatagagaatgaagcatcagaaggtagacacaggtctctgcattgcaaatatcagtaacagggatgaagaaagaacagcaaaatttttagaaaaagtgtaaaggatggttagacacttagaccctctcttttataagtttgattgtgtacttctaagaagcagcaataagttgaaggtaaagttatctcaatactctgataagatgtggtctctggattcataccaaacattagagttcaaggcattccccttcagtttattttatattcctcaaatgtatctaattccttaggattaatgatttgtttctcttaaaaacagcatttattgctttaatctgagaaaaaaataagacttccagtgtttatatctacaaacacaaggattgaaaaaaattttataatcagcctcgctgctaattcttataggtgaagcaatgacttagaagaatggggagactggagtacatgatagttttgtagacagccacagttggcaaaagatggtggtgaggctgtccccgttgtaaatcctttatctccatgagagcaactgttgctggctagtttcttgtgaattaagtatgcagtttgtcttttttttaatgtgataaatgaacgtattttctaactggctatttgcttaataaaaatgagtaatataataaggaattaggggagcattggaaagataatcactgggaggtgagaaaaaaagttatctctctgcttcagtcccttattctcatctttatagatcagttctcccagtgagaagccaaatgggatgtcattctttgtttgtttgtttcattaattctttgcaatctatagtaggactgttgaggagaatgtataaactgcaggttaccagcaggtggaaggaggggaatgagggcaggtggtccataagcagaaatattaattcttgactgattgggacagtgaatattgaccaacattgaaaacattatattatggtcttatttaggcctgaacactgacagccagttgacaagtctaattttttataacttaaatgtggttcatttaggaaaaactgccatcaagggcaattcaattctattatgacaattaactctgactttgaagtaagtagaataaatcagtttatttctcagtaaggcccaaataaactgagattgttgtgaaaattatgcagtttgtgactacagtgtggatgttgtgtgttgggttgtgcagtgtacaacctgcaaagctgtatgaggcaacctggacattctactcctagctatatacccaaaagaaaatacatgtttctacaaaaccttgtacagaatgtttatagtaccatcattcataatagctaaaaagtgaaaacaacccaaatgttcataaactaataagtggataaacaaaatgtggtgtatccataaagtagaatattatgtagccataagaaagaatggagtaccacacgtgctacagcatggctgaaccttggaaacattatgctaagtgaaagaagccagacaccaaacggcacatactgattgtatgagtacatttagatatgaaatatctaaaataggtaaatccattgccagtggctgaaatggggagtgattgcttaatgggtatagggttttcctttgggggtgatgaaatgttctggaatcagacagtggtggggttgcacaaccttgaaaactactgaaaaccctgtgaaatgtacagtttaaaatggttaaaatgatacattttatgttgcataaaagaacatttaaaaaaattaatccagtggggtctgatggcaaattgacatgagggaacttttttgagggtgatggaagtgttatcaatctagattagagtgatggttgcacaactgtataaatttataaaaactcatcaaactgtactcttaaaatgtgggtgtattttatggtatgcaattatacctcaataaagctgtttaaaaaaaaccctctctgagtcattactgaaatcagtgccattttctgaatttcagaaatatcaaaggagagctttcctagtgtgaatttatcataaataatgtttggtattttttttcctttgacttaacgagagcctgagatgcagaaacaaatctgcacttccatgttgtgttacccgctttgggccatggcccatttgccagttgcagattgcctccttgtctgaaaatgggtgtgtttcttcatagtaactctcaattctattgttggtgacagcgcaataatggaactttcttctgtgtggataagccccttcagtgatatttgcaaatcaaatcatatctgctttttgtgctacattgtcctcaaaatcttctgattggtttggttatagacatccctatatcagctttcctgttctctttcagtttaaatatctgtatgctgtagcaaattgcattatgaaatcctctcacatttatcgctgtttagtgcatggaaatggcatttcctcattaccagtcaaagataaactctaaatgtttctttttttttttttcctgaagtatcaaattatgtattcaaaaaacttttctctatagcattatttctctgagctgtttcttttttccctcctgaatgctgacaccagatgcagtctgcatggacattagtcccagggaaatcttgtcttctacccaggacaaggagattataggaagcaatgctgactcttgttgtagattcacaatgtgctgacacgataataggacatgaatgggcttttggaatgccttttcctttgagctgggctgagagggggacagaggcagacagctccatggcctgaatttcgttagctgtgtgacaatgggagagataagtagatgtgacagttatgaatgatcctctgtcatgcactttcacgttcagattcagataaactgacactgctgtcaaacacaagctatggagagctgagacctctgatgaaccttctaatatggtaaatgggagtcttaattcttcattaactgaaaaaaggagatttggccatgtaattttctccttgctgcctgttttaaagattccaataacccagcatttacagttgactaggcagggattgcttttccccccctacacttgcaacatgcagactgtgaaatctgaggaaacgctgcttaaacccagacttattgccttggttatctttaatgactttgaaatgtattggcctcattatggaacagtgcagttatcaattcctctaattaggtgatgtgctcccataagaaatttaacattaaagcacaaaaatgaactcgttagaggcatctattgctgggaacttcagtatcaatggtgaattgaagatactgtgtttcgttaccaactcttctgcaccatacatctgactcctccttgaagactagagcatgggcatttttttctttttccttaagggtttaatcctcatatagcacctctaacacctttgatgacattttagtgcttctggatagtaaactgtgtgcctttgactaaatcgactaggagtctagggaagggaggaggtgagcagtttacatttaaatgctccacatatcagcccatctttctttcttggaatttaacccatggctatttactctttcttatgtaagtccaataaacttcctttctataagtagcttagtacagtctttgtttttatcacgatagggaccattatttgtttattaaatagtgatgctgtttcactcataaatatttcagctgtatttctagagaagtaggatggggtttctgggtttaggcttcagtgaagggactttaagtctcttaacccttctttacctcaatcatccatctgaacaaaaaaaatcattatagcctcccctttggggaaactacatagtttaattagtgttttctaataacttacaaatccttagagaaaagttatagtagaagcataagaaattatctttggggttagtttattattattgctattattatcattattactatatgggactagttgtttttttaaattggctacttgaaaatgtgtttcagatctcatggagtgaaatttacctttcatttaccttagggctcaaataagagtatactgaatataaaaatatggaacactaatttctttaaaatacctgaacctattaatagccaggagtgttaacttcgtcacctggaagaagatcctgtcctaacttgaaaatgttagaatgaaaaccttaatcgtctcctctcaaagggtcattgaggaagctgggcttgagtctgtgcagctgttcttcaataatgttatatcattctgaaccaattatcatccttaacccagatttgctttgaatctctgtggcatcttgactactgtctataacaacggtgattgccagacactgcctgatgctcaggtttctatcaatcctcttcttctcctcacagcaggtaggagcttcttggtgttccgctccttacccaggcttgaggaatagtcctactttttgccatgatgccttgctgcagttctggctcttcccttgtgctgttgttctctttgtcatgcaggtttcccagtatcttagtagaagccttgaacaattcctattaccttttcagaccttccttccaagaactgggggatgggggtgttctggtcttgtcacaggtgggtgccacatgtaaggacccactggttcatgggattctttgagagagtctgacgctcacttgtctgggttaaaagtctggtgctgacacctgctttctgaatgactttaagcaagttatttgacttctctttgcctcagtttcctgcctacaaaatgaagataatagcgcctgtcttatcaaggttcttagagaagattagatgcattaacacatgtaaagcacttagaacgctttaagtcacatagtaagcattaataaatatcagttgctaacagcttttgcttctgctctgttaccattttactatctcacctctctcatagcccataacagcaaaccaaactctttggctcttggtagatatattattcttaatgtttgagccctactatttgctattgcttccttttttactcctataatgtgtgaaattgaaataaaaaacagaattgaggccaggcacagcagcttgttcctataattccagtgctttgggaggccaaagtggaaggatcgcttaagcataggagtttgaggctgcagtgggctatgatagcaccactgtactccagcttaggtgacagagcgggaccttgtctcaaaaaaaacaaacaaaaacagaattggtcaccatgatattaaagagccatgaaatatattagcatgtcttttttctgcctatcccctctatcctaaacattccatgtagtcttgggaaataaattctttaaggtaggccagttattatgaatataacatgattatctattgtgttatgtttactgggttgatgccaaggaaaaatgaatatggcaggtcccagcaaataacaacaacaacaaaaatagtattgtctactatttcacagagggtgtggagttagtattgggttttgaaggatgaataggagtttatcagatgaggaggattgagaagagcattcagggcaaaggtatgtggaaaaattggtgtggtagtacacgccaatcctgggaccttcaagttgaacatttaggagtgtagtgtttatgtttcagaagcagaggatgagtggagagggcagcaatagaatggcattaagacccttgtacagtatactaaggagtttggacttaatcctgtgggcatgcaggaccctttgaaagatttgcagtgggaaagtgatcggatctgatttgctaactcattgcaatggctctgtggaagaatatcttggagaggggttcaagacttgagccaggggacatatcaagtagtgtttcaaatgctaactaccccctcctgcttctcacattgctaaatagagtgcagcagaatgaggtgtacttctgaagacaggtttttgaatcagctttccagcagtcccttgagtacattgagagggtgcatggagggaagacatatcatctttaccctgccctctccccatgttaatctattaaaagagatgggagcaaagctgctatcacattgggcttgactgaagacagaagtccttgagcatccttcccctgagtgcgggcaagcctcgtgcttgcagaggagaggagattagaataacatcttcactcttcggtgagagggcaggcagaccctcacactagatggttccaccccggagttcaggcttctcctgacaagtgttgcgagcatctgatgtccttggcctctcttctgcactgcttaccttacagcagttaagcatgagggcattctgtgtcttcctttctttcccttcagttgcttaaagaagatgagaatttgctttaaagaaaaatattaataaatctttataaaatggcattaaatagaaaatctcacactcttttcttcagaatgcttttcttcaattgccattgtatctttttgccccttccaaagtcttaccaattattattaatatatattatcataattacttgtagaaaatcaatagaattgcttgtctttatcagcagtgctacctttctacctctctctcccttttcatcctctcttcgtctcttgcgaattgttgtttctgggggtattattattgtaattacggaaattgataaaaataccatgacaatttcatgcctcagaattattacacagggtttataaaaaaagattattatacatcaatgcagtatttgttattcctaaatgattattccagaaatactaatcaaaaacatctccctgcagaatagtactgtggctttaatatcagctgctgtttctttgaatggggttgcccaatctttcatcaaagaaacacatcacccatatccctgtctttaaaaacagcaattatgtgtaaatgcctcctgatttatttgagccagggccactggccagtatgagtcaccacaatttattgctaaccgtcacttttacatgataggtctgtaacaaatatctgccgcatattgttaaattaatcttccatttaaaattaatggagttagactccccaggttcaatgtaatttcatgttcacgggcagggagggatgtgtgctgcatacaaaatgagacaaggcccaacgccctaatctttcatcaccttgaacctggagactaggacgcgtctcagcaccaactaatgagattgagcctgcgtctctcctgaggatgccggctcaaagaggcttttctgctcagaaatagcaggctctgtcttattttaataattcctcagatatgacaagtctgatgttatgtatgaaagagccaggcttgaaaaagagataaaatgaattttatatcattacttcaaaaccaaaccaagggaagtgtgttgtagttaaattaaaaaaaaaaaaagataggacacattttagtcatgaaatatactgactgtaaaccaggagtcatcctttcatttattttaatgcacaatcaccttagatttctcttctgtaatttttaaacctattcatgcgttaatcaaaataatgtggatgaaagcaggagcttgttcaataaacatttagatgaaaatatcagaggggacatgtaattcctgatggggtatgtcatactgaacctctgaagtcccatcgcttcttttggtggcatcttttgaaaatgcatcttttttctgtgtaccactaacctattactgtttagtctcttagactttaaaaatgcctaagccaaattactcaggggtattgggttctctcgtttttttttctgtctttttcacaaaccaggtaactattttgcatccatggaaaagaaggttttacagaacagatttcggctctcatacatctatagtacttctggcaaatggttgctgtttttttgtttgtttgtttgtttgttttaattcttagggaggactgagccccagagacaatgggacccttttcctaggtaaagaaaacgtctctagaaagacactaagttaagagccaggcaaggtggtgcacacttgtagtcccagctacttggaaggctgtgacagagaattgcttgagcctaggagttcaagaccaatctagacaaacatagcaagacctccagataaggtaaacttcctggtttttaaaaattctgtgagttgagttctgcttcctcagaggggaattctaagtatctgcactttgtgtctgatttatttattttatttttttgagacagggtctcactctgtctcccagtctggagtgcagtggcacgatcttggctcactgcaacctccacctcctaggctcaaacaatcctcccacctcaggagggagctgggactacaggtgcctgccacaacacctggctaattttatatgtttttgtagagacaggatttcatcatgttgcccaggctggtcttgaattcctgggttcaagcaatctgccggcctcagccactgtgcctggcctgtgtctgatttataatacaacatatgattgattttaaagctcttttttgtgatttgttgtaatttgggaccacaataattttttttccaaccccttcttcagacatacataataaaatttctaaagaagtagtattggtattatactacctatagcttttattattattattattattattttactggcattctataacttagaattctattttcttacaatctttgtatatttaaatgaacattagggatagaaaaaatgtaaactctaatacaagaatcaagtatagtcacttaattgacacgtgcagttttaaaaattatagtcaccccttggtatactgagggaattggttccagtaccccctcaccttcacccccatatatattcaagtcctgcagtgggtcctgcagagccctgtgtatgaaaagtcggccctctgtatgtgtgggttttgcatcttttgaatactgtattttaaatctgcatttggttgaaaaaagtctgcatgtaagtggatcaaaacccatgtggttcaagggtcaactgtgtatcactttgataggctatttataagagaagattttaaaaatattgctccatgtctgtacttgaataagatttagaaaatcttaggggtattttagaaccagataaattagtaaaaataatgatactgtaaattggaaaataaatgaataatagtagggcatctttctccatgaacctgaattgctttgctttcctctcttttgatgtctgtaagctgttgcgttttgtacagtgggcctcagggtgcttcgtgagtcccaaataccagatttctttttctctcttctacttatagtatatttgccttaagttcttgatattttcttctgccctcttttcttcttttaatatcttcagcatttttcttcttttttctttctctccctctttccttcccttaaaagggcttctttattttatatagaaactcatctttttttgttttgagacagggtcttgctttgttgctcaggctagagtgcagtagtatgaatcatgactctactgcagtctaaacctccctggctcaagcgatcctcccacctcagcctccaaagtagcctggacctcaggcatgcaccaccatgcccagctaacttttgtatttttttagagacagggttttgccatattgcccaggctggtcttgaactgagctcaagcaatctgcctgcctcagcctcccaaagggctggggttacaggaataagacactgtgcccagccttcaatttttttgttattgttgtgagtgagtgagtgagaaagagagagagagcgcaggttgatatgctcaagcttaaggtctgtaatgggtttaaagctccaagttttataatcggaatggtagagacggaaaggatctctgatctaatccatcctccatttcataggtaatgccatggaggcctgaaaaggttaaggttctcaaagatcaaaaatgtatccttttggaaagtattatagtggttcctcaaaaaaatttaacagataattaccatatatgattcagcagtcacacttctgggtatataatcggaattaaaaacagggacttggacagatacttatattccaatgttcatagaagcattattcataatagctaaaaagtggaaacagtccacatgtatatcagtttgtaaatgaataaataaaatgtggtatatccatagaacagaatattgttgttacttttgtttttgagttgcattttattctgtcactggggctgaagtacagtggcacaatcacacctcgctgcagcctcaaactatggggctcaagaagtcctcctgcctggtactacagacatgagctaccatgctcagcctggaacattattacctagccttaaaaaggatgataattctgacagtctgcaatacgaatgaatcaatgtaatttgaaaacattatgctgattgaaataaactacacacaaaaggataaatattgtgggatttcactgctatgaggtacctagagtagtcaaactcacagagacaaaaagtcaccaggaactgggaagaacagtgggatagggagttacccattcatgggcacaaggtttcattttgggatgatgaaaaagttctgcaaatgaatgttggtgatgattaataatgtgaatactcttaatgccactgaccatatacttaaaaatggttagaatggtaaaaaaaaatttgtatatttgccacaataaaatacacagacactggtatgatttggctctgtccccacccaagtcttatctcaaattttagttcccataatccccatgtgttgtgggagggatctggtggagagaattgaatcatgggggcagtttcccccattctgttcttgtgatagtgagtactcacaaggtctaatcattttataaggggcttttttcttctctgggcactcattcttctctctcctgccaccttgtaaaaaaggatgtgtttgcttccccttctgccatgatcgtaagtttcctgaggcctccccagccatgcagaactgtgagtcacttaagcctctttcctttataaattacccagtcttgggcagttctttatagcagcatgagaacgtattaatacagacacgcacacattcttttattacctgagaaaatttctggcaattagtatgtctgtcctcctctgcctccatctctgtagctaacatttggacattcctctgtttcagtttcagatttgctctcataatgtttttgaatgttacatctttccctttcttatttcagttttctttttttctgacattgagtacgtgctttgtgatagtcactagagatacaaatagctcagaatcaaagaaagagtgtacatgaagtattttcaagaatatgcctataaaatattcaacgatttctcagaaaatatcaattgtaaaataaataaaatacaacaaaactttcttatttgcacaaatgcgtaaagtacatgtagtctaatttaagtagtttttattttttttctctaaagtaaattttgtgactttttttttttttttgagatggagtcttgctctgtcacccaggctggagtgcaatggtgtgtgtgatttcggctcactgcaacctctgcctcccgggttcaagtgattctcccacctcagcctcccgagtagctgggattagaggtcccagctaccacacccaactaatttttgtatttttagtagagatagggttttgccatgttggccaggctggtccctaactcctgaattcaggtgacctgcctgcctcagcctgccaaggtgctgggattacaggtgtgagccactgtgcctggcccaattttgtgaccatttcatataatattataagtattcctttactaaggcaacctgttaatataggtctctcagttgcaggcttttcttattctatggattgactaagaagcccccaaaaatccttatgaggaaagatagagtcatgtgtcataagagaaggctagtaataggcttgagtttcaaagaaaagagtttatcagactgaggagtaaagaacgttggtaactggccttcaaaagatagttaagattgcatccggaaagatgtggggaaggggatgtaaaatggatagcaaggcaggatagcaacagggcattcttggaatagacaaccatccatttgttctcagtgtgaaatatacatggttttgtaatgggaattaaggccgaaatggcatgtcaaggccagtagttgagagctttgtaggtcacattgaagagtttgtatttggagtttgatggactcctaggatggatctgtccagtggacaactggatttcagacctaggagagcctctatagaggtattaattgaagcctttggatgatcgagattgtgaagatagaatataagacagagcctcttgagcatttctcccttagtgagaagaaggtggtgatacacagaaggaaccttcagcaaggtgagaatgatagataaaggatggactttccccaagaaacctggcaagggagtgatcaggagtgttaatactgtcacagagactttaaagaggatcacaaatgaggggaaaccttggattttaatcttgactcttagtactcaaggaaactgcatgttaagatgtggtaattaaagtattaaaatattctaagggtcccttgcactctccctttctgtgcccattgtgacagcatggtcacatcattgcttgaggcatgcaagagtgctttattgaagatagtattacggggggagattttattttgatagagagtaacaaatagactaataatctatcttaaagtaagtatcttaaagtcagtaggcaaaggagaaaaaaagatattgataaggaaagcatctgcaggacagattctagatttctgttttttgttgttgtgtatgtcagggcccagactatgtaaatgatagggcaaaatgtgagtagcaacatagtcttattagaaacctaaatatctacaaagagagcaaaaaactatcaagtcaagaatatgttacccattttagtaaaaaggttagatttcatttgccttgtgtatttgtgtgtgtgtgtgtgtgtgtgtatgtatgtatgtgtgtgtgtgtgtgtgtgtgtgtatgacagtactgtattaggaatgcttagtaggcatttggagaagttttgggtgattggtaacatgaaccattcttccctttaatctggtgcatctgaacatattcctgggcagaaggtatacctgtgcacattacagacgtttgtgggtacttttatttcattatcctcaagcaagaatacgagattgctatattctacattagaccaacttgttcttagcaagcacagaataataacctttcagtgtgaatgtttgtacataatagtagtaggatgtattttgtggtattttttaaatgaggattcattttaggcttggcacagtggctcacgcctataatcccagcactttgggaggctgaggcaggaggatcgcttgattgagcccaggagtttgaagccagcctgggcaacatagtaaaacttcatctctacgaaaagtacaaaaattagctgggtgtagtggcacatacctgtggtcccagctacttgggaggctgaggtgggaggcttgagcctgggtggtggaggctgagtgagtgagagtgtgtcactgcactccagcctgggtgacagagtaagacagtctctcaaaaacatacatacatacatacatacatacatacatacatacatacatatgtacatgcatacatacatgcatacaaatgaggattcactttaaaaagcattgaaatgtaaatatcagctatacctgaatgtttataatttaaaggtaagattgtcattaaaggaaaccttaggaatttctcagacatactgaaaatcagcccgaaagtgttttctgttgtttggttgttgtcgttcttttaggattttatggagtactctcattacttatcacttagaccaaaagagaatgtcaaactgccaacaaagttgttttttctacatttctactaaataatgttaagtagtcaggttcatctttggaaggaagattcttaagtgctttggcctccagtagtttagatgagacttcttaaaactcaaaatcattttattggaaaatgctttattttctgtctttgtgaattatatttataataatgcatttaatttaggccttgggattttgtatacctttgggtgggcctcttcctcttctccccctgcatctctaataagcactgaatatcaaattgaaaccatgatattctgaaatcggaaagtttctgccttttgcagcttatttgatgggaataaaaatgactgatggcactctctcttggacccttttgttcaactcacctatgattatggagcctattagctggagttacaacctatttaagagcagtgcttaccagtaatgggggccaaatgattttggaaagttcagatgtactggactccctgcagaaatgaattcagcactgaacatattgatgcagaacccgaacgaggctactccagtgggacaaagagaattgtgagctctgcaagaaatgagtgggtagtagaattaaagatcagatagatgttcggctcaagggcagtctcagctcttaagttcatcacagcaatttaatcaggcccaaatgagcgttgcccagaaaggaatcagccttcggtgtgacaggaaatggagtttatttaaaagattctttgtttctagtaattgtgtgttaaggttttccaagtctacactaaaattacggaactactacatttgataggtgatagcactttggtttaccttggttcagaagatgtactgttgagaagatttatacaagtcatgatcttgtccagaaggagcctgccacctcaaaagttccagctctatcgtcttttggattaagtaggccagagtgcatctttggctatagctatctgatgcccccttccattgtaaaattattttcacaaaaatatatttgtctacagtaagagttatataatatagcagtaaagaccacaaactttagaatgaggcacacctgggttggaatcccacctcctccacttgttagctatatgaccttgagcaaattacaactgtagttgaacacatagttctttacttacgaaatgagaataataattcctgcctcacaagattatggggagaggtcaattaaatgatgtagtatgtatcagttgcttcacaatgtctgcacataataagggctcaataaatagtagttacagctctagagctctctcatcttgtccctcacctcatttgcccactcctctactctcttcatgagccagagtgttcactgctttaggaataagtgagggaaactttttttttcttttttctttctttcttttttttttttttttccgagacagagtctcgctctgtccccaggctggagtgcagtggcacgatgtcagctcactgcaacttctgcctcccgggttcaagcgattctcatgcctcagcctcctgagtagctgggattataggtgcccgccaccatgcccggctgatttttttttttttttttttgtatttttagcagagacagggtttcaccatgttggtcaggctagtctcgatcttttgaccttgtgatccacctgcctcggcctcgtaaagtgctgggattacaggcgtgagccactgtgcccggccaaataagggaaactttttagaggatctttggcttcagtcatggagaaaaagaagaaactataaacacttggaggtctgaacagttcattgattgttaagaacccaaacaaaaacactccgtccccaaccccgacacaacaatacagtggggtattttggattgacacattattagcctggaaacctatattgacagccaggttatgattttacacatgtaataagaagagtctattggtttttcttctttgttgctcactagttcttaagtttgctcactaatgtataggtatttttgtctaacactgacaaaatttgaaaagaagtataataaatttattaggattttacttctctccttcatggacctggcaaatagtgtatctatgtctccatacccatatccacgttcttattttttttatctgtatctattatctgtctctgtgtgtgtggaaagtgataatgaatgaatgaatgaatgataaaagatccaaactatgaactttatggatatcggggtaaacatccaacaatcccttaaatttggtgcactcaagtaaaagctgaactggagagagttgaccagatcctcttaaagttaagctttttatccctctgcccataatttgtaccttgagatcctatagggatgtgcctaggcctgtgtgaatggcagcctcatctatgctgtacctgcagtacagaccagcctcatctgtgctttacctgtaatacagagcgaaacatatctagagaaagagattagtttgcaattagggggatcccacccattccacagcttggcccagtggaggttccctgctttgatcgtctcttggtgaagagaagaagagacagcaagtgctgtagaaagttttcttctttgtagttaaagtgatagggtggaaacaggagcatagaaaagacattcagagaatagaaagtgaccaaccatttgaaaacctaaaggaagacctgggttcaaacatttgttaacatacagagaagaaaaatatgatctgtttggggtattacaatccagtgtgtattttctatcatacttaccaaatgtacttacttgttgtaaacatttaatatttgtttagtgctttgaagattcggagtaatgtttcagatctacatattgtatcaataagcaaataacatatgctaagcacttaaaggctattgtcattctccagctagtacagagcaaatgtgaaagggtaaagactatgtaatttcaggtgcggtttcagtgaggaagccagaacagcagtctactcttatctgctgctttcttccaccccaaccccctgacccataacaacaaaaatcaaacccagaacaaaccgcatagattgatcaaagagcataacatgcattgttaggatttcagatatgtagacagaaagtcagattaagctttaatgataattttgagttcttggagcaatgctcattgattacaatgtgtgtgtgctggggagcaatatttggggtacccataccttccctgggcatgttaaccttgtggggcttgccttgtttcagaacatgtttcctattaaaaaaagatgactgtaaaatcgtaggccttttctagcatgcacctcaaaactcttccagcctctacccatcacccagttccaaagccacttctgcttccacattttagttatttgttacagcagtaccctcccttcttggtaccagtttttgtcttagtccactcaggctgctataacaaaataccaaaaactaggtagcttataaacaacagaaatttatttctgacagttgtggaggctgggaattacaagatcaagatgctggcaggttcactgtcttgtgaggcctagtttctggttgtagatggcaccttctagctgtgtcctttacatggtagaaggggtacacgagctcctagggccttttttctaaaggcactaattcactcatgaaggcttcaccctcatgacctaaccacctccactaaaggcccacctcctaataccatcaccttggtagttaggatttcaacatgtagattttgagtggacataaacattcagaccacagtccctgtgaagaaggtatttgttattctggcagtgcaggagcaagctagcacacttgccatatttagctgatagaagtaatgtgaaatgaaccgttaggaggagggattttgtggaagaaggaatggcggactgagcaagataaaatatggagaattgctccctcttcaagaaacgcctccatcctgatgtatatcagctttcatatccccatggatattttacaggcattgctacctctttaaacatttatgctattaaaaaaatcagaccaattgttgacataaagctaacatagcagcttctatatagacagaatatgaattttttatgctgttgatgagaagtttatgtcatttatatactatagtagggtagaagatggatttggaatcctgaaaaagctactgtttgtaccattcagaatattagcttgtgctttgaatcgaaatattaagatacctgtattgtcaatgtgagtgtttctgtgcaaagtggcttacatatgggtggaatgggagaaattgctctacctggagaaaatagcaatagttttctttcgtttatgttttgttttgtgaaaggaagggttaatagcatttaatacctgatttatctgtgcttctctgcaccattaaaagaatgaactgttgtggtaataaaaccatatttcattgaattaaaagtgccatcacttgcaagatgcaacattattttatgtacctctaaaaaactacactaacaaactgacatgtcaaactgacatgccattgatgttaagatgcattccaatttcagagatgtaaatatactttaaaatgtatatcttggaatcaatgaaatactgcatatagttcttttgtggtatgtgtatatatgtatgtatacacacacatatatacatatgccacaagagaataaagtatacttctatttggttatagtctataatattttgaatcattttactgagttaggttttacttattttttaaagttgctgttgacatctgtttgataccattcatttaacatggcatgaatttagaatctctacttagaatagtcctttggaagccctagtttgttgagttttcaaaagaaaaaagagtctggtgcaaggaggcagactgacattcaagtcagatcattttttaaaaaaggaaagaaaggagggagggaggaaggaagaaaggaaggaagaggttcatcctgtcagttaggaaccagctatcttacttttcaaagacaaaatcagatcatactagtatatcacaatcccgtagtttatctaattgcatatttataattcttcttggatggtgtctctcatcttggattacctctctcacccaaaatcatattttattttgttttgtcattataaaatttactatatgatcattgcaaaacaaaaacaaaaaattaccagtacatataacaatactggatgtcatatattaagttcacaataaattatggcgatttttccacatcaataccttatcttcatgtttcacatcaatacataatcttaatttttagtgactgcatattatatcattgtatagtaaaacataatttttaaccatttccctattgatggacatttagattggttgcagtttatcactttaatggcatggctgccatgtactttctttttgtcacacttacccagtgatcattttaggatcaattcctagcaatttctggattgctggatcaaaggctctgtcttcatgttattatgtgttgggaagggaccatttcctcatctgttcaccaatacaggatatcagccatctcccaccccaccccatctttacctacttgattggttaaaaaaaaaatctatttttgtttttattagcatttttaaaattgtagttgaggttgaacaccttttcatatgttttggccttttcagagtggttcttgataatagaaagcacagcaggtcagagagcaaaaggtcttaatgaacttccattctgcttcacagaagcctatgaggttttgaggtaactttctcaagttcgttataaagaagatgaaactgatagaaaataactgtgatgtagagatggggtctggcccactttcagctggtctactctccagcactggaaaggaagactgagcatcagaaagccagggaagatccctccagaggtccaggattgttctgaggaatactgaaatcaaaaactctagactccttcctgctttctgagatgcagggatttgacagagaggtcaaaaaagggcccctttcctctgcatgtgcagcttttatttactattgtttcctttttgttgtattgaaatgtcttcattgcttgcctttatggatacaaataaccggatactgtaatttgaaagtagttaacaatgaaactgcatagtatgagccatgctgatttttttttttagtgggcaaatggggtgatttctctatgagcctctctgctgtcagaagctcttaacatttgagtcaacatgggaattatatttggaataaattagtaaattcccattcagcatgcctataccatgtaatcttcaggaaccgtaatgactgtgtagtagagtatatttccaacttggtatttataaaacacatttgctctgagaaacccttcagtatttgttcctcaaggcccagccctcatgctgcctcctttgttagtcagtgtttattttgtaatagttgggacagtgttgtacagtggaaacccatttgtctttggagttagcccagacataaatggactcttaggcctgctatttactagcagtattctcatgtttggaaatcaggagcaatgtaattgttgagacaatttattttaatgagagtaagtcatgcagtaagcatcaatcttagcacatatacatgttgtctttttttgtctccctgaaatcttcttcagctgcttccatgtactgatatcttcttccaaattccttaagagccttcatctgggtcatacattgacatttatttgatacttaatattgatagttatctcttgatgtttgtgtatgtctttgtatccataggatcctccattagcacatgtattcattcatcaaatatttattgagccacttctgtatattaggcatagagtaagatgctggaatatgttaatgaacaggagatgtggtcactgtgccctcctaatgcttacatcccagcaggcaagacctatatgaaacaaagtttgaattactaaatgaaagacatggcagttgctattagcaatgttgtaaggggctgtgaatgtagactagcttgtacatgacatttgagctgatatctattggctgagtaagagttagccaggtagaggtgggagtgataagtctttaggcagagaaagcagcacgttcaaagactctgaaacaggaaaggacttgtttcagtggtgcaatagaggatgagcaaaatgttctcagagaatggagtgcagaaagcaggccttcagagaggtcattggcagcgtaaaaatggggtaagaacggcaaccttgtgcagggtcttgaaggccaggtgtaggttccagtctgtcacctgagagcaacaggaagatactgaagggttaaaggtttacctgtggaagagtatcagtaaaacataaatggatagattctaagtgagtctactttaagctggagtttggagtcgcagggtcctgcgtgtgtaccaccatactctctacacttttaaaactaaaacagaaagtattctaaaacataaaacaaaactggattgtattttcaactgttccttcaactctgaaatactatgattatgctagagtatgagaaattttattttccaaacaaatataaagatgtatttctgatgaaaaacattttcaacctaagctaaaaggaaatctaatgaaaactttaaggatcctttaaaatactaatattgtgtttaaagagaaaatgatacttgtctttaaaatgttttaaaacatttaaaatatgctactgaatataagtgaagagtggtagatcctaaagtagtatttcttagaagagtagaataggttatttccaaaatctttttcatggaattttagtgaaagctaccatagggatcatgttgtccagcctctttgtccttataaaaacatcaatatcttcataaatcaagaaaatgagtcccaaaattggacacatgagctacccattttctaagattttgctgaacggaactttgatcataggggtctctttctaaggcaacgtattagaaactcccagcatcactgtattccttataagaatcatattttttacattaatctccagaatcaaactacaagacaattaagttgttgcttttaccaggttgaaacttgccttgatttactatgaatgttggttgccttgatttcttctactttttgtctcagttctacatgttgttgttcttctggttttgctccttatgagattcgctggatctctgtatctcttcaactgtggtgagtttcatggacagggtcagaacttagggaaatgttgagaatagggtgtggtcctatgatgggtcctcctcttcttacaccttcgactgttgtaccactctttgatgttacaaagatgaatgacttgtggtccttggcccagagtttcatattctggataaattattatttatttgtagtgtacttctatatttttacatgctgtcagaatattagaaatacagtgtttcctgtcagaaatgccagctgagcaaaagccagtaagtcagatactaatgaatggattagcaaattatagggactaatgaaattaaataaagattattcaactaaactagtggctcctcccagtagtttagagcgttgctgaccaccttctttttgtccactcacatattagaattaaaaatgtcaaagtaaaattaaaataacattctcacctacaagaggtagggagaaggaaagtaatatttatctttaatgttattttcagttgtgcatttattatgtatatttttgcataaaataacttgtagtttttgtttggacaagccaatcaaatgagtctttaagatgaagaaggagagcgaacccacaagagatgagtttcgtatgtcttctcaaaaaaaaaaaaaaatttttttttagctcaccaaaaaatgttatgaaatgagaattttgaaaccttacctgtggaaatcacagtggtaatacttatatttcagcccttagatattcccagtggtgttttgatcttagatattcccccaaaggtgttgattagattctggctacagctgaaggaagagaatttttgctttttagctgaatagtaaaacaagcctctaaagatatgaggcatgggggaaaaaaactaaaggcttcttcaaggtggtgtaagggcataatttttgtcatctttattttaagagctctaccaggccagacgcggtgactcacgcctgtaatcccagcactttgggaggccgaggcgagtggatcacgaggtcaggatattgagaccacggtgaaaccccatctctactaaaaatacaaaaaaaattagccaggcatggtggcgggtgcctgtagtcccagctactcaggaggctgaggcaggaaaatggcgtgaacccgggaggcggaggttgcagtgagcccagatcgtgccactgcactccagcctgggcgacagagcaagactccgtctcaaaaaacaaaaaaaaagctttgccaaaggtttccccttagtaaagaatttaatacttgaagtcatcagattagatttcagacttcatttacccgctctatgcatttttttcgtcttcctgggtttggtctgcctgtgcttcttagtctacaggtgtcttttctctgtactgccaacctctaattggagatttattaggtgctcttaagtaagagaggaggaaggccaaaggagacagaaaatggagaagcaagaagaaactgatcaaggcaggagagggaggaactggagaggatggagataaaagatgtataaatgaagacaaatggaagaacaatgagatagagaggcctgaatggtagaaaaattctaaaactgagctagtgagaatgcatataaaataggggtctggtagaagaacttcagcaaaagtggtgtaaatcaatgatgagtaaattaatagggcaattgtgcaaatgggactcactcatttatactaagcgtaatacatcatgaatgatttagagataatgcaacccgtagggcataccttttaatctacccaggacccggtagagaatgctgtcacttcaagagtaaaaaggcagaggatcagaatattgggtgtgtctcttcattctaacagtgttaatgagatagattctgagcaacatgaaaattaaccagactcacaagcttagtttgtgatttatagattgaaaagaagcttaatatattccaaacatcttcctacaaacccaaaatatttaagtgttttgaaagtattcatttgaataggttaacatgtgtgattgccatggatggaaatgaaagtaaaatgagtcactgcacatatgatccaaggaacatctgagtgttaagtgggttgtaactgcataagaatccagtgctattggaagatgcatcagagtattctgagaccagggaataaaattctcttccatgtgctcccttctctttcattcgtgtgcctattcactcaccattcaataggtgtctatcgacagccttctgtgtggaaggtactgaggaatgtcctatgggttgctgcttctacctgaaacagaaacataagatttacatccctcaggccctcttaccagtatttttatgggaggatattgaggaagggaagggagaaagtgaatataagaagtggagagaagtcttggtttatagagctgttagggttccaagtctgctgttctttcttgattcagaaatggaagctcacaaaggttgtgtctggaccaaagacccaagatagttggagtgttgaggattagatgattttgggcttcccttctagttcattcttagaatttattcccagtttttgtgtttatgaaagttagagatacagtcttcaaccattaggagttagaggtgaaaataatagtaattggatgttaccaagtatgtaaacacttgtagggaagggaaatacataaataactaaattctctattaaattctgattctgaaaacttcaaaacagacctaatttagtaagaggggctgcatttttatatgtgatcccacagaatgcttctagacttctgtcactgatggggaaaaatcaaattattcaaagtcttgcaccatataacaaaaaagctaaactaagacgagatttcagggagtatagaaaccagcaatttgtgaaaaatcttgtgtatgaagagtcatgatgtagaacattcaaacaaatggatcacaagagatttctcaaagcatgtcttagaggtgagcaggcaggcatcaattttaaaattctctgttataaatgatcataagcttatgtttttctgtgtaaaggagaaataatttcccaattttataaaacaaattaccaatgatgtaaaaaaaacatttagcacagtattatatcagagggcatttaacattcttttgaatcatttgagattttcatgtttccatttcagagatcagggaagatgtgccttggagaggaagcatgtcttaaatctggaaatgatatgaagagggatgtcagcaacacttcatcctgggccagtaatagggagagtttcttttctctcgtcaaattgcttaaaggattctagttccgtttggtgtggtcactcacatttgaattctaatactctatgtgatatagattctgttgactactgttagcgtgaccccaatgagaaattaaacacttccctccttttca

SEQ ID NO: 1607 - DNA, 581065 bp, Homo sapiens
cgcccagcagcgcctcaagcccgtggtggcggcggggctgtctctttaagcgctccggaggggctggggcgggagggcggcgagcgcgtttccatggcaccggggctgcgggggctgctgggccactgggctcactcggtttcagttgctcccggcggagcaggggcatgcagctcagcggccaccgagcctctggggctcgcccggccgctcctcgcgctcccagacgcctgtgacgcctgttggggccaagctgctgccgttccctccgcagacagacgcgccgcgccagcctcacgagccctgcaccaacttctgcccgacaagcccaacttctgcgccgggttcggacttgcggagccggaacggcgcaccgcgcgcagcccgggcggcggccagggcggatcagcctcgccgagatgtcctcgcgactgtggctctggtgcttctgcctgggcggttgccggctggccgccaggaagcgccctacagctccggctgggcatgtaagtggcgcccgcgcgctccggaacgcttggagagagcagacaacagtatgccccgccccacctcggacctggtgcggacaccgcggcccgagcccgggaagggatggggggcaggaggtggggacagacacctgcgggggctgcgggctgtcccgggcggagcgcggcggaacgcagtccccagctagtccttggggagcgccagcccgggagcggagaccgcgaccggggcgggtgtgctctccacccggtacttcctcagcgcctgacagatttttgtcccccgcccccaggtttgggtgtgtgcgcgcgtggtatgtgtgtgttttcgttatttttctgttttaagagtaattggctaatgactaccactttgtgacagggttgtgaatgaaatcctgtcgaacaccgagtttgacatttttttctttgtagagaccaatgagttcgtgcacatgtattctttctttttttgggggaagtatcgccgagtcggacggagtggtttattccacaggtttgaccagaggcaaatcctggctcgtctgccgaagtgaggagctggggagatgagtatatgaaggattgagtgctcggccacttagctgctagtccccttattagagaactgaagagttagtaggaaggtgactcaaacgcatcgtctcaggatgggcatggtttcattccggattagaaatcatgaaagctaggagataattcttgtcaccgtgtcaaccattagcgaggagctcacgggaagtctaagtctttacaaattgcctagtcctcttgactggctggagaagtttcacctgaattctgtagcctcagcggaatcatcatcgaaccacctgagagagaaaacagatctaattctgcttttcgatttctgctcctgggcggttatgaatagacaccagaatattttgaacatgtaaacatttttgccattttgctcctactctgcttcacctttgcctttctgaaatgtgaatactttattatagaaaaatggcttagataagtacacaaagccatccatagatctctgaggctttactttttcctgtaagaaaaattcgatttcagggttcaaattacatttccatatttcatttctttcatgtgagattcaatcttgacacatggccagggtgtcagtggcatctcagaacttcttgcctacatagtttgtagatatgtatttggcaaaaatgccacgtttctgggtatgtgatttctcttgaattgatgtgtcttgtttattttgaagagaaggttgatttagacttttcttcttcagtttatctcagaaaacacatccgactttggatagcttgtgcatgcgtaagcctgcacttcttagaaactgtcttttagaaagcttgcagagtagccatgctcttacctttacaagtgcctttatttaagtggatcctaggttggctaattagccacgaaatcacccatgcacactgagacagaacagtccctttggagaggaactgagaaataacagaaatacctacatcacttttgaccttgtttggctgttttacctcaggtttcaatattgactcttttgttgaaaaggctggagggatgacactgcatttttttttcttttaaggatactgctactgcagctcatttatttatcaagtgagatgagatcagatattaaaaaatatatgaattcttaagtgtttaatacagatgctttttccaggatgtcattgaggatgttttccaggatgtactttctgaaatcttgatgggaaaaatccaaattttgtagttctccttggtattagacataatggtggtttcttcagcaggaatcgtgttgggatttagtgctaggtttcttcagatgcctttgcaattgttgtaggcatgtgaaatgtagccacatatagatagcacttggcttccgcatacctgcctatctattaaattaaagagaattcttcctgagatttgtattgacctctgatgtccattatcagtgagagcaggcttctaatgaggtgaagaccactaatgagaatgcatcatcttactgactggcacttataggtcattaacacaggtaaaagtttgatgtagctaaacttgtacttgagaaaattttggagctggggtgacaagtgaaaataagaaacaactgtgcagctaaccagcagtcattgtgtttatggtgtattcctctgaaggtaagctcatttccaaagaaattttttttaagaaagcaaaagatgaaatatgaatattccaactctaatgataattgatctgtctgatgaccttgtcttaccacatttaggaaatcttgaataactaatattaggcagattcataaaatcagcatttggaagagtgcctaagtacctattacgtacagaggcattagaaatcacaggcaacaattaatccgtttgaattcttacatgccaggcaaatttctagctactttacatgtattatttcatttaatcctggaaatgccctatgaggtaggcacattatcataccattttatgacaaagaaagagacacagtaaggttaagttacattccagaaattcagaagatctgggcctaggcagttggattccagagctgaagttcttaacacatgcagtccatttaagaacgctcaggcccagcctctgtttttaagaagttctttttaatcacttcaatgcgttttcagtgggagtagagctggtaccttctacctagtggttgagatacctgtgccaccttttttgattgttgccatagttatatggttctgttggcattctgtggtgggtatggagagaggttggcatgctaattgtgctgctatgggtaggatagttcctcacaaggaagatctgatttatctcctccttattgagactcttcataggaaattatcctcctctctcatggctgtaagtacttgagtattaaaatgagggggtaggtttaaactggatattatacagtgggagtagttatctgaggcaagtgcattaaaaattagagagttgtaactggtaacggcattttgataaagggatattgaagagtttacttatgttaatggtattctgcaaatgttttctgaaggattaaataggaggaaataaactctactctggatctttgagacatcaaaggaaaatgattggctgtaatgcactctattaaaatttatcttttgtaatgtactcttgtaaacacttgcataattattttatgcatcctaatgaaaagtagtaaacatgggagtgttgcagatatcatagcaggcataaatgaataaaggaagatgaagtagcttaagctcctgggacatgtgatacttggatttctctgatatctggtgggaatttttaaacaacatggccactttgtgactcagcagtagtctaaactgtgtaggacatttcacttccatcccctaagatagtacaggcagttttgacatacagatcccaagtatggctgatatgaaactgtctacccctctcccatgacacacatacatagaactatgtttcacctcttagttacaggcttaatacaggcttctgtagttaatgtggaaacttagggtcagtcagagagagagtgacagtgacttagattttatgaagaaccaatggatttggaaatagagccagtcaataatctatgataataatttggaatagtgaaggagagatgacagagttgtctgttgtcccccacacatgctggaatttgtttctttttattattattatttaaacttttgatattatacagcctgaaattgagctgtcttagttcgttcgggctggtgtaacaaaataccataaactaggtgggttttaaacaacaaacatttatttcttatggttctggtgattgagaaatccaagatttctcagaatcttggattttcatagatctgatgtcttgtagaacctgtttactggttcacagatataggtttgtcctcaggtggtgcaaggggtaaaggagctcccttgggcatacattaatttcagtcatgagggctctaccctcgtgatgtaatcacttctcaaaggccacatttcctactaccatcacattgggagttagggtttcagcacaggaatttcaggaggaaacaaacattcagaccatatcatgagtgaactagagatatgtggggctaataataatcccttatttatttacttacttacttagttgcttttgaaacagagtctcactctgtcagccaggctggagtacagtggtgtgatctgggctcacagcaacctctgcctcctgggttcaagcgattctcatgcctcagcctcttgagtagctgagactacaggcacatgccaaccacattcagctattttttgtatttttagtagagacagggtttacatgttggtcaggctggtcttgaattcctgacctcaagtgatccgcccacctcagcctcccaaagtgctgggattacaggcatgagccaccacaccaggccaataatccccttaaacttagaaataatttaaacatagtctgggtttactcattaatttaaattaattggaaaagagtttttttcttttgaggtcaggcacattaaatgagcagaaaatgaatttgagaagagaaggctgtgtgcattctctatgggtaaaacattttttagcagtttgtatattaatatcttcaatcctaacaacaatcatatgaggtagataacaccatcatctttttcagatgaggtcactgaggcacagagaggtgtattagtccattttcacactactgtagagaactacctgagactgggtaatgtataaaggaaagaggtttaattgactcaaagttctgcatggctggggtgacctcaggaaacttacaatcatggcagaaggtgaaggggaagaaaggcatgtcttacatggtgtcaggagagagagagagagagaacaaggcgggaactgccaaacacttaaattatcagatctcatgagaactcactcactatcatgagaacagcatggaggaaactgctcccatgatctaatcacgtcccaccaggtccatccctcaacacatggggatgacaatttgagatgagatttgggtggggacataaagccaaactgtataattctgcccctgttccctcacaaatctcatgtccttcttacatttcaaaacataatcttgctttcccaacagtccctcaaaatctaaactcactccaacattaattcagaagtccaagtttaaagtctcacctgacacaaggcagttccttccacatatgagcctgtaaagtcaaaggcaagttagttacttccaagatacagtgggggtgtaggcattgggtaaatgttcccatttcaaatgggagaagttggccaaaacaaaggattacaggcctcatgcatatccaaaacccaaaaaagcagttgttaaattttaaagctccaaaatcatctcctttaactccatgtctcatatccagagcatgctgacacaagagatgggctcccaaggccttgggcagctctgcctctgtggctctgcagggtgcagcccctgtggctgctttcatgggctggtgtgagtgcctgcagtctttccaggtgcatggtgcatgctgttggtgatgcaccattctagggtctggaggacagtggccctcttctcaaagctccactaagcagtgccccagtagggactctgtgtgggggcaccaaccccacattttccctcttgactcccctaatggaggttctccatgagggctgtgcccctgtagcagacttctgcctggacatccaagtgtttccatacatcctctgaaatccaggcagaggttcccaaacatcaactcttctgtgcaccctcaggcccaacaccatgtggaagcttccaaggcttggggcttgcattctctaaaaccatggcacaagctgtaccttggtcccttttacccatggctggagcaggagtggctgggactcagagctctgtgtctcaaggatgcacagagcagcagggccctggtcctggcccaggaaaccattcttccctccttgacctctgggcctgtgataggaggggctgccataaacatctctgcaatgccctggagacattttctgcttcactttacttatgcaaatttctgcagccacagcttgaatttctccctagaaaatgggtttctctgttctacttgtggttggtctgcagattttccaaatttatatgctgtggttcccttttaaacataagttctgatttcagatcatctctttgtgaatgcatatgactgtaagcttttagaaaaagccaggttatatcttgaacactttgctgcttagaaatttcttctgccagataccttaaatcatctctctcaagttcaaagttccacagatatctagggcaagggcaaaatgccccagagatttgagcatttttgctaaagcatagcaagctaaagcatagcaagagtgacctgtgctccagttcccaataagttcctcatctccatctgagaccacctcagcctggacttcattgtccatatcactatcagcattttggataagaccattcaacaagtctctaggaagtttcaaactttcccagattttcctgtcttcttctgagccctccaaactattctaagctctgcctgttactcagttccaaagttgcttccgcattttcaggctatttttatagcagtaccccactatcctggtaccagttttctgtattcgtctgttttcacattgctgtaaagaatgacctgagactgggtgatttataaaggagagaggtttaattgactcacagttctgtatggctggggagacctcaggaaacttacaatcatggcagaaagtgaaggggaaccaaggcacatcttacatggtggcaggagagagagagcaagtagaaaactgtcaaacactttaaaaccatcagatctcatgagaactctcactgtcatgagaacagcatggaggaacaaccctcatgatctagtcacctcccaccaagtccctctctcgacacatgtggattacaatttgagatgagatttgggtggagacacacagccaaaccatatcaagaggttaggcaactatcatgaagtttcatagctgagaagtggtagaatggggtatagacccatcctgtctagctccagagctctgttcataatcaccatactccgtgctgttccctttacctttggcttttccttcatatgctctcaaactatgagactctgatctttttactcagtctggatctgtttacctaaattcagcagtagctgctcttgctcctattctccccaagtagattcaaacctttgccctttagttttagtagtcaattccagttcatactttattgatgatattgacattttattatatggattttctcagtgtccctgtcctcagttttaatattatttacatatgtttacttttcttctttcttctgtgtttcatagaaatacatttaccactcttgtttcaaggtaatccctccctgtatgttccagatcccatttaaaaaatattttctctgtcatttctttttttatcattcattcccatctctttccattctactgttttttctctttttccaatcatattcaagtcttgcattctacatctgtctctactgtatgtctataagatgttttgtctatatacaggtctgtgttgactttgcttcttctctccttcaccttccattgctgaaaaacagctcattaatgctgcttcctttgtttttttctaatcatcagtcatttaacccattgcactgtggcctcctctgctgaatgtccttttcagaggctaccctcttttcagaatttgcctaacccttatttttctgtagcatgtgacattactaattcctattttctactttttttacatctcgtacttttcctttgtacatgtagtatcatctgtagttctcctcctccattggtgcctgcattctccccttctatctttatttctctttccattctttatacattaactggtttatctcttcccactggcttccatcatatgtgctatttttatgagacccagatctgtacatccagccccagtctctttggagctatagacttgcattttcaactatagatttatcatctccatggatttcagactcaaaatgttcttagatcatctctagtcattattgtctccttctatatcttcttctcaggtactttgtctgtcttctcctttgtcttatttgaattttttttaaatctctgttacttgtctcccagtttacattgttgttttattatgagctttaggtaagatggttgtgaaaaggcttttgtttatggcaattcgataaatataagttaatatttatattcctatcagttgccaaattctgtcaacacctacaacaaaatatctgttgaattagttcctattcctgatgccaacacttaagcctgttatgctatttttactcctaggctactacagttatctctttgttgatcttctctttcatatcctctcaatcctctttattttattatatatactacttagtttttatctagattggtttttaaagcaaagatctagtgacatcatttcctttcttaagaactctgattatccatgaaatcagctcagggattcataatattgttcttaaatagcacttattatgtgccaggaataatttaagtactttgcatattttaactcatttaattcttacagcaaccctatcagaaggtaatgtttgtatcaacatttatgatgaagaaattgaagtccagggaagttaaggttttctggagaaactacatataacagtatgaagctcaggggagaggtcatgtaattaataagtaataaagctagggtataaacccaggctgtctgactctagaatctgagcacttaattaccacactgtattcaaggccttatctttttggtattatttaattttataaacatttattgagtacatagttatttttatttattatttatttattttttgctttttgtttttttaaatttgcctgtagtccccttctgctactcaagatctgtgatgcgtctaagattttactttaccttcaagataatgagttagtctgccacagttcatagttgctgctagaagacatgagattcctgggcaaagacaaatgactttattagttccttagtctgtagcaggcagcatgagcttcatgtttgcatcagttatcttgcccttgcctccttgctaagttccatgaaggcaatgaggagtggctccaatggatactgtgcataccatgagtttgtgtcacagatagggaacctggagcttagacaaccttcagtcttctaaggggactgctagcaaacctgccaacccttgccgttagagggagaatgaactttattatcttgctcaggaagcaactctgccctcagttctggcagaagacactctcttcatcttccaagattgttttttatagaaacatccttccagaaaaaagctgtcaaggctttttcacaagcagaaatgcaagagaccttgaagaattgtctcccaacatccctaacatgttgctttcccattttagtagcataggttttgctatggcttaaatctagtattttttctcttttgttgaatccagtgcttgattttcccattcttttaaaatagataggaacatattaaaactagacgaacacaaaggtttaatgagcttacttaaggggctgtgttcaaattccaagcacttgtcttttctccactgatgctgaaatcaaattactaacccagttgctgaatatgtagttgatttcttttctttttatttccatttagcaaagatttattcattgtcaagtactttgctaggcattggggatacagaaggaagtaaggtgattcctttctttaagcaactcatagatcaggagggagatcagcacacagactagagcctaccaatacaaaattggcagagatggtacatgtaacccaactataagaagaaagaatacaggacctcagggtaggttttcaagttattgactctgagtagaggttggatgagtggtaaagatggtgatggtggtggtcgtttccagttggtgaaaagaatatgtgcaagaaggcagcaagatctccccattaggaaaaccataaatcatgttcttaacagtatgactggggagaataatctgtatgaggctacagtaaaagataagtttagggctgttgagtccagagagaagcggtgtgagtctaataaccaaaagaaatagtggtggtaataaaacaagggaacagatctgaaagataaatagcaataggagttgatgaatgcatggaggtaagagagaaagacagacttgatggggcctctgggtaatggagaatatcagaaacacaagagaaaggagccttatgggagaagaagatgatgaattcagcagtgactgactatgtgggcatttctgtgtctgtgggatctcagctggagacgttctagagaaatccactaaaggggcctgaggctcaggaaggtgatctgggctggagctatatttggctgttgaagtggtaggaaacaagtgtatataaaaaagtgaggaaaaaagattattgaggaaggaaacctggatattttaatataagaacagaggacagatgaaaaagggcctaaggaggaagttaagaaactgcctgagaggaaggaaagaaagagtggtatatgctatggaaggcctcagggaagttaaataaagtagaaacttgtatagttaaaagtgtcactactaaaaaatgattgacttagagctacataaatagaacatcactggaagaacatcattctagttgagaacttcgctgtcatagccatcacttttggtcatgatgacaagaagtggaaactcctgtggagtgctcttatattgacaggctgtgtttttgcctggctaaacatttactctgtatctgccatcattctgagctcattattactatggccagaaatgactgtagaaagaaagtcctgctactccagcagaattaattacagatggggcacaattcaggatcaattcacaatcatcaaggcatttttctaggttcttctgtagaggtgggtaagatagagtctccacccccagggagcttataagcaagtattatgttctttgttgataggatagtcaagtaccttaaaggagttaaaactcaagtagtactttaagaaaggagaaaataaatttgtgagaggaaatcatgggaagctttctggaagtggtggcatttgtaggcaaggtaggattggggtcagaagtgcattcattgtaggaagagagcagagcgtgcaaggccttggaggttgttggaagggcagtgtctcctggggccaatatacactgtggcatcttttgtcaccatcattggctccatgcatttgcagctctttcctctccaaatacctagcgtccccaaatgcccttcacatttttctgccatggtgcctttcctctcagcaaactccctgccttctcttctcttccaggccaatctctaaggcccagcacaaaagtcacctatttcacaaatacttccaggtccctcagataggattaattacatgtttgtctgtttcagcaatcttaactgatatttttgtctgacataggtatctggagatctatagtttcttttaaaaaatctatttgtgataaccatgtgataacagcgaaaacgtgtttggaattagtaaaggcacttccagacgattctgttaaatcaactccttgtagtatataaattatgtggcttgtcaactgatgatctggaaaatgttttctgtcattcttcagtggacagttttcagtggtgtttaatgttcctcctcactgatatggttaattaagaattgacagtaattctgagctttagtgagttttactcttgagagaagaagcaatcccaggagacttgaggttttgtttctctgaattattatgaaaactattttcatgagtgaatgtagtggatgccaagcaagagaaagtaactgaattttgaatagtttttcctttctgaagggcaaaatactaatattaagttgccgaacctgcagatttttgttatgctgtgaaggcttttgttataaacaaaagtatatgtggggatctaatgtacggcatagtctgtagttagcaatactgtattgtgtacttgaaatttgctaagagagatcttaaatgttctcaccatgggggaagagaggtaactaggtgagatgatagatgtgccaactaacttgattgtggtaatcatttgacaatgcagtgtacatgtatatcagatcatcatgttatacaccttaaatttgtgcagttttatttgtcaatcatacctcaataaagctggagaaaagaacatgataataaaataagtcaaattatattgcttatttattatgaagtttaaataaaatttgctgttccagcttacaaagtccaaaagataagaaaaaaattctcagcatgaataaactgggaatgtatcttcacatcaaaaattcatttttcaatgcatttaatggtttactcatgctgagaactacttcttatcttttgaacttttgaaccctgtatgtatggagatgagcaaaaatgtatatgagtttcttttaaatgtactggaataccacatgtaaaacaaaacaagtagaaaactcaagacccagcaatacacattgatcaattatgtgataacataataatatttgtactgggctttaggcatgttatatgcaatactgaaatgaattttgctatgagaaatatcataggcatcagccattgaaaggtatgcctaacatcttttgtaaagcaaatcttgcttgaatttaactaacagtcacaagtctgggccagtaagcaacacagtcagtgtcccctccacccttcataaatctatttgcagtagaaatctcattaacattttaattgttttgtatctaaagttgctctcagtgccacatttaaagggctcaggctcattaaaatttaaggaccagagagctcatagtctactctaatgacctagtgatggttgtaaaggctctaaatattttttggttctttgaataactgaggaattccttgtagtggctaagtatgcctgaagataggttgttgcattgcccaatttcaatcccatcagaaagctctctccctcttttccctcatctaaatcctagggtctcttaaagtccctttcaacattttctgtcaacttttatttcattgcccacattatttctttagctagattctaatttaattgagggaaaagaattaaaatttgtcactgagaatctaccttctgtttgtgtttctccactccccacactgacccccgtcccattaaaaaactatctatcccaaacttaaattaattgtaagcattagaagttcttattctggctttgctacacgttagctaatgagactacaacacaccttctggactcagtgttctcatttgtctgctaaaactttggtatatgtttcatgacattgtttttgttctaaaatacatgtcttcaaggattaattagccttacttacagtctgtttccaatactactgttatatacagttattaacatttatcatttaaatgtagaggattgtcaacccaacgtaacagtcttttgttttgctccagttttggttaagcccgtcctggtaagaggtgattaaataatattttttctttgaagactatttctggttgataataatgacaccctatcattatacccaaatattatcaagaaaatatttaattttctatgagaaaacagagaaagaagtaaaaactaacatcaaattggcctgaaggtttataccatcaaagtgtattgaaaaccagaaagacccaagattattgcactagaaattgttatggggagagggtaaatgatctacttttaatcctgggatgtgacagtgataataggatgcagattatacaaaaacagtaataactgggagtatgcattcacttaccctttttaaaatcatgtgttttctatacacttataaacatgcagcatgaggtaaaatatgtttctgtggttgtcagtttctggaaatgcctcttatgggttttgcccataacgtatgttccgtttaaaggctctactttgccttaaaaaatgcggctttggctgggcacggtgactcatgcctgtaatcccagcactttgggaggccgagggggtgcagatcacctgaggttgggagtttgagaccagcctgaccaacatggagaaaccccatctctactaaaaatacaaaaaattagctgggcatggtgacgcatgcctgtaatcccaactacttgggaagctgaggtaggagaatcgcttgaatctgggaggcagaggtttcagtgagtgagattgtgccattgtactccagcctgggcaacaagagcaaaactctgtctggaaaaaaaaaaaagtggctttggcctcatggccagaagattttggatggggatagaaaataatcagagcagatttgaaggtaccttacaccaagacggtcattttacaggctacatctgccctagaggcccctgaaatcctttttgttttaggggacacatgcttcagtttcaccatctttaatttttttaattgtataaaaaaagacataaaatttaccattgtaaccgctgaaaaatgtacagttcattaatgttaactatttgtattggcgtgtagcagatcttgagaactttttctcttgcaaaactgaaactctatagcccttgagcaactccctatcttcccctctcccagccccttgcaaccaccattctagtttctaactgagtttaactattttagataccacatcttagtggaatcatatagatttgtctttattattactggcttatttcacttagcatgatgtccacaaggttcatcattgttgtttcatgtggtaagatttccttattttttgaatttttttcaacgtttaggttcaggggtacatgtgcaggtttgttataaaggtatactgtgtgtcatgggggtttggtatacagataattttgtcccctgggtccttcttttttaaggctggataatatttcattgaatgtaaatactacattttctgtatctattcattcactgatggacatttgggttgcttactactcttggctattggtgtgcaaatatctcttccagatcctatactttaaatttttttttaattcctctggatatatacccagaagttggattatgggatcatatggtagttctatttttaatttaaaggaacttccatactgtttaccatagtagctgtaccatttcatattctcacagcaatgcacaaagattccaattactccacatccttgcaaacatttgttatttctaaatttttttaattgatgaataaaaattgtgtatgtctatggtgtataacatgatattttgaaatatgtacacattgtggaaaagctaaatcaagccaattaacatatgcattatcttaaatacttatcagttttttgttcaccagatttttgtctttcggttttcataaaagttatttctatttccagtgatgttttatctacgtgacatcagcatacaagctacactttttctttcttagattattttattctacttaaatttatatagtagactgatttacctgacagtatgtgttcaaataaaaaataatttcataatcccttatccataattttgaaatccaaaagctccaaacactggcaggtactttttattgttatttgttgcacaaactaatttggttgcaaaatctacagtgatctggtatgagtttaattgtagaccttatttatatttaatatgaaaattgttaggattccctgaaaaaatattaatgagtttgattagcgtgtgactctccagacacttctggacatatatgtatcatattgcctctctaagatctgaaaaattctgaatgccaaacaatttggccccagggatttagataattctaatctgtgtttgtcaatataatatttgaataatatactgctctttaaacagtaatttagatttttaagagtttgctactttgaacagaattcttttataaaatgagaaatcacttttttttgagacagggtcttgctctgtcacccagactggagtgcagtggcacaatcacggctcactgaaggcttgatgtcctgggctcaagcaatcctcccacctcagccttccgaatagctgggaccacaggtgcacactaccatgcccggctaatttttgtatttcttttttgtagagacagagttttgccatgctgcccaggctggtcttgaactcctgcgctcaagcgatctgcctgcctcggcctccctgagtgctgggattgcaggtgtgagccactgcgcctggcagataaactagttttaagcaaagaagcacctacctgtttttgtttgtttaaattctggatgttgattggtataaagcaagggaggttcagctttatgtgttcttaaaaaaaaaaagagatttatcataatattgatgaatgtctttgaaatttcaatattttataacataccttgtcaaaagcataattaaaagaaaaataaattgtctttcatcattaaaagacgttaacatcttacaccagtcaggatggcttttattacaaagtttaaaagcaacaggtgatggcaaggatgtggaaaaaagagaacacatacaacaatttacattgttggtgagaatgtaaattagtacaacctttatgtaaaacaatatagagatgtcttaaaagaactaaaaataaaactaccattcaatctagcagtctggctactgggtatatacacaaagagaaatcattataaaataccacctgcccttttatgattatcacagcactgttcatgatagcaaagtaatagaaccaacataagcgtccatcaatggatacttgagtaaaatgtgattgaaatatatatatatatttattatatacacacatatatatgtatgtgtacaccgtggaatactactcagacataaaaaagaatcaaaatcatgtctgttgcaggagcatggatggaataactcagaaacagaaattgaaacaccacatgttttcacttacaagtgggagctaaacaaaaggtaaacattcacatagaactggaggccattatcctaagtgaataactcagaaacagaaattgaaataccacatgttttcacttgtaagtgggagctaaacaaaaggtaaacattgacatagagagtagaataatagacactggagactacaaaaggtgagagggtgggtggtgggtgagagttgaaaaattatctgttgggtacaatgttcactcttccagtgatggatacactgacagccccgtctccaccactatttaaatatatgcatgtaagaaatctgtacttgtctctccctaagtcaataaaaagaaaaataaagttcctattttaatgataagaaaataaaaattagatgattcattaagtgtaatgcataaaaacaagttctgttgtcattctattaagccctgtataaaagccctgtataagcttctgtataaaataaacagagccagttgacatctattggatctcgatgccaggcagcattacaaggactgtctatattattgcatttattttatctgaacaacaaagactgtgcaattgtactatgcctctgatattgaaatgttattatttagggatagagataaagcaaaaaataccatgtgctataatttagatatttatttaatccaattgcattttatttgcagtgggaataagcctttattagtcccactcttcgttacttcttatgatgtctacctccagagagtgtgctaatcttttgaagtgtaaaatggtctgattatggttagtcagctggagagtgaagtctctttatttattttttttttgagacagagtctccctctgtcacccaggctggagtgcaatggcacgatcttggctcactgcaacctccacctctcaggttcaagcaattctactgcctcagcctcctgagtagctgggattataggcatgcaccaccatgcctggctaattttttgtatttttagtagagatggggtttcaccatgttagccaggatggtctcgaactcctgacctcgtgatctgcccacctcagcctcccaaagtgctgggattacaggcgtgagccaccgtgcctggccgagagtgaagtctttcactctcttctgcttcacaaactttcctgttttattttttcgataaattttattctatttttcttttgaagtccctattttgaccctaataagctgttatacttttactttagattgcatttgtgatagctctctatatatttagattgataaattattaggttccaagaaaagtcaactgaagtgcctagctcactctcctttagtttttgtatttcatattaaatatgcttataatattctcttttgtatgtgaaatctgcatgatcacacgttgcattattaatagcctcgccgaggctttgcttcttgctgttactacttctattatctcagtgtttaagctcttcatctaatgacataggtggaacatttatgtttctctcatgactttctagtgtagagaaagaggcctgttctgaaggaaatagagcccttcttacggtggggtggagtcctttgatagggagttttggtccctgtggagacagatacttcaagagtcgtaagggactgggaataaaagttaattctaaagaaccccagaaactcagggaaggcatctttgcatctgacagactggccaataattgaactggaagaagaggtaaatattctcacaaaggagaaggattacacatggggaggattgtaagtgagtctccctgcctctattcagtctggcaacaagagatagtagggcttttgacctacagacaaattaaatgccacctgtcaaaaaagtgagctttatggctcagtctttgcaattgtgtgagatggaaaacacatttgtgaggaagcagctaggaatggaaagcctgaattaaaatgaattattgcttgaaggacagataaatgcctgttctgattgaacctgaggctagcagtgaatccactgcaccaacgtatcatcactgtctgtttcactgagtacatcatttgcctacgaaataaacttgttttcttttgaaaaacatctttaaaatttctgtgtgtgagcaacaacaacaaaatttggacatagcctaaatattcaagaatgaggaaacatctaggtaaattatggtatagccttacaatggaacatttatgcagctttttaaaacgatgcttacgaagaattttaatgccctataaaatgcttatattataataagtcaaaaaagaggcaggatacaaatgcctataacagcatgattttatatataaatgtataaatataaagacaataagcacaaaaggaaggaaatgtatcaaaatatcttaataatgtttatctcctggtggtgagttatgtataatttttattctctcatctacagttatgtttttgctaacttttctgtaatgaacatctattacttttttcttagaaaaaatactttgaaaaaagttgttaacctgtaatgtgttattgacaaatgccacttgaagacaactttgtaagacctcttttgagccaccagtgcaactaagctttatttcccctaagaaccattatggttcatttgtatttcagtaaaatgtttcattgtatacttctatccgggccactattatttagtattccagtgatggtgaaataaaagataaaacatttcctatgtttaaagatttctgatcagataagaagacctctttctaccacatggtttccaatcttgtaaccttgctccaaattaacagacataagcgtattcaaaacaagtagatcataagcgtggcttcttcagatttatagttagtggttcagagctgtagtcttatgtcatgtttctccttgtatatgtagcatccactcaaaattattttctcagataatttactgggtattagttgaactgtaaattgctaaaaactttaacacatttatcatctggtttttctactcctaagggtaagattatcctgacttggctttctaggtgactcttctgtaaccagttgcttacatataaaaatactttgcttacctagaactcagttatctgacaacctttatacagttggctctttgtatctgtggactctacatcccatgaatataaccaactgcagatgagaaataatcagaaaggaaacccaattaaaaaaacaataaaatttaaaaactacagaataacaagtgtttacatagcatttacattgttttatgtattataagtaatctaaagatgatttagaggacacaggaggatgtacctatgttgtatgcaaatattgcaccattttgtataggggactgaaacatttgcagatttcggtatccatgggagtcatggaaccagttccctgggatgccaagggatgactatgtctgagaaataactgagaagcaataagtaaaccataataacaacataagtaacaacagctaccacttactgggtacttgctatgtttttttaattctgagtactgtcctcattatctcatttaatcattataaccctctgcaatggttattgctctccttatttatagaggagaaaactgaggcttataaaaattgaatcacttgtccaaggtcacagtgctcattattgtgaagctaggagctgaaccatattccaaagtccaaatatactcataactattaccataaataaaaattgaaaacagatgtcacagtgtctgtattctacaaatgcttaacattacacttcaagatcccaagaaaggatcactctattttacaaaatgaattcagccaatttacaaatacaatatttgaaaaagggaaaagagggcttctagaagtaggaattgataacgaaaaagaaggtatggctgtaaactgatagaggggcttagagaatatattcccaagaaatctgaaagcataatattctggattggttcactaaaaacatcttttacactgtatagtttctaactttatcaatataataaatatggagcttcatcatggtagatttatcttgtcaataaaatattaaaatgaatatagtcttaattttaaaaacatttttataacaatttatacattttattttagaatgattagagaatataggtcagataaaataacaaaataaaaaaatctcataattttacagccagagatattaactgttaacattttagaagaactacataatataaatacaaatgtaaacataaatgtatacgtttacgttttaacaaaatagggccatggtttacttttaaaaaattaccttcagttacaatctgtgtgcacatttaaaaagattatttgattatcaaggtagagaagtatataacatacttaagactgattttcttccagtaagtataacaacatgcacacacattaatctgctgctttaaggcaaaatacatattaatccagaaaattattttatgtgaatcagctcattgatgctacatcaatgaggcactactgtactttggctatctttatgccatgtaactttcattattcttctctatacatttgaaagaaaacttgattttttaaaggagaaagaatcaataatgagcgggaaagtttaagggtgttttgaaaggaaaagtgtacctatactctatattccctggctggagctgatgtgatttaaagccatctgtttctttcacttgaaatgcagttagctttgtattcatcagcctacttaattcaggagaaagggagggccaacttccaaaagctgagtttttatttgctatgtcagtttacaaagatttattgagcacctttttgtgtgggtcttgtattagatagttatttactgcaaagacgtgtaagatgtgctctctgtactcaaaaaaagtccagtcaattgatctaaaaaatataaatagttaattacaattcagcatggtgggtacaaagagtgaagtgaggtttaggggctataggagcacatgggaagtaagaaaagctatctggctgtagagattccaaagtggacatgtagagagaaagtgggtggctaaggaaaggggggtgatgcagtatgtttcagatagaggagctgcatgtacaaaggttcaggggttagacaatgagcatgctgtgtttagtgtcatggagattagggtaggaagtggaaaaagggctgacaagcaagtattcagggcctatcaaggaggcatcctgtgtcatgctgaggaattgggattttatccttaagcaaagatgagtcattcattggaaatactgtcagagaagccatgaatagaataactatggttcagagaaatcagtctagtgctatgtgaagaggccctaagttgtacggagacaagatcaggatctgagctaaagtattaaagaggaagaagttgatctggtgaacttgctgattgttggatgtgggaggtaagagagtgggtgaggaaacatgacatcattatctctgggttaggttactgggtgcatggtaatgtcttctgcaaatgaagaagtttccaaagaaaagaagattgagaggatatttcaaagatgatgaatttattctgtatgtgttcagttggatatgtagaacttgagcttaacgaaagcagtgactagaacaatagatttgggaggtatctgaatatacaagtatgaaaaccagagaagggagtaagaacccccaggtaatatctgtggattcagagggacccttgaggaccaccatcattttaagactcagtatagaatagtagtgaagcaatgggctctgctgtctggattcaaatcctagttatacctcttattaggtcatgctatcaattctctctgtccttcagtttcctcatctgtaacatggagatgacacatattttagtcataggctagttgtgaaccaaatgagttaatatcttaaagtatatattataggactggcctgtagtaaaagttaaacagatttagcttagctttactgtattatttaaacgattacggtaaatttggccaaataaataaagaaacagtgaagaatacagaataagtgttgtcaaagggttagaggaggacaactatgaggagcgtcataaaagccaagtcagaatttggaaagtgagctgtattgaatgttgaaggaagggaaagacaagcaagagataaaatgtatcttttctttttttgttaggagagtttgctggtcaccttggtaggatgggtccagggtccggatacagtggtctgataattggtggttataaagtatgagtgaatctgaggtattttatgtaagtgaggaaagaaccagcacagggaagggaaccaggcaatgaattgaaagaacccttcatgtatgcatcaaatatcctcagtatatcctgtctgacagtggaccatgaactgaataaactctccaggaactatactctgagactgtatacagagaaaggtggccattactcttccatccttttgttctggctgaccttgaaaagaaggtaggagaggaaccctacttctttgtgcctgagatcctctgagaagtgtattggtctgtgttaaatttggtaggatccctgggtgagagacagcacatgatgttgacatgaagtatctgaagtcatctcagtccacttctcagtccacatctcagtccacagcaggtcaaaccacagttcagggacccttctgagtaagggaaaccccctacaggtaggctcttactctgcagtcatgctgactgagctattctctgtgctgcttctggcaacaactttcattttggcaacaactttcatttggatgctttctctttcaaaggcagaatagtatattggaaggattatgaagctagatcacggaaaatttgtttcagtttccttcattcatttttcaaaaatatgctttgagcacctactatgtacgagacaatataccactggctgaagttggaattatagtggggtcaggacaggtagggcacttgtcagaaagagcttgcatgacagtgagagagataagctattttttaaaaaaggaaccattctctgaaagggagaatacaggtctacaactttgtccagtgaggtcagagcatcttcttgggggcaaaagtgatggcaaagctgggaactggaaggtaggttgagattggccatgtgcaggggacaggggagaagagttctctaaggagaggaaacagcatgggtgaaggctttggggttatgaaagaacctggtactttctaggacctaaaagaagtttgaatgggctggaatatcggggtgctgtccttttggctggctaaatgatactgggcatcaatgaatttgatattctgtctcattctccttaaggccagaagtgggcagaaggattcccttgttgtaggctgttgttcttagaatgcagagatagaagaaagatacgaaagaaatcactctgaggaccataagtagggtggattggggctcagggaaggcaagagagaaactagaatcaaggagatatgttgaaatgctaccagttgatgagattgcagtgctggaaatgggaacagagaaaggagttggctggaagaagaaacaagtttggtaaagaacaggaggtgctggcatgcacaattactggtaattcctggaaggtagttcatttgagagggaccaccatgaaatgatgaagattaacaatttttaaagagaaattttagagagcatagagcagcagacaggagctggaaagccaatgaagagagttaaaaatggaactgtactagaaagaagaatttcatgaatttgtgtcaaggaattttagaagacagcatttcaaaaaaatagatttaactctaacttagatttaactctaagtttctctttgataaatgctttaaaaaatctagttaattaggcaaattatagacttaacagttaaaaactcagaagtctcagtctgtgactggtcaaagcatacctgttaagttgtggatgctgctttttcagcagttttagagctgatgtagtctgtttcatttttgttgctagtttatgaatattacagttttttagagtttctaatattctttttggagtcatacagaagggaacagagaaaggagttggctggaagaaagaacaagtttagtaaagaacaggaggggctggcatgcacaattactggtaattcctggaaggtagttcatttgagaacgttcttaatagagttcttcctgaggaaaatcaggggagacttgattcttatgtgaaggtttttttttttttttttttttcaactatgtgaagtgaaagtatggaaatttaactctattgatgtgtgtttgaattctgaaagagatgaaggggtgctgtgaaaatgcactgcactgtgttaggaaatgggattgccccaaagagcatggccaatgcctgggacaattgcattcttgactcaccctcgtgaagagctaaggcccagctgggcaatcacaggcgctgggtggaggcttccccggtggcacccctctgtgctctgcactcttcttagaatttaacatttccttagcaactggatagggtgcataggttagcattaatactgtgaaagagaagaaacttggggcctttaaaagaatgccatcttgggttactatgctttcattttggttttatttttctcagtggtcaaaaactattgtttccagccagaatatcctttttatgtccttcaaaacactaatttttggttgctatgggaactggcttatcaaattttaaaaatttgtgtatttcagatccctggaaaacgtgtgtgtgtgtgtgtgtgtgtgtgtgtgtgtgtgtgtgtgtgtgtatgtaaagaaagaatcagatattattaaaatgaaacatatacctttgttaggtgaattgtggagtgtgtgaggtaacacttcattccaaacccatgagctctaccttaaaaaggtatccagactttgacactacttggcagctttactgtagtaaccttgttccaagccatctttatttcctacctggggttattggacggttccttaactggcccccctggtttctcttgtaccgtttccctaccctggctctgaagcgattctgttaaagtgtaagtcagattacgtcagcctcttttcaaaaccccctatcagctgccacttcactcagagtaaaaaccagtgtcttcaccatggcctgcaggccctatttggtcaagtccccatcctatccccaactgatctctctgaactcctctctgaccactctctggcaggttcagcctactgaagtcacactcagctcctcgcaaggaattctcctgcttcaggactctggagtttccttttccttcctccctaattagaatgcttttcctctagacagatatatggcccactctcttaccttgttcaggtctatactcaattgtcactttatcagtaaagcttttaattctccaagatcttggccctccctttcctcttctctagtcagtttttctacaacacttaacagtgatctcactagtgtatattttgctgatttatttatttattgtccatttcctgcatttggatgtaagcttcatgaaggcaggacgttttgtccattttgttcactgatgcatctgcagcatttagtacctagcatgttgtagttgctaataaatacatatggaataaatgaatgaatttaatattgctatattgctttgcatattctccctgaaatgatctatttcttttggaaatggctgttctgcacctatttaagtgtcgatgacatattaatcatggaatagcaggcatcaccccaggtgctagactgtgaagatgaataagaagcatgccctgtcttgcagagagcttacatttgaggaaggaatcaggcagttaagtgcatggaggtaagtgctgttggagaggaaaactcaggtagctttgggggaaagggacacacatttaaccagcttctgtgatataccaggcacctcacaattactactccatttttgtgatatgaaaactcagcttcagtgaggtaacatgaattgtccaaggtcatatgacctgcaggttaggaagttaagaccgactgggtctagttctaaagcccacatatggcagataccactttgcctccttatggggtaagggtggtgtgtttaactgtgtacaaacatctatttacttcttttctggtagtcctagatgcaagtgactatgtatattttaaggagacttaagcttaaaggctcttgaccttaatgagggaaaagattgtataaattcatataattattgctaattattaaatgttctgaaagtgtggcaaggccattgtgaatggggatattagggactcattcttcaagggcccttttctttgtgaaggtttctgtgaccccctaggaaaaatttaaatgctttcttttctgtgcacccatagtacttgcttgcatatccattcattatcaggtttgttgataaatgcatgacaatttagatattacctttatcagatggggaaacgccatgaaggtgaagaatttttgtcttgattatctctctgtgctcagtgcctctgaaaatgtttgttgaggaaacaaattcatagaaagaatccacaatttaaactacaaatctatagaaagcacctgcatgaatgaaactgtggtctcccttaattgacagctacatctttaaagttggggaacaaaggaaaactgtgtgacatttgcgaaccattagttcagagctggactgtaaagagatacaggaaaaaattgatttctaaagtagaaatgctgatggcatttggagaaagtcaaagaaatataatttatgattagaatccatatattgctttatgatttaccaagtgcattcataaacactatttaattatcacaaaactcagtgaggtagagaaatacaatcccattgtactgatcaggaaccatcagagaagtaaggataactttgaacttgatcaagtcacatggttatttatggagtccacatacaaacttaagatcttctgattccaaatcctggacattttccactaggccatgttccttccggaatactggacttttgtatcattatgagtatataggtctctgacttatgttttccattcatgatatctacaaaaatgaattgtatattttttgttttatatcggttttctctattgtaaagtactttggtttattatttaattgggccctaaaatacatgcttaactacattttatatattattcatctttcatctataaaatgggattatattccacctgccgagtatcttgatgtgcttcataaaatgcaaaatccagatgggaacaacaattttataaatcttgaacattgttttatgtttgtcttttgagttctatctttcatatcacgacctttcaaaagtttgtggttaaacccagagtaatacactcccaatgctatttactcaagaagttattagtatgagatttatatatgacagaaggtagatgtaatctttgtaggtgaatgctagtaatataaagtagcagatattaatatgaaaagcgacagcttctttaaaaaatatcaagtgaacttttgacttaaaaagttagtatggcaggcctacagggacagtacaaagtatataggaagtcacgtttcgcatttgcatactgaaagcatcgaagtctgatttccctccagcattaccaatttcattgattatagctcttacttgtctatgcacttcaaccaagtttttagacaattcaaagtggttagatgatcggtctgtgtatatttgctgattgattgcattcatcatataccgcaatggaaaagttgtcataaaagtctcgattaaataatatacaagctgctatgtataaacatctcatagttgaatttcggctgaatacactgggctgcaatttttcactttatattgattgaacagccaagtgattgcagataggggctgaaaatagttctgtagagaaattccatccttatagtgtatgtgcaagtatgtttatctgtgaagcaaggtgagagtgctgggaaggttcataaagtaactattgatctagaatctggaattcactcaggataatttttgaagagcataggagcctctgtaaagattaaaaaatgacataaactaaaacattgttatagatcatggtaaatagtaaccctggcttcatcagacaaccttgattaggaagagcagaattagatattgggttttttttcttcttatgtttaaaagagaagagcagcattcatgcccctttttgagtcagcactcattttttggggaagctcttctcatctaaaggaataatccaaaatatggggaaaactaattgcatgaatatgtaagacaaggtacatccatttgatagaatttttgtaggcactgaaagttgtccaagttgtccttgtgaagtcttagcaatatggaaactatgttgatatgataataggaaaaattattttatgcagataaaattgtagaaaacttactattatttctattataaatatgtatattaaaataaatttatagataaatagtaatcatttgattacttttattataaacattttatatgggaaaaccaaagttcagcactgttaagtaattttttaaggccatacagctaatcagtgatagaggctggacttgatctcatggttgtctgcctcctaagactatgccttttatattatattaaacttgtaatattgcttctgaattttaaatataaatatattttataagaaaaactaaggagaaatctagaattttaccataaaatgtgtttttgggacttaatttgttcacctttaattttcttttggtcttttattttttcctactcttcttcattgattcttccctttccttttctattcttttcttcttccccacattttcaattttcaaccaggaataatcatacttctagttagattgtgttttggtgaataatcaaatcactgcctcccgcaacctcacctgctgttcctgcctggtcttcttcccccatccttgaccattcctttttggatgcctctcacctctcttaggttattcctttttgattgagactactgaaaaaaaacaaaacaagacaaacaaggtaatcttcagactttcttttggggatgtccttcactaaatctcatatattttaaatctgagcaattggaaatttctactcctactcttttgctttcattttgaggtaatgactgtgtggagcaaatgttgactctttctggaggattaatactaatttggctctttaaaaattttaagcagaaagacgatttcccctgtcctcccaggaatagtgggtagaggtagaagatgctgatgtttttctcctgtttttaattaacatgtttgtttttagggtgtcttttcttctctgacatttttccctctggacttagcaagtttttgaatcactgtttctcctgccagagagaacatcctttgagagaggtcccagagatgttaagagaccctggagatctcaagagatgttaattagtagaagtaaataaatagcttgtttatttttatgcgcattttaatgctgtcctttacttttttaaattaagaagtagaaaatgtgcttgtgcttaaatgtagtgtaaagtttcccatattcctttgggtgctggtgtattttccccagttgcagaaaatatgttcagaagaattttacctgttgagactattccttctccattttattgctttttattgttactgtagccccctgcacaaaaatggcatatgaatagtaataatattttataatctgctacagtaaccatatttgcttatttgcaacaattacataggactggaattaaagatatagagacctgagaattgcccatcatttgcaaaaaactcttttcatgcaaaagtgaaaaatttacagtgacagagcaagaaggaacctttagaatgtcttccccattcttatcttaaggcagcctcacacttaagacagctcgagaaaatgacatgctgccctatttgggaagccattaaaattattttcagaactttggccagtatcatcttttcaaaatatagttaaatcctgctagaggagctgttttattaatattttacttaagcccttagagtagaattcaagcttagtatttcatatcctaatcaagagaagtaatatacaacagcagtgaagagtatgaaccctgcaaatagactccctgggttcacgttgtgactttgccacttaatgctgtgtgaccttgataagatatttaacttcacttcaccatactattctcatctttaaaactggataacactggttgtgaaaatttagtgatatgttgcatgtaagatacttagaatcgtaactggcacacagtaagcctaaatgattgtttttagattagatttatggttaaagagaaagacaatctacagattggaaaggttagaacaataagtgagaggggattgaatctcaaaatgtcagaagctagtaagaaagccccagttggaggtttccaatcctagactaattactaatttcacgtaactgagataacgtgcatattttgtgatagaaccatttttggttatcttcatgggagcttgatattttcaaaagctgtccaacaacacctaataatattgttgtggacatgatggaacaatattaccttgatcataatattattagctagatttacagatttggactcatataattatagtgctagttaatagatcatgaacagtattctgttagaaaattcaaggcatttacaatgagaatacctataatgaaaagataaattgtaaatataaatataaaagtggcattgtggagaagcagaacccaagtatgtcatccaaaggtttaacgtatatattaccattgaacttcaaatttggttctgaggatttttgcaaccaagatgacaaagaagatatgatcagttacattactattattatctaagagaagaaagtaaatcagttcctcaggaggaatttttcctagtacggatttgtaatggagattaatcacataggttcataaatgatcagcaccgatttaatagcaatttctttaataaatattttaaagcaaatgctcttttataatgaaactttgggaaagaagtataaaggttatgaagtgtcagttcagcaaagagaaatggtaggctaatgtcatctgtgtatgtgaacttcatgtgctctgagttgatccaaagtatagttgagagaacctaaactattggaagtacactctgttcttcagtaatgttatttcacgttgcttctctcagccagagtttgaggggagctgggtaatagggtctagttagaaaggcgtagaggcaggaataggactattttaaggttgtaagttttagcaggaacagtaggctttagaaatcagctaggaaactagtaaagttgacctcctccataaagtgtttctatatcatgtttcttgaggctctgagtttgttaggggtgcttggctggatgggtagtttggcgttaaggtatttgaggggcaaaattaagcagctcagttttacttacttttatatgttgagtttctgcaaaagtctttatgtgacaaacagtaaaaaaagttattttgcttaaaaatacgggaaaactgtttctgataaccctgattcttccagtgtaaaaaatgcaagttttatatacgtcaataattaaatgttcatatttttatcatgcatcttaggtcgtatctggttcctgtattagggttaaagacaatttgaggtggataaaaagccgtctttaatctgtcctgaaatggccaaatatatataaattgagataaggcctttctgtcaagccctcttctgtaattaaagtagagctttagtaaatctttggatcaaagaagactggtcatagatttgagaattttttttttttacctttcttcagacttttatgtctataatcctacaaattcatttaggtagggtcaccattaacttgttatgtaaatcaggacacttttgagcatggaagtggttcataacaggacaataagcactaacggagagcagtttcctgggcgtacttcctgcagggtctcccaaagtctgcatgtaaacaggtacaggagtctcagtgtcaagggttagggagatgggataatagttgattaaaattaataaaataaaacacattcatattgaccaattagaatataaattataaataaggaaatgtaaatcacttataaacctactttttagtgattacaattgttaatatttggttgagcgaatatccacctagaatttttatgagtaatagaaaacacatattttctttttccttctttaaaaaaaaacttgtgatatttaactacttttttatatttattgcttttatgtaacttttaatcattgtcatttttcaatgtcagatattatttgaaaatatgctctttaagggttgcaaagtattttatcttagagttgtactataatttattgatgcattcctatcattggtattttgagttgtttctatttttttactattataaaatacaatgaacatttttacatctccgtttttgagtggaagttttataatttcttgaggatgaattactggaagtggaattacagagtcaaatttttatggtttgtgtatgtatctacatctgtattcaaattgtccttctgcaaacatataccaatacaaaataccaccagcaatgtgttaggttgtttcaagtggttaatatttttcttattaacatctataatagctgtacctaaaatggaaaaaagaaatcctatgtgtatatgtacagtttcctctagacctgtctcacaaattgctatatggcaagtaagtagaaaataattacttcactgagatatcctttgccttatcacctttggagaaatcatgatatcttttatttttatctgttagtggttttttttctgttgttttttgagatagagtgtcaccctgtcacccaggctggagtgcagtagtacgatcttggctcactacaacctcctcctcctgggttcaagcaattctccctgcctcagtctcctgagtagctggtaacaagcacctgctaccacgcccagctaatatttgtattttttagtacagacggggtttcgccatgttgaccaggctggtcttgaactcctgacctcaggtcatccgcccgcctcggcctcccaaagtgctgggattacagttgtgagccactgctcctggccttaatattttttatgaaatgatgaacagtatgtctggggttggttatgaaaatataaaagtatactcaagttttttacatatttgagtgatttgaaaagctaaaggaaattaggcatctaaataagtgttcagttggtacctttgaaagtgccaattcggcagcggatgtgagatggtgtattaagtggagtatgtgaggcggggctttccacttggatggacattcaaatgaggtgagtgggcagtttgatgtttgagagcaacgttaagctagggagtcattcctttgcttacttgcagaagataaagcaggtatttttcaggagcttaagtctatcaaactggtggtgttctttattgagaaggtgaattgatgataggagttcatcctcagagggcggctatgatcaagatgcagcaagtgaataaaacatgtatactacttcattttaatggagctcaggagctataagcaggtcttaagctctgcccattaggacttttatttgtttttctgctttgttaatttatagcagttatcaacaaagtttcttctcactctattctaaataatctattgagaaaaatgccagtcctaaataaatttttcttgttccccaaatgaagggaagagagctgaatagtccactggtctaaaaggaacgttttgtagccatgccgtgttcaagtcacaagttacataaggcaaggaggcatctaggcctggttatagatcttctataatatttctcatggacttctctgagttcctcctctgaccttctgtctgtcttatgtgcatgtttcatgaggcctatacagtatctagggttgtctgggcagaatctatagactaaggtaagtgaactctgtattacggcttgtttggtttataatgtgagaccacagcactaattggacacttcatgtgtgctgttaatacatgtaagtcctctaagctaataagcttttttggatttccctgttgaaggggatttcacctatcttaaagggagtagaccacactaccatgttgtgtgggaggttagattagcaacctcaagttaccaaacttaaagttgaatatttcagtcctgcctaaacttttaagacagaaacgatcagcttacaaaatttaattttgcagccaggataaaataaataggatggcattggcagagacaaatttttctgatggataaatcacatgaaaggcaatattgtgtaagagaaaaaatagcaccaaaagagtttcttgggacttaccttaaaggtttcccccttctaattatacagagaaaaatcactctgctccacagtctccaagaatagaaaggaggggaaaatgtacttaaactgcagtgtgagaaagtaaggttggatatcagaaatcatattttggtagtattgttaaacattgtgaagagttacctgcaaaagaccccgtatccttaaaagaggggaggaggagttgcaagcacacctggcctctgaatgcattacaggcaaagtccttagaaagctgttggcaaaggttatggggaaagcagtagacaagcagtggctacaaagaatttactggaccatgttagaaagcaagaggaacagcaagtaattgctcctaggcctaaacaaaaacaacaacaacaaaatcatctcaaggacaatggaagagtggaagtgctaatacacatcaaaatgtgaaagaatcatgggaggaactgcctacacaagcagaactcattgtgaattaaaaaaaaagaggaattaaaatgtaagtttgctatgtttgtaggaaacagttaagtgattatgaaactgtttaggtttggtggctggaaaataggtataaaatgtaaatattgtgtttaaaacattttgaattattatctagaagagtattaaagagtgatagactcttaactgactgagatatttatgtgctttcagctagaaggataaaatcagtggtctcctagaatcaattcttatggtatgattctctgaaattatggagatttgttggcgctgagtatgtgttataaagttcagagtgcaaatgggtataattaaataaatgttcactaagcaactgctgtgaaaaaggcatgaagtacaaagttaaacaatatgtggcgcatttttaaaaaggtgcttgcaatatccacagagagattttgatggtaacagatctggtaagggctgcttgagaggtacacaggcatttttataagagaaaagaacaggcagaaatgagtttggactatgggagaacatataaagctttcctgtagagaaggcagttggtttgggccttaaaggagatatgaggtttttgaccaatgatgatgggaggaggaaagggaaccctgggcacggaaaagcgtacatggtagtacatataagctggaatacataatgtgtgtttggtgctttctcaaagtcaacaaaggcttctgaagaggaaagaacaccattagaactttaggagataaacttttgggaggagataacacaaaaagaccagttaggagctactgaattagcttagagaagaggtaataactgcttgttctaggtaagccagtaagaaaatgaagtaagctgctaaggaaactaagaaaagaagggaattatgagagataactagtgatgaaagacctgggtgggtgtagagggagaatcagaggtaacacaaagacaatagaatgattggttgaatattgaggccattgacaaaaactggagagaaggaaaaggatattgtgaagcaactccttggaatcaaagcttgcttctcttatgactgtttttctttctgccttcacatccttcctttcatctcctcagttcagtccctgctttgtgcctggttctgtgcaaggtaaagtaatgaaggtaaataaaaacacgcaaaagatatcccccggcccttaaaatgcttaccatccagtttgggtaatagaatctatccatatgtatgaaatccttagcacatatttagaccataactattgtgaggactgaaaggggaaaaataaggggttgggctgtccgtcctgcagaagtgaatcttagatacaaatatgcaaaacatactctagttgtatatcaggtaataaatggggtcaagcctattaatgctggttccggtttgatatgaacagatttgtcttttgggttttcttgaagatcttagcatgtctccatgtgttgtcacccttgtattcggagatcagacgaatattaaataagtttatgacaagctattcctcctttcttgttatttattgagattccttacccctaggaattactttgcagatgcttctttctttttgaaagctttcttgtatttcataattatttgttgaacaagtaaatatggtgactttttaaattaacttaaccccaacttggggtccgatttctcatggtaatgtcttggcataggattcaagcatctgatttcacatctaggagttgtgaactagaatacttaaacgcagctccacccaccccctttctttaaagacccagtgacttaagtagaagctgtaagtctttattttacccctgcactgtagctttcagaaatcttaaaagaatccaaaatgggctagttattttgcacttccctcttaatagcacctagggataattactggtatcttttgttgccatctgttttctagtttatagatctatttttatttcatgtttctattctgttaaaaattctgtttataaaaagtacatatagttggcaatatgagattttttggatcttcttgtagtttatgagaccaattaccagatcatttgtgaagacatagtgatttgtgaaatttgaacctgaaaaccaatagcaaagggaagaaaagcagttggagtatttgccagatgagggatgtcgcagtgctctttacaaagccagtggtgagggccacgtgaaaggaaaagcctcactatatctagtctttcagtatttactcagggcaaagacagacttcagaacagatattgtctttaggagtatcgtagtgatcactgagggacacttgaagacttttatttatttctttcctatttctactcttttggggctctgttctctaattaaaattggtgttttggaaaaagggaatgtgacttctgaatacagtaataaattatatccttgcctcagatggaattaaaatgactgcagacgtgaaatttccctgcttctgaaaacttaatttgatattttctcttacacaccaagcagtgatttgcagaggcacagactgtaagattaattgaggcagccatctcttctggcgcatctaatcttacatctaattatctgatcatctgaatcacaaatacagtagttaaagggtgtctgtttaaagggcacacttaaaatgtaaatattaaaaaggagctctctggttttccagagacagacatgcagacttgtaatggccattatgttattcatggcattaggtcagcaggccacatagaactgtggttacattgctctatcactaaaatgtgaagataattctgaagtctgtattaggcttgttttgacaattaacctccattagtattccagaacacataagagcaaaactcttaaaaggctttcttttcaagaatgcactgtcaaattgacttcatcatttaaataggactgtagtcacagtaaatgatgagttgatattcatacaaagcgtaaccttaattacaatattatgagcaattaaacccagtgttcacggaattattgtacatttatgtgtaacagaataaaaacattgcataggactgttaagctttttgtatgaatctaattaactttgacaggctttgagcttttctccttctttcagaagtgctgtagataaatgtacttgcatctggaaaacttcaaacagttttgatcagcatttcagatctgatttaaaatgaatgcattgaaacgctgtcttaaatacagagttgatagatgtgtggtgcacagtttcttgtagcaggaaggcagatgtggtagggagaacagctgtagactacagcagccagtggatattgtttttcgtcacaatctaatgtcaggcagctactgctgtgaacaggtctttatatatttggctctggttaatgctgcggatgtgaaaagctgaactcacactgattccttggaaggcaattaggagggagatatgtcttcttatgcttccatttctgtagcccttagggaacagagcaccatgagcaaaccaaggttcccaaggagtcccagtgactttttaagtttcataagtgaggaatagagtcctccttcaaacagtgaattatgacattgaggattttggagttactcttcttgattccctaaaatccaactattgattaggcttgagaggaagctaggaatttcatcatctaatttgcatggctcgatggtaacgacaaccaccaccactatcacaataatggttatattttactcagcaccaacaattttggtgattggcatacattattttatttaatctttaccccaactctatgaagtagacaccatcttcaatttattgatgaagaaactgagacttggagcatttattgtcatttttgaagtcacgtaactagaaagtgttagtgctattaaaacataagatagaaattgagtattaatgagataaaaattcattttaaaaatataataaaacaatatatataatatgggcctatttatgtaacaaacacaagagtatggtaatacatatataaatatatttgcactgatataaatgcagataaagagaagcagagttgagtacactagatggctgacagtggttattttgagatggttgagcagaaggaaggacaaagtagaaagatttttcaagttttgttcaataacttcttacgttgtttaaatctttaattcatgtgttgtttcagtaattacaattttaaagatcacaaaagtacttttgctgctaaagtaaacatctgaaaataaatcttcatcatagaaagtggtggtaggtttgatttcaactaggactctctgactataacatctgtgctttttccatgaagttatgtgtcctttaaaagtgtgtattaatgtttaaaaatctgatgtaaaaaggtagtgaatttcctagccttctcgttgtccttagaaaaccttgcttatactggctgggtgcagtggctcccagcattttgggaggccgaggtgggtggatcatttgaggtcaggagttcgagacaagcctgaccaacatggagaaaccccgtctctactaaaaatacaaaattagctgggcattgtggcccatgcctgtaatcccagctacttgggaggctgaagcaggagaatcgcttgaacccgggaggcagaggttgcagtgagccgagatcgagccattgcactccagcctaggcaacaagagcaaaactccatctcaaaaaaaaaaaaaaaaaaagaaaaagaaaaaaaagaaaaccttgcttatacttagatcacttggggatacatcagaattccattcttaatttaaaataaccaatatatttcaaatacctatgatgtaccagttgcactgtgaagccctgaggaggttgcagagatggaaaggacactggctctccccctaaggtgttatcagcatcgtgaacagacagactggtgcccacagagctgacacacaacgtggcaacagtggaagaaacaacatgccatgtagctttacagaggatacaagtatttctaaggttagggttcacataacaatttattcagtacctatgtggatgtttaggagccggacataatggaagatactaagatgtggcttctgtcctcaaagaccttgtattggtacagaaaagggagcattataacacaggaaaataagagagcaagaaaagccaggaatagcatataattgattgctaagtgatatagattaggccctaaatgaaatgggaattcagaaaaaattgtgatcactgtgggtaagaattgtagatttcataaagaaataaattatagtaccactatttttttttggcttaaaagaagggtggccaggaatcctttttttgtactttgaaattggcctttgagtagagtctctcattatctctgacagttgttagaaaaaggaacagaataacaattaaatccatccacagctgatgcatttatttgatatatatgtatatatatgtttgtgaatatatatatttgtgtgtgtgtgtgcgtatgtgtattggaagactaggcatgatagattatttttctctctctctcgttcccttcttcccttcctctcttttttccttccttttattaattatttctgctagtattactcagacatatgacatagaatcaggcatgcttgaaatatgcaagattttctgtctaaaaaaatagaatagaagcatagaggagctagctgtttagggagtttccctttaagaggcattatacctgagttctggacccttctaaatacgttaaaccataatcatatatctaaagtaccaaacacagtgctagcacatagtagatgctttgtaagcattacttctcttctctgccttcttcacaaaactttagtatccaatctaagagagaaaaagccacataggaggggggtgtgcaaaaataaaaaagactgagggttgcatatttggaagaaatttgattttcaacagccaattcttgaaaatgtctcaagattacagtgactgggtcagctattatggagcaactctgaacttggagagaagacaatatgagtatactaagaaatacataagcatctagggcaaatcacatatgctgttaagtatgtgggattttaaaaaatatgtatttctatgatatcagcttccttccactttttgtttttaataactttaaaccagataaaaatcttcacagccattcagactcagactaacttaactgaagactaaacttgagattcagccccaccgaattatgcatttttttaaaatgataattttcccaattatgtaagtatgcaaactcaccatggaaaatttgtaaaataaatgaaggaggtataaaacaaacaagcaaagatttgaaatcctgcatgcagaagaaaacttgatagcatttggttccaagttctcttggtgttttttttaatgcttatttattttgtaggtattacatatttgcttatgaccatattttgtcaatttaaaagttgcatattttgcagcgtgacccagtttgcaatcattgttcccttttacaatattggaggtggccctggggaaaaggcctgtctttgaacttgattgaacacgctgtctggggcctctctctttcttcattgtcatccccagagtgtggaagcctggagattagctggggagggcttctgctctgtgcctgggggagaagattgtgggggcatttgctcctctgaaaagagaacaagatagctggctgatacagaggatcttggatggctgactggatggggtcagaaataggaaacaaattgagttaatcagcatgtgtcttgagattcacgctccagcacagcagcaggttaggatctgatatgatgtgaaggtggtggaccgctaggccaggaacagaggcagggagagagaaaaaataccaagaacatctgtagatagagcattaaaccttcaacagtgtttctttcttcctgaaacttggtgggtattaaaaggactgaatgcatttatttatgcttgtccttggtgcccccaagcatctaggtatgaagggttagtagggtggcagcatgtttggaaagggagacaagatgtttatcctagaacttctttggtctgcttatgtttatttggggtagttttggagagtctggtggaaattgtagggggtaggattaaagtcttccttccccagtgacccctgatacttttactgattatttctttggagcctatgaaccactcttagttcagtagaactcttggagccctgtttcagtgatggttcttatcatgtgaactgactagggatgccatgcagtgtccctaagccatggtggcccaggaaagccatgtccttctatgttggataagtaaccacaatactcctttattcagtgtatgtttattaagtaccaagcatgtattagatactgtgcagaatactgtggattaaagactaatagaaatggcctttgtccccaggaaacacaatgtatggaaaggtagatttataaagagattattaatattaagtcttggaggtggaagtagggtcatgctgtttgtccagtcatgggaattaaataatgggtaggttctaatgaatgattgtccaatgattacatattatgtttacctacttaatatcatctttaatcaaaagcagaattttgtatgtaacttctattatgcaaagtttctcatgctagtatttctcataatattatttgtgtgttgaaatctgagcaacatgacttttctttcttgctgtttttacaatgagctttcattggaatagtccttttgacattattgtttttccttaattcaatattttatctcatttataatctagtaaaccgggaacttgacttaaaaagtttctgattttacaaatattagccagatgcggtgggatgcacctgtaatcccagctagttgggaggctgaggcatgagaatcgcttgaacctgggaggcggaggttgcagtgagccaagatcgcgccactacactccagcctgggcaacagaatgagactccgtctcaaaaaaaaaaaaaagtttctgattgtattatttatctaatgttctttagaggcaggtttcaggaatgtagcaacagtctctgagactctgagttgggtagactcattgagtaaaggttgttcaactttggtagaaggtgggtatgggtattggtagatttgtcaagctcctcagattatcagatacttatcagtttgagaatcattaggaacattgagctatgattatagactttctctgtgtcagttacaataaataggtaattcacaaattgcaaatttaacaacagtgagtctgccactgtagacaaaattgggtctggcttttgttgatctttttagagtgaaataaaattcttatatttatagaaatcagctaattctcttgattcctctctctcctctgtttctgcttgccttcttccccttctctctgttctgcttaatgtcgcttctctttcacctctaccctctccctctccccaacccctttacatgttgtgatcacacaggtaagatgatgtggtggtcaggggcagatttatgatcacagtgggaggatgtgtgtgcttctgacctggcttatcttcagtagatctctagggtgtagttctcaaactgtagcatgtattagaatcacttggagggccagttaaacccagattgctggattacatctctagtttccgattcagtacatgaaggtggggccccaaatttgcatttctaacaagttctcaggtgttgctgatgctgctagtccaggaaccacactttgagaaccactgatctaggagattcccttactatgtaaaaactattattactttttgaaaaagtaaatttggaaaaaaaatattggaggatgaattctcatttgaaatagaggaaaattttaaaatatgctctgtttttaagtgttttcttggagggatacaatagctttcctaataacttatttgaatagtttctcaatggataaaacatctattatatagcctttatctgaaatttaccttatctttgtcctacactttttgaccttggaaaggtgatgtcacgtggtaactgaagacaattatcagtcttctctatttccttccactccatatccccagtctaagagtatattactttaatacctcagtactgacattaatttaattttgataaatgaaaagatgctgaatgttgaggccaattatctttgatgaaagaaggctgaactgttttcatctgtacaaggaagattttacagaagacatccaagttcctggaaagaagtttatctgacccagacattaaaacattaaaggcagggtgactttagcatgcctttttaaaataagactttatgtcagagatttatttgggtacactttggtgccaattatgtccaattagtaaattaatggatcatgtgacacctagtctatagttgtacaattttttcttggacattaagggttaattccagcacagtgtttttttttttttaacttttgaatttttttggatttacttcttaattgaagttgttttatttcttaataaaagtacaacgtgttttgaaatatgtatacattgtggaatgttggtaaactgggctaatcgaggtatatgttaccttaaagacttttcattttttgggtgtggtgagaacacttaaaatctaccataatattttttaagaatataatacactgttttttactatagttaccttgttgtacaatagatctcttgaacttattcctcctatctaaataaaattttgtatcctttgaccaacatcttccgatccccacccccaatcctttaacccctggtaaccatcattctcctctctactatgagttcaattgtttacattccacatgtaaatgaaatcatgcagcatttgtctttctgtgcctggcttatttcacttatttccaggtttatctatgttgtcacaggtgacaggattttcttcttttttaaggctaagtaatatttagtaatatttcattgtgtatatatactagattttctttatccatttatccactgatggacatataggttgattccatatcttggctattatgaataatgctgcaataaacatggatgtataaatattttttgaaatcctacttttagtcttttgtttttttttttaagttttttttttcttttattattatactttaagttttagggtacatgtgcacattatgcaggttagttacatatgtatacatgtgccatgctggtgcgctgcacccactaacttgtcatctagcattaggtatatctcccaatgctatccctccctcctccccccaccccacaacagtccccagaatgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatattattccatggtgtatctgtgccacattttcttaatccagtctatcattgttggacatttgggttggttcgaagtctttgctatgaaatcctacttttagtacttttggatatacatccagaagtgaaattgcggcttatatgttgattttatatttaactttttgaggaacctctagactttttccatataggctatactaaattacattgctagcaacagtgtgcaagagtaccttttctccacatcctctccaacactttaaaaacctttcatcttcttgatagtagccattctaataggaatgaggtgctatctcattgtggctttaatttgcatttctctcatgattagtgatattgacaattttttcatgtacctgttagccatttatatgtcttcttttgagaagtgtttattcagatcacttgcccatttttaaactgatttgttttctactgttgagttgttagagttcctcatgttttggatattaaccccttatcacgtgcggtttgcaaatattttctcccatcctgtaggttttcttttcggtctgttgattgtttctttagttgtccagaaactttttagtttgatgtaatttcatttatctatgcttggcttttgttgcctgggcttttgggttcatccaagaaatcattgcctagatcaatgtcacggagcttttcccttatgttttcttatagtagttttacggtttcagattttacatttgagtattaaagtttttgagttaatttttgtttcttgtctgatataagagtctaatttgagtcttaaagtttttgagttaatttttgtttctggtctgttataagagtctaattttattcttctacatgtggatatccagcttttccaacaccatttatcaaagagacagtcttttcctcattatgtgttcttggcatctttgtcaaaaataaattgactgtaaatgcttggatttatctctgggttctctgttttgttcattggtctatgtatctgtttttagtctagtagcatcatgttttaattattatagctttgaagtatgtcttgaagtcaggtagtgtgatgcttctggctttgttctttttgctcaagattgctttggctattcagggtcttttgtggttccatagaaattttgcaattttttttctgtttctgtgaaacatgttattggaattttgatagggattgcatcaaatgtgcagattgctttggatagtatggttgttttgacaatactaactcttcctatccatgagcacattatatctttctacttatttgtgtcttcctcatttttttcatcaatgttttatggttttcagtgtacaggactttcatctctggggtaaagtaaatcctagttttatggagcccaagtcttataaaatctgatagggggagacctcttaaatagtaaaatatatcttatattttcaaattttacaaaacttatgttaatatgaaaataatatttccttgtattctaggcccctaatataattgcttatacattgtagatgtctcagaaagaattgtgaattaattaataagttcttcatcaaagtatcttcaaagcagtgtgatttccattatttttcttttcctttcttttgtttcttacaaaactgccacctgggctggagtacagtggcacaattttggctcactgcagcctcaatctcctgggctcgagcaatggctgggactacaggtggactctaccaggcccagctaatttttaatttcttgtagagatagagtttccctatgttgcccaggctgccctcaaactcctggcctcaagtgatcttctcactttggcctcccaatatgctgagattatgggtgtgagccaccatgcctggctgatttccattgtttctgagctacttggtgtcattatctatgacttgatattgaacatacattagcactataaaaacacagaaaccaaatcaaccagtgttttccgttgtaaaacaataacatattcataagagacttcctatgataagctaaagagatgaacagtaaagacaaaatgatgatgaatggcttaggccaaatagatgttagccagacagatctgacaaatggcacacaaggctgcttaggttagaattctgtaaaaaccgttattctatcttctaatttttagaggatagagggctggaaggttttgaatggtggataatttctggtagtgaagtcctcaaatcagaaagatattatggagctttgggaggtcaggtgatggtggactaagaagcaggagaaccatctgctgcagtctgatcctggagcatggtctgagtggtcagagttatttgtctcctttgctctcgagtatatgtgggcaggggaagactcacaagtgtttctgctttgagatggcaataaaaagcaagtgaagaataaatagttgctgctacctcttgattaagatcagtgcagtgccttaggtcttctcagagatcctgaaagaaaatataataaaagagataattaaggaggtgggcaaagcaatttaaagatattcacaaacactaaaaatgtttttcttatggtttgatttggaattgtgaggtgatcatttaaaagaaaagaggggtacggtattagcccattgtatccttgatcaatatagaccacccattccttttagtttctgcatcatagctaatagattgcccagggaaaacaaagtatcatttataattgttatttgaatattttatgtaaaacctaatctgaagacttagagaaatcattgtagattaagataagaaataaagatttgcatttatgagaaattaatgatagttctgaaattgaagaaccatttagttctgggagaaataaatacaaattataacatctagctgatggaattttgtttagattgcttctggtgataaaccatctataataatataaatcaagccctggtgtttgccataaatttgcaatgtttagcataatttttgtttgcatttcatactaaagtgacaccaagaaatatgagattaatagttattaagtgaaaatgactttcatgtctgtagtcatttttagaaacagttatgtgtaattcatttagggaccagaaaaaattaatttgcagttgtggtgggatctagcacattagaacaaagagggaagtcgcatataggaataaacttttgaaacataagggtggattcatttttaaccctgaattttgatttaatacctcaaggtacccttcagatcatcacacttttgtttgttgactgtagaatactaatagcttaaggaacagagaagttgttacctgttctcaaattatgtcataatcctggagagtagaagcttatccatacctgaggggacagagggtcagatagctgccactgcagtatagtgtcttttattaattttaattagtgttttcattaggaagtgtcatattagtttctgatttctaaaaaggacacattatttactttcatttgtttcactgcactataaatccgcagtggtgtagaagttaaattctatagaatttttgttttgttttttttttgtttttttttttagaaacctagcctcagaccttatgagtttaaaaaatatagttaatatttcctaagcatttattaagtgctagctgtgtgctaaatgctttatatatgttcagttatttgtgttatgttcattactagagcccttttcaggcaaagtcatacattcatttattcaggtgttatttactgaataccctctctgtgctagatgtgggaagcattaatgttttagaggaggttggaggaaaaagatgatatttaagagtttataaaaaggacatcaggacttttggtcaatatgatattgtaagttcatattttgaggctttactgctcaaaatacctattaaagacggataaagtatttttaaaacataataaaaccacattattgtgtgaaaatttaaaattagacctttagttgaaccgaaaatattcagaaatgccaagcagtggtgagttgggatgtgtgtgggcttgctaagtgctgggtctggaagcagaggaggctttgatttaaatggtgaggcttgacgtgttggagaagcataatagtgccttaaaaccaaactcatggctggttacagtagctcatgcctgtaatcccagcactttgggaggctgacacaggtggattgattaagcccagaagtctgagatcggcctgggcaacatggcaaaaccctacctctacaaaaaatacaaaaattagccgggtgtggtggtgtgcacctgtagtcccagctacatgggaagctgaggtgggaggatctcttgagcctggcttgttgaggctggtgtgaaccgtgatcataccactgcactccagcctgggagcgctgacagcatgagaccctgtctcaaaaacaaacatgcaaacaaacaaaaaaacccaaactcacaccatgaaactagaaactgtcccttcctacccatctcagcttcccttcaactggtgcttgggacactgaattccaggaagctgacacctggttctggattgggcactccacacgccaagtggagggaactatacgtcaactagtgatactggcttagaagaagtctcattgtgctgggatataacatggaactgtttattttttttcttccatccttacaacatatcactaatagattccaaagtttttcagtcacataaacttactaacttattttagcatagtttaaaacttatattttcaaaatctggctttttttttctgccatcacacactagaactagagccctggtagctggaaggaatcagtaagactgagggcacaggctggttgtggtctggttccaagatgccccctttttctcttatttcctctaacagccctagctgcttctgggttgagataggtagggaagaaggtgaaggacactaattttgttagtgatggaaatggtgcctgatgttgcttggattcggtctggttttgtctgaagttgttgccctttatcttaggtgctgtgccaggtttcttggggtaagtatttgcctcaactcagtctgtctctgaggatcatcacagagaggggaagtccactctccatttgactcctgccagtggtccacatgcctaacacttctttggttggatctgtgattgcttgatctagcagccctgtggctcaaggtcaacatatttattccctctcctcctttcccaagtcttttattttaaagggagaaagaattaaggagaaatggatgttgatagtagtaaggctggttttccagtatttaaaaacatcatgtggggagatgtcttacagctttttttggtgactctctttggagtgtttagtgcctttactttttatttctagtctctagacacaattcaaagtcaattggccaggcacagtggctttggcagggcgtggtggctcacgcctgtaatatcagcactttgagaggctgaggtgggtggatcacctgaggtcaggagttcaagaccagcctggccaatgtggtgaaaccctgtctctactgaaaatacaaaaattagctgggcatgatggcacatgcctgtaatcccagctactcaggaggctgagccatgatcactgcttgaatccaggaggcagaggttgcagtgagccgagactgtgtcactgcactctagcctgggcaacagagtgagactctgcatcaaaaacaacaacaacaacaacaaaacaacagcaaaaaaaccggccaggcatggtggctcacgactgtaatcccagcactttgagagactgaggcaggcaaatcacctgagatcagcagttcaagaccaggctggccaacgtggtgaaccttgtttctactaaaaataaaaattagccaggtgtggtggtgcacacctgtaattcccggctacttgctacttgggaggctgaggtgggagaatcacttgaacccaggggataaaggttgcagtgagccgagattgtgccactacactccatcctgggtgacagagctagactctgtctcaaaacaaaaaacaaaaaacaaaaaaaccccaaaaaacaaaaacataaaacaaacaaacaaaaaagcacacacacaaacaaacaagaaaaacaaagtcaacaagaaaatatctcctgaaaatcccgttacactagatagataaggagagaaagagtgaggaactttccaatcaagatagggcctgccaaccaaaattcaaaacaaataaaactaattccaaggaaggcagttatcaaaatcatagatcagactatcaattccagcagaaataaaaatatttaaaattattaaaaaatcaaacaaatgttaaatcctgaaagaaataaatgaaaggacacacacacacacacacacacacacacacacacatatatatataaataaaataaaatatgagatgtgtgcattgtaagaaagatgaacagggaatttggcaagatagattgatgatttaattattgactgttaaaaagtctcagtgtgtcatttggtagatgaaacatgctatatatttttttttcttgttcaaaggaataaacctaatgaatactctgttttaacacaactgtctgacatatactgggtatactgcaattcaaatctgacacaaactaccctggcattagcacagatctaatagattaaaggcacagtcctccaccagactgttcccacttcaggtgacgactgcaagtctcagggggagcccaggctacccatgcttctgactaactgtaaataaatttggtgcttttcatgaccttctcaagcttgaaaattctaataatttgccattatcaatattttattattacttgttattactcacagaattaagaaatgcattatatttgggattatagttttattgtaaaggatacacatactgatgaacagccaaatgaaaagatgtgcagggcaaggtctgagtggaagacagagcttctgtgtcctctccttgtggagtcaggacatgtcatcctcccagcacatcagtgtgtttactaaccagcaagctccgctgagcctcagtgtccagagtttttactggggtttcattacataggcaagattggttgaatcactggccacatgattgaacacaatctctagttcctttaccctccctggaggtcaggtagtaaagttctaacctgctaatcatatggttggtctttcgggtgaatggctcccatcatcaggctatccagggaccacagggatatgtcattagcgtaacaaacaattagttaccacattagcatatcactcaggatatttcaagggttttaggagccccatgccaggaacatgggacaaagaccaagtttttcattatatcacaatgaataactttctattccatcaaaaaaatagcatgtatttaggtataaaatacaaaaaagtaaaatattagaaatataatttagaactcgtccaaataacttctggaaaatggaatatagaaaatattttccatcaagtagacataagaaagaagaaaaaatacaaactgctagtaaacagaaactacaaaatgagatgatgaaataggtacagttatacttgtaatgaaaatgtgtgcaactctgtttacctattaaaagatggaagttaacaaattagatttttaaaaaatgcaactattgactcaaaaaactagcaagatttaaggtaacaggaccaaatataactaagaaattctaaccaaatgaaagaggatataaaaatgttaatatcagacaaatagattttatgataaaacagtacaaagtatgttataatgcgttagcagaaacattacataatgataaaagagcaattcaccaagtatatacaataatcatcaacttgtaaatccttaacaaaattgcctcaaaatatgtaaagaattaagttgccagaattgtaatgagtaaagtccaaaaataattagtgggaaatttcaaaatatatattccaaaatttttccaatgtatgtataccgatatatatgttccagcatttatcaggatccaaaacaaggcagagaaaaacatttggtaagtataaagacttatcaacaaaatgtacaagcttgaatatgtgtatgtatgtgtacacacaagttcacatatccatgttcctattaaagagtacatattaagtacacatgtatacaaaagttttaaacacacaactacatgatttttctgtatattgagtgatagattttttttattttaattgattttgaagaatcaatattatccagataatagtctttgacatctgtgttacctaattagaaatcagtaatacccagtttttcttttaacttttattttaagttcaggggtatatatgcttgtttgttatacaggtaaacttgtgtcatagggttttgttgtacacattatttcatcacacatatttagcctagtacctattagttatttttcctgttcctctccatccttcccagcctccaccctccgattcccagggatccccagtgtgtgtttttccctgctatgtgtccatgtgttctcatcatttagctcccattcgtatgtgagaacatatggtatttggttttctgttcctgcattagtttgctaaggataacggcctccagcttcagccatgttcctgcaaaggacatgatctcattctttttttatggctgcatagtattccatgatgtatatgtaccatattttctttattcagtctatcattgatgggcatttaggtcgatgccatgtctttgctattgtgaatagtgttgcaatgaacatacacatgcatgtgtctttataatagaatgatttgtattcctttgggtatatacccagtaatggaattgctgggtcaaattgtatttctgtttttaggtctttgaggaatcaccacactgtattccacaatggatgaactaattaaactcccagcaacagaatataagcattcctttttctctgcaactttgccagcctctgttttttactttttactagtagccattttaactggtatgagataataacctggttcttctctgtgttggagggaaaactttccctgtatcaacttaggtctgaatagttgggggcctttgaattaattgacaacaaacaaattaataggagaaaagtttaactcatgcatgcaatggtggcctatagggaataggtcatggaacagctaggggtgagggtttatatcccctcataataagagaggcatttaggacttcaaaggataggagattccgatgagggatgttaacacgaattctttctgaaatatcctggtgcccaaggtttgttccctccctgactgcagtcttttgggagtcaggaaggggagtaaggggatggtggtattgtggcagctgagtcttgtaaagctttgctgcagttggtatcaaagagagagagggagagtataatatatccatttccagatcctggctataggagacgtgtccagaaatgagtactctaaaagtctctgtggcttcctatgcactaagaataagataaaaactccttggcctggaaggcccttcctatcacaccaagcatctcatcattccagccactttgtccttccttcagatctgcaggaggccaagcttttttccctttttagaacctctgctcattctattccttctgtctgagtagcatccctggctcttccatggttgccttcttttcatccttcgggtcacagtgtcacctcttcactggagactttcctaattaatgaatctacgtaagcttctcttatctctattctagcaccttaattgcttccatcttagcatgccacattttatatctatttaggtgtttttttattttctctctcttctatttagattgtcaaatcaaagagaatatggattttctttttttctccttttttcttaattatactttaaattctggggtacatgtgcagaacatgcagttttgttgcatagatatacacgtgccatggtggtttgctgcacccatcaacccatcacctacattaggtatttctcctaatgctattcctcccccagccccacactccccgacaggccgcagtgtgtgatgcttgcctccctgtgtccatgtgttctcattgttcatctcccacttatgagtgagaacatgcagtgtttgattttctgttcttgtgttagttctttcatttgtaccacccgcagctgaaaccgtcagtgctgcacccaggtgccctctcctttactgctgcacacctgacaggcttccagctcccagcattgcatttctttgcttgaggacttactttggtttctggaagctgactctctctgctgtgctttgggcctgaaatactagggaggaagtagcttttaaccaatcactgacagaaattaatgtgtaaatgcccaggttccctcaccctccaacatctccaatgttggctggcttgataatgcatcttttatttgctaattctccttctttgtctaatttcatcactctctgaccagtgttttctgtacctcctaagtaaacaatgtatactcaaatcacatgtggggaaagcttctggcacaatgctttacacacataggcatacagtaagtatttgttggatggatagatggatgggtaggggtggatggatggatggatggatggttggatagatgaagattgcaatgtggagttcaaggttggatatggtgtaagaattcaaatgattgacaaaacaaaaaacaaacaacaacaacaacaaaaaacccaaagatgctgttagctctttctaattaatgctgttgcctcacaaaaaaatatagcacattgaaggtgtaggtatatcagtttacagataatctaatatggaaattttaaaagctatggttttctttaggaccattgtacaatgcttgatgattttatggatgcctgtcttatgagcagtttttacattccttgttttattacagtactgtatttacctaaagtattaaaatgtgctatgcaaactcataaataaagttcaacttgaacttcacttaatttaggtgaggttaatggtccaaacaatcagctttcagaaatatatctagaagtgagaattaggttgtgaaatcagatggtgagatttagaggcacagaaaacagtgttaacaaaaagggaatgcagtcacagagtgtgatgtaaaagatatgtagtgtgaaaagtactaagacgtttatcggtattattattgtgtcactggacaagttcacagagctattttggggatgactagagcttctgaatcagagctcatttctgttttcagaagattatgaatatggagactatgccagactgtgagcttcttgaaggcaggaacatcaaagtctgcatcatcttttatattcctagcagggtccgtgcatggcacgtaagtgatcttgaatgcaggaaaagcatgagtggttggcccaactggctattacaattagtgttgttttcacatgtaaaacaattcatatgaactagtaaatcattcatcactaagtaaagcattcctcaaatcacaaaagattattaaaaaaattgaattctggcattccaggctattagtgttagccttactcactgaaaaattaaagatagtgggtctaaattcctgtaaatctgtacaagctttctgtaaggaaatattaatataatgatggtggtggaaaaatacttgtgtttaaacaagaattactcgagaaacccaattaaacatgcagattgaaaatattgttcagaattaatttccagaaaaaatttaacttctcttgatgaactggcttgctttttcttcatgagtactgagaatcctgcaatttttttttcttttaaaattttggctaccaaagcactcagaacttaatttacaactcaatttttctaactttttgggaatttatgatgtttatatctatcttctaaatttcttctggtctttaaaatttattctgatttttctttttcctggtcctggtgttgtttttgtattgcttgtatttttctttcttactttatgtatttttcatgacatgtcaagctttttgtggaaaatggagaaatcaatgctccatatgtaaacgtatatattttgattagattgctattcttcttttattcaaggccaagtgtttgtgaagaacagcaagtgactgtggttggacttgcacacccatgtgtttgggcattcacacacattgtcaagctctgcaaacaaggctgtactggctcaagttggtatgtgagctatgaaagaaggtaagagtgcttctgtactctttgattattgaaaatcaacaccaaacacctcaaatgcacctacatattcatccaataaattttatgctcattaagtaaatgtgcataagatgtggccaccaagaacatttagagttatatatttttcttcagagacaagatatattattactttagacctcatttatgtctgaggtattttgggttagatgccactaattttacctcatggcatggtgtaccattgaaagctaaagatcagaaaactgacagaaacaaggaatattgtgttggtttgctaaatttagcacgacttggatccaggggatctacagttgtgaaccaatgtctgacctgcccttggtactcttgtaacactttgaaacctagagcttctttaacttttttatggcctttgaattaggattaactcggcgggctagaagaggagagaaaaagcaagtgtccacaatgctttctaggcgtcaaggcttcatgcagacttttttttcccttcaaagttttgaaatagttttacaaaatatctaagaacctcttaacacaaatagttgatgatgggttaaggatcaaaattcaggatacttaatgttaaaaaaaggtgtggtttcagattgacaaagaatttataattactactattattgctaacacaaagttggggacatttataaataactgggtttgccattgtataaaaatattggatcactaataatataggactaaataaaatataagactaaataatttataattgtggatgtttacatatgcattgtgtgtgtgtgggggggtgtatgttgaacctttagatgaatagtttttgtttttcgtctaaactcaggaattttgtggggtatttttagagatagggccttgctctgttacccaggctggagtatggtgccataatcatagctcactgcagtctcaaacacctgggctcaagtgatccttccacctcagcttcctgagtagccgggactaaaggtgtgtgccactgtgcgcagttaattttttaatttttatttttgtagagacaggggtcttgctatattgtccaggctcatttcgaactcctggcttcagatgatcctcccagcctttgctggggttataggtatgagcaactacactaggccaactcagaacttttaatggtgtttaaatcagaaaatttcccctggctcttcacagctgtgtggccttaggctaagttcctacatttctctgtgtcttagttgtagtgttaaaaaaaatgctgtacatggctattatgaagattaattgattaaatcttcatagataagatttaacacgtggcacaatgcttggtacacagtaggtactcaatatgtgttagatagtataatgctgtagcagaaaaatttattttcaaagaaattagaatggaaatcctatttatagggtatatgacgtgttcattagagtacttgttttgaaaatggctttttatttagactttttgtactcccccccatgagttttaatctttgttggtaatggaccgaatcaaataaaattcattaccttatagatacttgggaaaacaaatataaattagtaaaacaggttttatagttttattcttaagagattagtagttttgcacattctgtgtatgatactgagtttggagtagaggcagtgtttgaagatgttcagcatctttgccatgctcatatctgttttgtttgcatgtaagtatacaaacttatacttaagtcctgattgaagagacgcgtgaacaaaatattaggttacaattctagatggtgaataattgtcataaaaatggtacagccagtgagtccaatttttgagaaaagagaaagagcaatctacattggcttggtaggaaaagagaagttagaggaagtggaacttgaaattgaccttgaataatgaaagcaatttggactagaaatataggggtggcatatgaaagggagagaatatgttagtacttttggaataaaaaaaaatttaaaaatgacatcaacttgacagaaaggaaatcagcctgtctggagatatttggtattatgatctgctgataggtcagcaaaaataactcagtgttttcaaactttggtttagtattcccccctaaagagcctttttaaacaatttttttccctgaagcttccttctgcaccatgaaattttaacattacacatattctttatatccatttatgtactgtgttcctttgtaaggtcacacaccattgtatcaactaagattcttttcatcccccactcataacaataactaattgtcaccttcttgtgggtgatattaatacggttgagagtgcatgccgtagtggagccaacctatgaggagctttcaatatcaaattgaaaagcatgtacctcattatctttcaagatttcattattcttatcataattttgggttttattcttgatagcttgagcaatccttaggatattttataccatgggatatgggggtccctcttggttttcattaacctatacctataatgaatctgaattgcatatggagtgaggtatgtatgtgtgtgtgtgtgtataatatgtacaaattatacactatatgcacattggtacatttatctatatatacacatacacctatctctctgtctataaacacaaatatatatggcaggatttgaattggagagagaaatttctaatggatttgagatagctctgccttaagagggagcactatatctccctaatttagatccctgtatttgttaggcccggtactacaccatctatggacaggtgtacaacatggagcagcagcctgtctactggtgctgccctgtttggaaccagtgggatgatgaactgggatgcctacactgtaaattataattcttcttgtctaactctgttacgagaaggaatgatttcactttgtttttgacttcaatcatacttgtcaagtttttccgcatctttagtatcactgcagattcagagcatctctttgaactgaaaattcacacatgatgtgcaaaaatgcacaaaaaacttttctgttaagtgtttctaatgataggtcacaacgcaggacccatgaaagtgctgctttatattctctctttatttaaaagacagttgatttaaaaccagacagtttacaccttgacttccatctcctttttctgtttgcccctttcccatatcatcaaatttgtaatccacagttgattcaaaagtctggagggaaatcatcgtactaaatctaaatgggatttctcaacttacgcttgtcatgattaattgcagaacactggaggcagtttactttttaagatgaggtatgcaatcctttaacaaacctctggtgagagtatttcagaacctttggagtgtgtttgacagcactcaagtagcagaactagtggcattatatagtttattcacaccaggagaaatggttcagtttagcaaactcctttacctatattatgtatttatggttattgcaaagtcacttaaaatgcttcagtgtgttgcaatcaatgcagcaccacagcacaacaattcatctctcttgctattctgtaccttggggagtttgttggcgtcctgtttccttccccagtgtgctttctgcccttgaaacatcttagtgaagttatcacaggcttcccatgttaagcaggtttagtggtgaggggtgcaccaagggtcactgtgtatttgcatgcagtgctaggccacggccactgctttaagcttattgaaaacatctgttcacggtgttattagcttaaactggttaaacctcagtgaaaacatcttcccatgatgtcatcttaactatgttataaactcctggaaattaatgactatgagatgaattcttttttttttttttttttgagacggagtctcgctctgttgcccaggctggagtgcagtggcgcgatctcggctcactgcaagctccgcttcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccacctcggcctcccaaagtgctgggattacaggcgtgagccaccgcgcccggccgagatgaattctttatattgttgtatgacacctattagtccttattagcattttttgtttgatttttagattgttttgactacacattattatacatagaatttttttagaccaatatttctgaaatttgaatgtgaatacagatcatctggaatcttgttaaaatatggactccatattaggtctggggtgggcctgagttctgcatttttacaagcttggaggtgatacagttgcttccgcacagagttctgcaaggttttagacagtaaggccttaactcataatgaaaacattgtttaaccttgctgtggaagtgttggtggaaatttctagattggtgcctatagtgatgattttttttctttctctcaactctattctccccactcctcattcaaccttcttttagctatcgctgcagtgggaacttgtttcaatggaagaaaatgctcagatggtgaaggccagtagtgccagtgttcagagggatttcatggaccccactgtcaataacagtgagtcaccaacaagacaattttattatgatttggtgctgtttgctttgcttttaggggccagccaaatttgtcaattcagactaatggttaggtccttggcggggttggtgagcatttaaaattagccactgaggaaaacctctagcttatagtgtaatcaggcatcacaaaatatgctttgtagtttagttttaacgattcaccattagagttcaaaggggagcagtaagtacaaaacacttcattttgtaaaggaaatggaagcttaataataagtaaacctcattctgacctcagatgttagatccttcatggagccatagtttgaaattgctggtacggtttctctgagatctctgtggtatgtgaatgcacaaaatataattaacatgaagttgttgttaataaattcaatgaatttattaacaataaatttattagtaaatttataagtaaactaacttattagtagatttactacgttcatgccatttatttaaaaaacaaaaacaaaatacctgaaacttgcatgattatcaaagttccaatacttcataacctagttttcaaggttggaactttatcaactgtcaattgtggacaggtacatttaaggtgtttcttgtgcaggaagtttcccggatggccaataatttatcctttactgcatctgtcataagactgggtgatttcaaaaggctttgttttgacttactcatcagattctagtctccagagaatgagaatacatctgtatttatcttttcagagcaggaaaaacaaaataaaacctatcttatagaagttaaagaaatagatacgaaaagctaaccaaaatattgctttcattatcttctgctgacatgtttgctttctcgtatccattacttgaatctttgtaagtgaaattggaaggttgctgagagctcatcactcatgtccatttgtctcctctgcccttggcataaggttaagactcaggttttccatggtgacctcagagctattcttctaaattaatcctgataatctctttgggttgcttgctagtttttgctttttttttttaaacaaaattgtgaattaaaataaagctgatttttaacctcaatttattctttgactatggaatactgattctgaaagaggttagtggatgctttgagctctaaggtatactttccactattttcattatttttaagaagctaacaaaaatcatacattgatccatgttaacaaattgtttgcctttaaataaagtatttcaactacatgtgcaacactggttcccttatcttgatcaatagctgtaatgggcaattacacatatcactgattcattaggactttaaaaaattaattattactttataaattcatttgttttggtagagcacatcttgcaaaatatcaagtcctggaggggaaaggtaattaaagaggcatatggtaatgataaaggcctagaaattatacctggatttatttattctttatttcctacactagtagtcagatattttcattattccatttcttaacactttgtgtaccaaagtaattaaaatgttttttgaaattcaggtagctagtattcttatttttcagttttgggttggtgaaaatactagattattcgagacatattagtgtttcttttccccaagtttgtttgtataccctaaaattccggaagtcatgagagaagaccaatgatacaaaacacctttcaggactctgcattgcattttgcatattgttgttgcccaagtgtgtttacctttagattttggcaatatttcttcttttagtgtagctctcctattgaatttaaaaagaaatcgatgatatacaaaagaaattggtgatacattctgagggatatattacaacaataggaattcagacatttcctacatggtattgcatttcacctgtcaaaatgagatatcaaaaagtatgtaaatttcagaggtttttatgaatgaattttgaagacttcttaggaaatcattcaaacatttgggaaacaagtgaggaaccgagttaagaaatgacattagttgaatcttgaaagaaaattaaaaattaaaatcagcaaagactttaaaaaattattatagttgttagaatatgtagtctatcaaacaagttgattatagtctggtggtactgcctataacctagctcttatttcagtggctggatttgagttctgatatatgagtacataatcctcggtctggtctcgttctctctctctgtatatatatatatatatgtgtatgtctgtgtgtgtgtatgtgtatttatgtgtgtatatatatatacacacacacacatagtatatataatcacaatgagaataattttaattttgtgtttcaaatcatataaataataattgaggcaataaaaataatttaaatcaaacaattttaaattatgaaaaagcctattatatgcaataaaagacagtaaaaatgtacagtcctatcactttcagataactgtggtggtcatccttttatgcccatttatattcatacacacataaaatattacataaattagttcatatcctatatactgttttgtcatgaatgttcatgttttttttcttaccttcccttttcttcccttcttttcccctcaaacttctcctatgcccagtaaccaacctgttgaacactcttgtatctttctctgagcctatgtaatcatatacaaacagatgcacatttcatatcaatgtaccacagatttttgaccacctatttattgatggatatgtattttgttttcagttttttcgcacaataatcaatgttgcaataatgtggtgttttacattttgtgagacaaatttctagcagtgggattgttagtgtgaatgcatatgtgtatttttcattttaatatgctgcacttaagcatcaaaatattcctttaaattatttgtaagatgttttatggaccatggtaatggctttactagtttatttggttgggatggattaaaatctaggtaaatcccaattatttacttatttttaatatgctaatataatgaggaatcactgcatcttcatccaaatccagggatgtgtcacattaaattatctagggtcaggattattgtaaacatggattgctcttattattgggtaaacttgactttatttgagatacatagaaaaaagaagtctggaaaataaaccggatggccttttaaaaatggagaaaagactctagtcctagagagagaagggccatgctaataactgagataagtgcttgaagttaataatgattctaaaattgctgatctgcttaactcatttgaaaaatctgcctctaataaggaaaaatgaagaaaatgaatttggacaattaggaagtaatgaagagctttctaaaatagctattgattaaaggaatcaaaagaaatactttgaagatttgaacacatgcaaatcaggctagatggctggtggtgaaattttcttttttatttttacggatccaggcagaacaacgtggagcttcattaactggttaatatcacacacaaagtcacacctcttctcatcacttattcagttttccttttctctcttcagaagtcaagttaaataataatgtgcctggccaggcgtggtggctcacgcctgtaattccaacactttgggaggccgaggtgggtggatcacgaagtcaggagattgagaccaccctggcttacatggtgaaaccctgtctctagtaaaaatacaaaaaaattagctgggcgtggtggtgggcgcctgtagtcccagctacttgggaggctgaggcaggagaatggcgtgaacccaggaggcggagcttgcagtgaccagagattgcgccactgcactccagcttgggcaacagagcgattccgtctcaaaaaaaaaaaaacaatgtgcctaatggttggattctaagactctgaggtcttgtttctttttttcttttattctttattgtaattttttattcatctattcaatcttcctattagtcttccaattagttattaaatatttatataccaggctgtgtgctaggtacttcagagaccaaaacaaataaggtatccttaatgtagtgggaaatagagagcaggaaaccagtgattatgatatagcccacaaatagtatgatggagagagttcatctatgtcgtattgggaggtgatagaaggtttctcaaaagatttgaaaatacaaactacaagtaattcctaaacatgagcagaacaagaatatgaaattggtaagagagaatggtatattgcccagagacataaaatagctcatccagttcaaggaataataacaataatactggctgggtgcagtagctcacacctgtaatcccagcactttgggaggcagaggcgggcagatcatgaggtcaggagttcgagaccagcctgaccaatgtggtaaaaccccgtctttactaaaaatacaaaaattagccagacgcggtggcgggcgcctgtaatcccagctactaaggaggctgaggcaggagaatcacttggaactggaaggcaggggttgcagtgagccgaaatcgtgccactgcactccatcatgggtaacaagagcgaaactccgtctcaaaaaaaaaaaaaataacactaataatactagtagtagttctcttgactgcactaggagattcatgtggggcttgacaaaaaaaaaaaataataaaaatagaacttttttaaagtccaaggccagcaattccttagcctttcttggtccagccagaccagctatttcagaacattatgcagaggtgcctgagggattctgcaaggactttccttccctaagtccagttctctgaacaggaagtcctgcagttggagtatcttgagcattcaacagtgtatttgttcattctcatgctgctgtgaagaaatacccgaaaccgggtaatttaaaaagaaaagaggtttaattgactcacaactccgcatggctgggaggcttcaggaaacttacaatcatggcagaaggcacttcttcacagagcagcaggagagaaaatgagtgctgagtgaaggggaagccccttatggaaccatcagatcttctgagaactcactcactatcacgagaacaacatggcagaaaccgccccccatgattcaattatctccacctgatcctgcccttgacacatggggattattacaattcaaggtgagatttgggtgaggacatagagctaaaccacaccaaacagtactgtttggtactctactcttatgcctatggcagagtccccaaatgtctctgttacttcaaagcgtgatacttatgtacattaaaaatgggatattgctggaatgctgtctgatgacatgaaaagtcctcaggagttctggggttgagttcgggtctcaccaatgaccacctgcattatcttggagaagttattttatatccctagcttcagtatcatcatttataaaataatagctttaatttttctgagcactgactatgtaccagatactattttaaatgatttgcctgtaatacattattgttacagctagtttatgtgatgaatattcttacttgccccgcttttgtacccacccaaggcatgcaaattgttcacagtcaaacagctagaaagaaagggatctggatccatatcaatatattcgggccccagagcctgcaaagccatccatgatgactttataataatttctgacataatcttctgtcttccagatcgttatttatgagggttgtatgagataccacatgtgacttctaagctagaaagcattatctaagcattgcttcttgttcattgcaaattctctgagaatcacaaatgaagtacagaaagtaagagaagaaggaccccactgctgctttgtttcccactgtgtgggaaatctgaacaaaccttgagttttgggtcacaagtatgactttgagccaaccagtaggttctagtcaaggaatctagtaggctttctgcaggatccatctgttctgtgcagaaagaatgtttggtcaaaggatcttcttaaaatgacatgtctccaagagcactgttaatttgggatgtgttatgggttgagtcctgttcccccaaaattcatatgttgaagtcctaacccccagtacctcagaatgtgacctcatttggaaacagagttgtggaagatataattacttaagatgaggttgtactggagtagggtgggccctgaatccagtatgactggtctccttataaggagggaaaatttggatacagaggcatgccgacagcgagaatgccatgagaagatgaaggcacagatcaggatgatgcagccgcaaaccaaggaatgccaaagattgccatcaaaccaccagaagctaggtgataggaatggaaaattttccctcatagtgctcagaaaggaccaaccatgctgacaccttgattttagacttctagccttcagaactgtgagacagtatatttctgttgcttaacccactcgctttatggtaatttgttatggcaaacagatataggatgttgagaaaacatattctccttattcgcagcttcatttcagcagttggcctattgaaacaatgaaaatgggaagaaaatggcagggggtttataaagagcaaattatgctaagaaaacttgatggcttactttaattgaattataatattagtgtgagaaggagagttaatttagaaaaaatgcaaaaatcattaattgaacaagcttatgaatctgcaatcctaaatgagcgttactaggagatactatgaagtgaaatgcagcttttaacaggttgaacatttctttctttcttttttttttttgaggtggagtctcactctgttgcccaggctggagtacagtggtgcaatctcggctccctgcaacctccacctcccaggttcaagtgactctcctgcctcagcctcctgagtagctgggaatataggtgcgccaccacacctggccaatttttgcatttttagtagagactgggtttcaccatgttggccaggctggtctcgaactcctgacctcatgatccttccacttcggcctcccaaagtgctgggattacagaagtgagccaccgtgcccggcccaggttgaacatttctaattagaaaatctgaaatctctaatgccccaaaatctgaaactttttgagtactgacatgatgccacaagttacactgaacccattattttttcactttattaatgatatgttgtattttttactgttaagtacttatgtgtgaataatttaagaaaattacttatgggtagcgtataaattcagtcaggaatgatgatggtgccaaacaaccacagattgtccccaagagtggttgagatagtgacactttgctttgtgatagttcaatgtacacaaacttttttaatccaaaaagttattgaaaatcttatgtaaaattaccttcagattacatgtataaggtgtatataaaacataaatgaattttatgtttagacttgatatttcattatgtatgtataaatattcatccccatcccaagataattatgtatgtgtaaatattccaaaatcctagaaaatatatttcattatgtatatgtaaatgctctaaaatccccccaaaatctgaaattggaaacacttctgatcccaagcattttggataagggatactcaacctgtatcatctagatatattgatatatgttcttagcgtgagctgacagtgttaaatccagtgttactttgttcatcacataaggatgcattggattagagctcctatcagggttgtagcaagtctataataaggcaactatattctgctttatgtaacttgacagaaagtatggcagattgatgggaattggagcaaacataaaaaagggatggatagactgtttatgaggaagtggagtagtaactatctgacatcttcctgtgtgcccagtaaaggagcatcctgtcatttagaatctacgcagaagatttacttccctgacattgatttgaaaatagaagctttggaagtgtttttactaacacactcttttaggtatactttgcatggccagtgttagcaccatgagaagtagtttaaaaaagacttcatgagaattccctgatattgcaaatatgataactttagagaatgacctagcactatccagggtaatttgattctacacagtataatgggtggtgaactagaacatgtttaatgtggatgatagtgacactagtagctaactcataaatcatgctttctacatgctaagtactgtcctaagcgctttacacgttggcttatttaatatttagaacaacccataatgtaagtgctgttaatagtcttcttttacagatgacatgctgaggtgaagagaagttaagtaacttatctgagatcatacaggtggcaaatgatgaagccaaggtgtgaagtcaggcaatctggctcccaagttcatccttgcaaccactgtgcaatgctgtttcattaacatggaagaacgtgtttgttatgaaaaacaaaactgatatcatttctctgaaagggatataagagattttatactttatttttagtgtttgaacccagtcagtattcttaggaaacagtattcctgtagaaagtatgagctaaatgattatcttcatttaaacttttgctcattatacatacacatcattgagtgattatttaggacctgtgtaaggtgtacctaactccagtattgaaaagcctaaattcccgttatggggacaggaaaacaaattgtaaagtgatgaatggcatttcaggaatacattcagcttgacacaggaacgaggtcgtggtggggaacgggacttgccaagttgtggctcatatagctggatgttaatattatgacacacattattgccatgccaaatagtttggatctcaactccttgtatgtgtaatgccactgaagattttaagtatattttaaagatgtagctgtaatagaatagaaaggggatgaagtcccaaaggaaaagaaaatgttatataattcaaatggccaaatctagcatgtatagtagtcactccttattcaagggggatacattccaagaccctcagtgggtgcctgaaaccaccgatagtactgaaccctatatatatatatatatatatacacacacacacacacacacactatgttttttcctataaatgatgcatacctaggataaagtttaatttataaattaggtacagtaagagattaaaaataacatattaaaatacaacaattaatataccagaataaaagttatgtgattgtggtctctgtttctaaatatctctgaaagatatttgggattaaatattatactgcacttaccctttcacttcctgcgatgatgtaaaatgataaaatgcttatgtgctaagatgaagtgagatgaatgactgtggccttagcttttgcagttagaggtgcaagaacaaaactagcacaaatttcttcttccttcttcctagtttcacagaagattcattcttactgtagatcttagcaacctcggtatatgatttttctttctttccttaagtcaaaaaatctcaccttttacttagatgaagcactttatgatgtcacttcagcatatttaaattgccagcatcactactcttgcaccttggggacattattaagtaaaagaagggttacttgaacacaagcactgagataccatgacagaagatctgttaggagagatgcctattaagtgaccaatggacaggtagtaaatatcgtgtggatacactggatgattcctgtctcaagcagaatgaagaggactggcatgtgatttcatcatgctactcagaatgctgtgtaatttaaaatttataaattgtttatttttggaattttccatttaatattttcagacctcagttgactgcgggtaactgaaacctcagaaagtgcaatgttgttgcttgcagccaacagtttttcttttcttgcttgtttttttggtgttcaaaaatcaaacttctcctgttctatgaggtacaaaataagattttaaaataccctttttagtttgtcaactgcaaatttaaatctcattttctcttaaaggaacttgataaaaagtttgaaatgaaattctgagtaagaaaggtaatgtgcttttactgcagaagccaatattctgcacttgctatttcttgtaataatatatcttccttgccatttgaatttgaagtatatgatacctgtgtgcacttgtgtgcttgtgcaattttactcattcttatttatttctgggtattgtgcaccagaaatacactaacaatattaccaacaacaaagaccattgtgatttatcacttggtttggtaggggtaatttcacttattagttatttttgtaactaaattccttattttttcataaaagcctactaataatggttgtagctataatggaacattctactattctctattggagtttaggctagtcaatgttagaaactacgaacatgataatcaatcattaaaattcccttaagtgattagagtattttatgttgggtaaagaagatgaaacttgctcccaaagttctctgctctcaggtcagtctggtgagtctggcatttgaagggtagaggtagaagataggaggaagcagctgatgggcctgccaccaatgggttatttttcagataggagggtcctaggaacccagataacctggtcagacttttttgagggtaatttaataatacacttcctgagagaggcaaattagaagaacagagaagacaaagccaaaaattgaatcctacataagacaaagggaggagagtagtgacagtcaagagaatagagaaactcaaaagatattaaaggtacaaatgtagctgcacaggttaggatctcggtctcaacaggagctggacactctattggtcaagaacagtaaaaagttggatgtgcaggacatgatgcattattattatatatttttgaacatgaataatctgctctaatgtactatatttctcaaaatttattctctggatcgctgcttccgttgtattttaagaagtgttacatgaagtaaagtttttgtgttcaaataagtttggaaaatgctttgttaagtaacctaacatactattcattcttgtaaggactttccagagtctttaatatgctaatgtatatttttactcccatagaagggcatatagatttctgtgtattcaaacccatttgactctgtagcctttctaatggggatatcttgagtattattatttcatataggaccaacatgctctggagaatacacacacacacacacacacctatacatattatatgtaatatacacattatatatcatagctcttaaattattatatgcatatataattataaatttttttcaaaatgctcaactaatagtaacatatatgtatagtagttaaaaaaaaaacatttaacaaggtgctttcctgtatgttacctcatttaagctcacacccactctgtgagggagctcatattctcaaattagagatgaggtaacagagacccagaaagcttaattgatttggccaagtcacagcttgtgagtagctgagccaagacttcaactaagatctttaactctaatgatttatggttttgtcccacagctacctagggataaacagggcttgcaatgggcccttccttgcctttttaaaaaaattttattttatttaccatcctgtgcactgttctggctgagaaacagaggaagcagagtggagttggggatgcctttctcatctttctccatttgtgttctcatacagttttcataattcatatttttgttcttccttcccttcaccaataaaactttacttccatcacttttcccaataagcaacttcaaactaaagcattcatagatactactggttgaacatatttgcgttttaatgggggcctctgaaaacacaaaactttacctgcatggtgacagagctctggcagtcatcaggagggagatcctgctgggtaggggagctttaggaatctctctacatgtggtgtgcaggctgctgttcatgttgtttctatcttgaggctcagaactggctgtgtctgtcccctcccaggcaggtgctagaggttggtggcagtccattcctttgtaattgccagtcaacctgagagctcctgctgtatttgccccaaggacataatgccaaggtctggatctctgaccaagcatctttctgcatttcatactcatcatcactccttcctttgcccccacacatatcctcctataaactagctttcttaacatccgttttattaaataggtctcctttgaccttccaaattcctaaggccatagttacaatcataacaagtgtgtttaccattaagataagcatcctaaataaaagtcttaagagaaaatgaaggtgtgcagtagaatttaactttactccaaaatagttctctttgacctagattctaggaagtaatctctaagcctttggacatcatacctgataagagcatctttgtttgcctggagacattagatcaacagatattctaataatattatttgtggtgggggctcgacacacacttatagtcttatattgggtcttgctatgccagaaagaccaacactgtgattgagggtagggctttggctcatgccctgattgccagaaatggagactgaaataaaccacatcaatagtcaatcaatcatgcgtatgtaatggagcctcagcaaaaactcaacaatagagtttgggtaaagtttgctggttggcaatagtctatgcatactgtcacatattgttaccaaaaaagtaatgcattctgtctccatgggacagacggacaggatgatggaagttccacttttggtagttgctgtattctaccctatgcacttcttcccttggaggattttaatatgaccttttagtgagttctatgagtctgtctagcaaattattgaaattgagggctgttttgggaatgcccaatcttgcagttggtgtcagaagtgagggttgtctcttttgggaactcttccctctaatttctcagttgatccaaactctcacagaatgaaagtccctacacgtttttcttctccttcaagattaaagtgctttgagtctctgttttgtttccttgtgagtatggaacgcagagaaaattaagtagcactctgtggctgatcacctgttcaggatgatactagatgagggctttcctcattattggtgaagaacaacagtgtctggactgcctcaatagtttgaaagtaatggcttaacacacccatttattgaatccgatggcaaaccacagaagacaagcaaaaaacattgttattataatctgttattgctgaagaacactggagataggggggtgtgggggagtaggagaataaagcacatgagatctgaagttttaagatcctgcctgcatcttgagtgaacatttgttgaagtcattgtaatggtttaaaaatggttctcagactatatgctaaagaatatttaacaactggaaatgtagttatgtaacttaactaaaggctatttttttacattttgacagaaaagatgatatgttttgttctgttgcaagttctagtgacccctgcttagctttcatttatcacaagtaatcttctcccggatactgcaattgctgcaatgttgagatgcttatattacatcaaccttggagaggggtcaaaataaatctgtgaattaagcaagaatacattacagctggctgaaaagtgtgtcaagaataccctgaagagaaaaataaaactatttttttccctgtgtacaagttgttgtggctccttgtctatctacttggagtttagtaaagaaattctgttcttcatcttaattctaatgtgggtaagtagagtagataaagcatatggttgcagctgctctggagttacttgcatatactaaggaaggactactcagataaagcatcggctgtgataatctccatttacacagaaacaaaaacatacaacgaaaacctcagatagcttgactacataaatatatgattggcagtgggttcgagagaattctgaacatcaggtaaacccaatggtgacttcattgttaatttagggaattatggataaatgtggatggcacctatagagaaagtcatgttgcaaaaggatacaagaaaaggaatgagcaagatggacattaaaattgaaaggaagcaaatcacgcagagagtttatattcaaggaaatgaatagaaataaaaactaagacaaaatgtgccaatataagaaatataaaagttgatatatttgtcatatcttgaaaaatgtgattcaaagtctctgttttgatatttttctcatttagatagttttattttatgactatggacaattaaagaaggatgaagtattttctgtgagtaatttctcaatagtttttttatcacaagctgtgattaaaattttatatatacattagggaaaatactatactttagggtgaagaatcctttttcatggctaattaacaaacaagaaaagttagttatgtaacaaaaaattaaagctggaaaaatctaatagtttaataaacatgaaattataggtgatgttttgcatgattcagagtcacttatgtactaaaaaggaatgaagaagcctttaatgaagtagacaaaataaactaggaatggactgcttagtcactgacaagattatacttgaacaaagggtagctctactgctctttgaagatgctacatgctcatttatttatacatcaatgcattcagtttattcattaatttaacaaatcattgtgccagacacttgcctagatcttttgatcacaaaagtgaggtgctcttaatggttataagaaattttcttgatggttaacagaaatggttaaatgccttctgaagctttattattttgtttggcataagctaggagtaaatattttattaccttttaaaatattttgaagtacttctaaaatatttgtgaccttaaggttatcgtatttttcagagaataggaatattcttcagacattctggatcaattgtgttttactacaagggaataataaagattaaattcaagaaaagtagtgatgacagcaagcaaacaacttttcaaaaatcaaggcaagatggttcccattgttactatactatggacccaaaggtccatatactatactatactataccatataccatactatactgtggacccaaaagtccattgttactatactaaaaaattttcctgtttaaaaagatattgtcatgttttcctacctgttatgtggaaatgtagtgtatcctatcttggccctgttaagtcctggaaaaaagtaatcaggttggacagaaaacaggcttctaagacatttctgtgtttcaactgcatgatggttcttctggctgcagtttatctcttttgtaacatactgcctgtgagaatcatctggggatcaataagtgagactcaatattgtgatttaaagcagccctttacattaaaggcagtattttgatatctaaccattaacaacatgactgcatatggaccatttacctggttataaaaccatttttgctgagcgaaaagaaaatggatggaattcagtttcggaggcttaattaatgtggctacttcttcaatttatttgtttatttatttatttattgggatgatattgagccctactttatttgtaccctttttaaaccaaaaaaataactttcttcctaaggaagttggtttcttttcttcactgaagatgtacagccagattatgaatgaccacgtggtaggagtggcttaaaggaggttgcaatattagaatgaatagtaggaaaaaaataacttttaagacctcttcaaagtctaagggtctatgatctctggattgtgattttgagggcaggactgaatcttagcatctccatctctagcccctggcaagggacctaaaacaaactgagctttaaatatgtgtgttgaatgagtgaattaatggattaatcagaatttcatttaacttgtttattgattatcgtgcagctttaagtttcagactgtaaaggtgggcttaaaaggcattttatttttccttgagccatcatatcggtggtttgggttgttgtctcacaatgaacaggactgtagggctgtgactgtctgagcagctcagctgggctttttccagggatagatagcttagtttcacatcataccaccaaactcaatcaataacgttaacttttgagaaataaacctttttatttaaataaaacatttatataaaccagtgactaacattggcatatgtttttaaaaataccaaagctcaagagcacaaaacaaaacaaaaaccctgaagaaatataaatatttagcttcaaattaaatgccatcactaaatttcagaggaaactaatcactacctaatctcactcctgtatcctcccagagattaagtaaccaatttattccaaaattttttcggagttaacaatcttcccagctgcattcatggctccacagtgctttggggctacagagcaacttgggcatcaaagcttttgtatcagactttgatccttctcttcaggttagacctttttctgtctgcttgcaatttctcaaagagaaggcattaataatttgctgttggaagacttccaatgttgttgtcttgtttctttgtctactctgcaacttttgttttctcacaacaagaaaaagcctgttttgacaccatgtgcttggctttagcagcttggaggaggattacagaagcgctcctgccgccttctctagcatgacttccctgtgttcgcattctcactccacttgacctgtttctcttacctaattcctaacccctgtagccagcagttgtgaagttactttgcattgaattaagactgtatttttttttttttttgttaacaattcttgcatgttttcagcagttgtcagggacagtttttcaagttggaactttaaacaaaaaaaaaagaagaagaagtctgattttccttttgcctataaacattttaagcagaatataactaagttttataatgtagatctagtaggttactaaatggtaattctggatgatgcttccttcgctgtggacctcagtgtgtatttattgttgagtaaaaactgagagtgagaatctcagatgcttgcctaatttctttttactgattttagagtgaaactattgggttgaaagaagggaataatatgtatttatggcttatggttcttttgtattcttccaaaaatgatcttggtacttagatggaattgtaatgggcatatgaaaatgagatctttttccacgttgccttatttcagactgaaaatagttggatgcaaatcttcttagtataaatttgcctttgatgtcattgtttcatagtctagatgtgtccttttcacattacgtcttccggcacactggtgtttggaaagatattttcatttcctgagctggtttgagtagaggactctggtctaccagatgcccctgctccacagttgcttacaaaatgcctgtatgttttgaatgtgtgtgtctgtattctcaggcacagactttggaaagcatctctgttctgaccaccctgcagcattcattattttcagttctgccccttttggaggtcttgccacaaagaggcatatgtataaaacgtttgctagttaactgttgacaatttgaatgtatgccaaagttctgtaattgaagtatttcttgaattctatggtgtatggaaaacatgacttatccaacactgcaaacataattttatatttgaaaacaagagggaagcagacatattttgaaggtgagatgttttaaaaagatgaaccaagagatttatttgaaaaagttagtcaaggatatgaaaggaaaaagtctgccaattttgtttgtggttcttcaaagctatttttcctggctggatgcaattgcaaaaggattgattaaaatcatgctgagtggttttatattttctgtatttaaatgggtgagtaccaggcataagcttaagaacagatataatagagccagcccattgctgtagtttattttaatctaaacccccacgtagcctccaatttcatgtataatagttaaaatatatcagttgtttactaggtgccacacaatatgatagtgttttagaagacagtagtgcatttttcttctaatcaaagagagcatttttcttctaatcaaatggaaaagagatactgagtgtgatattagtgtatttactccttatagcagctctatgaaaaatgtatttgttcatcattcctatttcagagatgagaaggtggaggcaaggggcaattaaataaattgcccaaggtcagtataagtgtgggtaatgagactcaaatggagatcccatgatcttatcatttttgtgcctctttgacctgaggctgtgtgaattggaatttgcaattgacactgttatatttcctgtcccagagtgctcctgtcattcatcttgttagaggtcccatgtttcactggataatgcaaattcaccttttctcttgtttctggcttttaaaatgacacccagccaacaggaatatcttctatagactggaagagctgtttcagggtttttttttcacgttataaatcatagtgccatttatcagaaatagttttattgcttgaaagtgcacttgccacagattcaaatgctttatgggacctgtttacaagtgaggatcttctgtcatttttcactctctttaaaaaggaaacggaaaaatggtgattgaaaaatcatcagccagttaagttccggtggtaatagtccatcttgaagaagcactcacaagtttctgaaacttctgcagctgtccattcaaagatgcagggagatagacagtgcacaaaatagcaaacaaaggcactgctgcctgctggagaattgggatttcattgtgtgtgtcaaaagtaaatgaattcaagaataaccacttgaaaaggaattctcccttaatgtctttggtgcaaaaatgtgctcagattgtactggctctgaagagtgagactcaaagaagtaaattactttctagctactagttttcaattgctactggctcaaagtgctagctaaccttgcaaaagtggagcagagaagaaagcagtttgcatttttctcctaatcaaaatggaagagagtgagtgagataccatagtgtcacagagatttctgatggcagaagtttataaatagtcataaacatctcattgcaagtctcaacaagaaccacttaaatgtcctgtatacatttttcaggcaatttttatttggaataaagggtctaggaaatggttttgaggtgtgaaaactgatgtttatagagagtaaactgttttctttgaaggcctttcaagtatatattcagcagtcatgtaattatgtaaatttgtcttggacagttaaggcagttagaagctagtactaatgaaatgctcagttatagattcaaccctggtctgggccagtgtgtttcagccaaagagaagcctttagcaaggcccaggaagcatctctgaggcatccctgcaatttgttgagcttctttggtcacaaggggactgaggacataaaaatcaaggcttttcccagaaaacctgcctgaactgcatggcagttgcatcctctgtgtctcaaatggatagaactgaatatactacacattttggaatgaagagggctgttgtttttttcaccagtgaatctgagtatggtagaatgtgtatggaataagcagtgagggatatctttatgatgtgaaatggtttaaatgagtttaagaaatcgatgacttcattcacaaaatgactccaagggattgttcactttttgaatggctactacttttctcccatctgtaaaatggaggcagtaatgtctagtttcaggattgtggaaaggaataaataagatactgtctggggagcacctgcttcagtgtcaggcagatagtaagtacctgatatggtttggctctgtgtccccacccaaatctcatctcaaattgtaatccccacaaattgagggaggggcatgtaatccccacgttttgagggagggaggtgactggatcctgggggcagtttcccccatgctgttctcatgataatgagtgagttctcatgagatctgatgagatctctgtctctcacctgctgccatgtaagatgtgcctgcttctccttttgccatgattgtatgctgcttgaggcctccccagctgtgcggaactgtgagtcaatgaaagcttttttctttataaatcacccagtatcgggcagttctttatagcagtgtgagaatgagctaatacagtacccaataatgatagctattattattattttcaggagcatccaacaaatattagtattaactagaagaaacaaacagtacctttaagtactgatatgaattaatgaaaacactagctatcatttatgtatgaaacattagtacctctattttataggcctcagaaattcaatatgccctactgcattgtagcagacagtacaggatttattgaaggattcttcgactattagtacaatctgattcataccaggtgttgaggagctgaggagtaggcacatatgccatgcaaggcttggatgagaatgctttagagatttaagaagcattaagaaatgaacctaataaatttacaacttaatggcaagagcatcctagaaactttctaggaatggagtgagtggaagagaaggcaaaagaaatgtagactggacagaccagcaggatgatataccctgttgtcgacaaaggggttttgttggaggatatggaacaactccttcaaaagagaatgtgtttagaagttctaggctgaagacctgtttctatgttaaaatctttatgctttccctaggaaagtgactaaatttcctgcgcattgtcatgctcctttgtacaaagaagaaattaaactcaatttctgagttctctttttcctcccaaatctatagattctgtgggtctgagagaggcaggcattaatacaggcagatcttattgaggactaatcctaagtaaacctaactagtaggtgtgctgatgaccacagtgataaacaattgggtttttaaatattaaaaacaggtgtgaagaactacctgttacagaagctgagagtagttaaaactttagggttgaatgggacacagtgtttagttattttattcatcaaaagaaaggaaagctttgatggccttgctggaaaacctgagaaaagtgagaaaagctgaggaaagacgaagatgagagaaaacaagagatggatagatagtggaacagatttagggagcagaagtgcaggaggaagcagagctggctgaagaggggagagctggacttttctccatttctgctttctctcccttagcagacattaatacaattcatagaattccttctggtggagtccaaatttggctccaggatcctcctaaacagcatcttgagattagggaatgagttcaggtttataggctgtaagatttttcaggcccatcttagtacagttttttttttctgtgaaatcaactcttcaccaactcactattagttttagtctttgtaactcctattgcattttcatttctgttatttggcccctgctatggactgaattgtgtcttccccaatttatacattgaagacctcacctctatcgtgactacatttggaaacaggacctaaaaggaggtaagtttaaatgaggtgataagagtgggtcctgataggctaggattagtgtccttataagaagagacaccagaaagcttgttctcttcatgtgcaacaaagaagaggtttgtgaggcaggatggtggctactggcaagtcaagagaagaggcctcagaatgaaacctgccttgctgccaccgtgatcttggacgtctcagcctccagaactgtgagatataaatttcttttgtctcagccacctagactgtggtattttgttgtgggagcctgagctaatctaccctcccatatctgtggtcagtattctagtggtctgaatcttgtcatcctgacaacactttgagcttgagatcatgtcttgtatgtctttgctttcctgatggtgtatacttgacactgaagaattcatagtttgtgaccagatctttactacattttgttcactaactcaggaaattacgtaaccagttttgggaaacttcttgtaaatatatgaagtaaaagttttggtgccaagattaaactacctagaatatatattttattaactattctgaataactggcatgttattataaaatgctgagaacagactaatcaagagggacatgttaattttttgaatgttgtcattttctagtttccagataggcacatgtgcccaagacacaggggcaaacctactgacaatctcagcgtcttctggcacattcgagtgccagctttaattctggttagtgacagctgaaattggatcccaggttgcttgactctaagttgaggcttcctggaatgccaataaaggctatactcttgacttcattctgttctgctggaatttccacttgctgagtttgatggagaaaagcatccccacaatagtaatgcatgagtctttaaatgactgtgtgtcttagtccttattaatgcagatgagactttaataaattatttactgagcacttaatatttgccaggcactattccaagttttttttttatataaactgcttatttaatctctgtaatgtatccacaaagtagatactatcactacttaaagctgaggcacagagtagttatgccagttgcccaaggtcagacaggtagtaagtagaaaagcctggattcagtttcagacagcctgattgcagagtccaatcccttcactacggcattctgtgtctctccggttgagtacaagtcccggaggacttgtctttgattggtttcattagtaaaccaacattagctaatgttctttgccactctgaatgctggtgaaaagctggcaatagaagataattattttctggaagatgagtattacatataacggctgtgtcatcctctgattcaaggcagtagagtgtagtcgttaaaattgttctggaattagactttgtgatgttttagctgagtcctcagatttccagttggtgactttggaagttatttattctctccgtaccttaatttcttcagtctgtacaatgaataagaggaacagttcttacctgatagggtaatggaatggttaaatgaggatctatacaaattacttgatccagtgcttcacatgtagcaagcacccaataaacaaccaccacatcactaccatcattatcaccaccaccatcaaagtgatttggcagaaaggtagtcatgctataatgcctagcagccagttatattctttgttcatcttaatgtgaatgagataagtcaatcataaagttacctaggattgagtggactttttatagacctggttatccaaactatatgtggatctatatctacatacatattgaacatgatgaataattaatgaccccaatgatgatcccgagtagtgaataagaggcaagggacatttatggaatattttagaagtgtttttattaaatgttatatttagggtatgaaagtttagaacctgtttgtataccttaatttttttttgagctaggttgcttcattcccaaaggattccaaataaaaccgattttaccttttgtcttaatgcactaccattttaacatccaattataatatagattaatcagttagatcacaaaaacatgcaggaagtcaggagggcatgatttagccactagtcccagatgcagcttgctggggaggaggactcaagagttttgcagacttcctgcctttgtgcctatcagctatgcaatcttaggaagattacttaacctttctcaacctgttttgtcacatttaaatggagactgtaagtctcaccttgtaaggttaaaatgaagatgatgctgaaagcaaaacacctggtacacaagaagcaacatattcaagtatttacagagaatctgctataaatctgtgctgtctttcagagatagtgaatattcttcttatgatttagaataaatctcaatgtcatgccccatgctgttaaaacacaaccctctcattgccaataaaatgattttaaaagattataggtattttgtagcacattcagtggaggagagttgtgcttcctccaaacatctagacttggacatatctaagttctggtaaatagatatagaaatagccagagttattggtacacagtgggccttaaagcctaagctttggaaaaacattaatatggagggaaaagtctcaggaattagtgctacatatcacccagatgaatgaccaaaccaaggtgaatattggacatgctaaaatatgggattcagaggctgcggtggctcatgcctgtaatcccagcacttgggagtccgaggtgggtggatcacttgaagtcaggagttcgagaccagcctggccaaaatagtgaaaccctgtctctactaagtacacaaatattagccgggcatgatggtgcatgcctgcaatcccaactactcgggacactgaggcaggagaattgcttgaacccaggtggaggttgcggtgagccgagatcatgtcattgaactccagcctgggtgatagagtaagactctgtctcaaagaataaaaaatgggattcagaagaccaacagcagatgatacctaaccaaaatgtcaatagataaataggaatcagagcagatcctggacagaagtgtgtcccctgagctaggcttgcataatgaggtaatgcctgatatccatagctgaactgttaccttctctgtggggcttgcccaagctttttatcaaaacgttacttccccatctctgccactgctcacaactcttgtcctccatgcaactttattacttcctgagcacttaacactgtctcttatactgtgtatcttgtttattgactgtttaccccaacagaatggaaacgtcttagggataggaatttttgtcttttttgctcacttctgatacctcagggcttagaagagtaccttgcatataggaagcattcagtgaatattttttaatgaatgagccacgttacagttcatatttgtgtcattcctagttattgtaagcatatattccatttaggtaaactattgatagtccattgccttctgtagatttagtcattttcagtaagtctattcttaaccctacaaagttcttttggaaattgctaaggaaaatgtgttaactgatagactaaaatcctgatattcataattcctgtgtccagagtaggcagaccaggtaaaagcgcctcctaccaatggtgcctaaaaaatgattattttaacagactctgactgaccatgtatacacaataacaagccatatttgtttcatttattgagaagtataaatattagcctataacatcaaaggatattctccaaataaataaggggtgattattggacataaagtttgccatcaagctttctgaggttaccaaagttctgtttatgctgtgagtctatagaactcacatcccctgtcatggcataagtatgtgcagcagattgtcctgtgtgactccagatcaaacctatgttcattacagtttccttctaggacacttttaacattaaattcaattatgctgtaagtactttaaatatcattgccagtgcttcctatgaaagataagtttttccttcatagtatatgagtaaaagaaaaagcattaaattcttaaaggtaatttttctcatatccaagaacatgtatttttgatttgataatgtgttttaatggaaaaaaaattcagtgaagagtcactgtggtaggcgaactgtcatttatagcttcccaaagtgtccctatcccaatcctcagaagctttgaatatcttaccttggatagcaaaagaatatcttaccttggataatcacattgcagacgtgattaagtttaaggaccttgagataaggagattttcctaaagtatctgagtgcatacaatctaataatttgaatctttaaaagtggagaatttttcccatatcacccacaaagagggtgataggaagatgttgtgttgctgactttgaagatgaaggaagagaataactggcaccaaagaacacaggcaagcaatagaagctgggaaaaaaacaactgaaaaacaaattctcctttagagcctccataaggaaactctgccttccctgcagacaggttgattttagctcagtgagacccatttaggatttcttacctaaagagctataagataatatacttttgttattttaagccactaagtttgtggtgatttgctacaacagcaatgtaaaattaatatagtcactggctgttgaataaacaatacttgtagtatttgttttaaaacttttgttctgtaaaacaactgttagacctgtgcaagtaaacatgttattaagaaaatttttcttgctattaatgtcatacgaattaagtggcttaaagtgtattttgagctaagtatttctatgggtgacattgtaatttaaaaatcagataatttagaaatatttgaactgtgacagattatcttatagtggattaggacatatttcctttgcattcttaatccaaacactatgaaagcactttggtattttttagtgggtacatttcaatgtttgacgagttggcttacatcttgtttacaggcgctggagttaatttttcatgagtgataaattgtcagttaacatgagcttttgcaagtgaaatttgaaactctactaaatgttgagtgtaatattgaagtgtattaggtcaaatggctaaacacaagcaatgcattggcactgattcaacatcctaatgatccaactgcattcctttgcatgaaaagtatttatagtagtttaattcatagtattctttagctctgagttttgtttaagaaggctagtgaagttaattatgttgtctagaaatggaaaaagaaatccaccaacaacccctaagaatgctgctaatgttgatatgattgaattcatagtagaggcagctggatttaattatcagtttgcaatgttgcggtttcagcagcagttgctgaggaatggataatgcaagtagccttcaaagccactcacattagagataaaaaccttgtcattgagtcagacagctgactgaacaagtattaaaatgaacaaagatttcccaagggaagttgcagactaaggtttggttttgtctccttggcttcaattcaaatatgtcagacatataggatttttctcttttctaactcaaaatgttggccattcttagcattagaggtgggtttggggagaggttgagagtgggggcatttagtggcaattatataaatctttggttagctaattactccactctttattcagctcatttatggggagaaatgtagaagagaatccctaggttctaattattttagcagtgttacctaagtatcaacttaagtacttttgcagctgtgactgagtttgctaaaagcaacagtggtgactggtagcagaaatcaaatattttccctgtaaatcaggtttactcaacagcagcactattgacattttgaaccagataattctctgttggggaagggcgggggctgtcctttgcattatggtcagcagaatttctagcctctgtgtgtggaatgctagagcactccctctccattgtgaagactaaaaatgtctctagatattgccagaagtccactgggggagagggtgcaaaattctcctcactgagaatcactgctataagtctgagaggaaatatgcaagttacttttggaaggtacaggtttctcattctaacgagctcttggtgttttcaccttactgttccataaaaatggcagttcctgtgcttagtgcttagtatcctcaagagaatggaatacttgcaggaaatactaacatcttagtgtttaagtgggtgtgtaaccacacagacactcctgacctttatacatcagctttgtttgcttttacaaataatatctttatgatattttagagagaacattcagaagcataacatctctcaacataaattctatagttggagctgcttctctgcacagcagtacttcatcctgtaggaagcagccctttagcaacataagatatgaaacagcaggatgcaataagaaaggaatgaatctttaatgaatagtttttaatagaagtcacattgttttaataatggggaagataacatggtattagtgctggcaattaattaaggaattcttgccaagataattggtaatcattttcttaatttctttgtgtgattcaataaatacattttgtgggttttttttttttgagtgtgataacattagctgactgaattatagctctctttgcacgaagattagagttaccaaaatgttcagggaatttgtcctgcattatgttgactaatatatctaaagaatagttaaagatttgcctgtttttaaaagtatgatgcaaaataaaacacgggtagcagaaatcaaatattttctctgtaaatcagggtttctcaacagcagcactgttgacattttgagccagataattctttgttgcgggggctatcctgcgcattatgttcagcagcatttctggcctctatgcactgaatgctagaacaccccctcccagttaggtccatttgtgagattttggtgtgtttttaataccctttcacctcaaaacccccacctaaagaacacaggagtgcacagatcggttacagtctgaacggacgagaatgagccaggaaatctgaattgtgttcctggctttctcacctatgtgaccttaaacaggctgagatttagtcttcttgttttccttatatacagtaggcaataaaccatccccgctcaatccctcataaaatattatcaggattaattagagaattcatttgaagtgtgttgtgagcctagaagaaaagcactatctgtaatacaagatattacttgttttttccttgctcttctctgttttatgcagctctgcttccccagtctactctcatctatccatttagctgctgggggttgattaaactgttactcacactctttcccagctcgcattaaaggaacagtattagatttcattttgttgagagatttaaacactaccttgtctgacagattttgaattcacctcttaaatgcattcctacaggccccagccacaaatatcaacaaagttgaaaacaccaactttatttcttagtcaccttgaataaaaatgatgctgtttatttttaacacgtttggaatattcagttacaaacactatcagttctgatggacttcagtaatgggaatagtgtctgtgctttttttatggaaaacttatttctaacagttctcttttttgtaaatctaattgcttttggttcaccaagaattcatgggcaattgcttttctcactattacaaatatattgcaagtggagcttttatattcagggttgctgacctgaatctgttttccttcacagtaatcttgtgctgtttccaagcttaggaaagctgacagagtttgaaaagacaatattcatcagtcagactatgggtgctgcttttgcatcttttatacgtaattgtcaaaacattctattaatacccaactacaggccaatgcatgaaaatataatcggaacattgcagaagtgatgcagagacaaacaggaacttgaaaccgtccctcatttttgaccccaatttactgctatcccacacaaatttggtgttctcaatttctgaagaaattatctatatcagacatgcaggcttatggtccagaggttataggaaatgtcactttatattaaaaaagaacccacctcaaacctggcgttgtgctttgctccttgcattaataatgatgtctttccagctctcattctgcttttcagtcctgggggacacatattttaattttttattggctgtggtagagtttcagcagattcataggaagcgcttcccatatgcttcctgatccatgcaaccagaggctgcagaggggtgtggatacttgtgtgtgtgtttgtgtgtgtgtgtgtgtgtgtgtgtgtatgcatgtgctggttgatgagggaggagtgacaactgttgatttcaattgacatagcccattgtgtccttaaagtagatacgaatcaggatatttatatgcacttagccatttttcccctcctaacaggtcttggactttgaaatttgatggtaaaatggattgggatggtaaaagtaataaaggagaagtcagtttatccatgatttaatctatatggtaaaatccatcaaaattcaaaggtttataaggtcgcatgttaggaaaaagttttggttactgatacagcctattagtttctacaatttccaccctcctccactctactcatgactgcctggcctgacagcatttgaaaggtggggcattgtatatgccttaacgtttagttttaatttatactccctaaaatttttatgtgtaaatattttccaatttaagtgtttaaccataaaatatatttagagacttgaaaaaagcagagaatatcatatttatgataatttaccattttaagaaaggacacagtgcttctcaaataagtagttgtatgatccgactcttcaggtgatgacagctttgttgattgagaggcaagtagagggggattgtctgggcagtccatcattaatacaggtgtaaatcacctggtggagcagaaaacaaatgtgtggtacatgtatttctatctgaattataatatttattccccatgtaagctacagtgtgttctgaaaaagggtttctgggatcctttctttgcccatgggtttcacattgctcaatgaaaatatgttatcgttgttgaaaaaaggtttttatgagcatatttgaatcatattttctatcataatctcaattatgtttaaaaatctggaatcctgcttttcatgtatgtaagtggaagagctaactagaaagctttttatcattagataaaagttaatggtgtctttacttcccaagatcccccaaatttgtcttttattttgatatccaaattagtgccttatatatttaccacccacccttaattttgttcttgaatggttttaactgtataaagtttgcctccttttaacaaggtgggagtgatggtacatgtatgaaaagctgtttgataccagagagtgtatggtacttagcattttctcaggcccacgtatttttagaactgaaaaaaaatagccttcaaagaccatttccccagtcatctggctttttaaagaggactgagcatgtccaaaactgagctcctcatcttcatcttgaacttaactattgtcaggggttgcctcttcttatgcaagtacttttcttcccgttgcccaggccaaaaatctgggtatcatccttgacttctctctttcttttataccccatgcctaatctttcaaaaaattccttggttttatgatcagattatgtccagaacctgtcactttttaccacttccattgctctagcttcattcaagttaccatcatcttttgctttgagtattatagtagcttcttaactggttccctcctttcacctttgcttttttttttctcttcttacaaagcagccagaatgatctgatgacagcgtaggcagagtgtgttcttcctttgattaaaagcttcagtggctccccacttatccactgcttatgagaatctacatgatcttcctccattaccctttatctctctgaactcacctcctcagacttccacacttccctctttcctttccaactacactggactcttcgccgtttctcatatgtgctgggcatgttcctgcctcaggcctttgcactagctcttgttcaactgttgtcatgcctgtacctttctgttagatatctgcacaatgggatccctccatcctttagtgtctcattcccatgaaagtatcttgcctatctttaaactcacaacttgttttcttggccctctctatcctccctgccttgtttagcatttttcccctctctgacaccgctttctagcagactacactgtttacttacttattttatttatttatgtatttatttttgtcatcacctactacaacgtcagatctctgaaggcagaatttttttttcaatgtcatattcacaacccagaatagtgcttggtacatggcatattctaaataatcattctcattaagttactatttactgtggataaattttcacttccatcatttacctagattctcctctgtgcttcttggacaatttcacacaagtgttagatcttgactcatgagttgactttgaacagatagaaagaagccagaggcattcaaagagctgggagagggtgtgcaaagacactgaggtaggaagagagcagtgtgtgaagatttgagggtggaaagaggcaagagtgtaggaaaggaaatggtgggagaacaacatgcaaaagttaacagcaaacagattacaagtgccttgtatatcataccaaggtgtctgaatttatcctctaagcagtggtgagtcattaaaagattacacaggagttgacttgactcagattagtattttggggaaaagaactcgacaaagtaaattccttttagaaagtatgaactcttcaaatgtgtagatgggtatagagaacaatttttataacataagtatcatgaaataatattctatacaggttataacctaaataaatttggatccaagttatagacacagttatatttgcacatctgagcatgaacaagggcttgtgtgatctatgtaaaacgaatgcctttggaccctgtcacagttttaagaattttatattactgaagtgatgttcctgctttaccatcatgacaggaggcttgttactgtacttcctaatcattgaatgtattttgatattatttgcagctaaagagaaaatgataacttccattttaatcagaggcattttcaattgctctccaatctaaattcataaagaaaaatggactaaaatttttagtatggaatccaatttctttttgaaaacaaagacttttctttgtggaagaaaaaataatccataggggaataaattttatttatggaggaggtgttggaggatgctattttagagacagtatgcaggttgccaaacagtgattgtgcttttgtaggtaaagagcctctaccagctggacagcctctggaaatagccacatgttcaattaaaatgttttagcaaatttattgagagtcaggtagtttttcgtttttatctcaacttccagcacatcaaaggaacttagctttaattgcctcttgtaggaattaatctgtatggaagcctatctctaaatagccagagaggccatgaccaaatgtgaagccaatcttctctccacacttgcaagtgccccaaagagatttgctcacatgtaaacagacccctattgggttcctattagtagagttagcaaaacttattttacattgagattttataaattctaataacttttttgtcagttgggatttttgattccaagagagagaaactgattggttattttaaaccccagaagactttactggaaggctagtggaggaagaaaggggaatacaagttgatgggaatgtggagtctgatacagaaaatttacagatgccagagagttctgggggaagcaggggccacagtcatagcagaattctattgctgctgcaaggaatctggcctccagaaacaacttcacgtttcaagctgccagaagcaagtggctgataggctaacagggagtgagtgaaacagagagaagctctgtccttttctgtcctcagtgggaggcaatagtacaaggtaggtcctaactattaagataatcccaaatggagaatttcatccaaagggagaccacagtgttcatagggaatcatgggtgggggagattgggtactctcaaaatgataactatatcttgcatttgttattttattgcatgttgtcttgctttgtttgaagtgactggtaggattggggtaaggatttttgcctttgtaagttggcttaaaatatccatatatctatagctatgcacatagtatatagatttctttctcttgtggaaaagtagctgtgggttggaatggaaagtgaggaaggttttatacagaccaaatttacggtctgcctgtagtaactcaggattatttatagtactggagacccaaatggttggtttgcattatgcttgaattgctcttcttttcccatgctgaatacttctgaggtactaacaaaaagaaggcagagtaaacaaaaaaagtctttgtatattttcttcaaattgggttaagatcaaagagaaccactgattaaaactgaagcagatgtatgtgcacatatgtacatgcacacagacacacatatgtatacatttatatattttatataatcttaactgttaagagttaattgcaggcctgatgtccctaaacattttaataggtgtttcttaagaacaatttttttcataaccatatgataattgtcaaaatcaaaaaattaatatgtacataatactgtagtctgtagaacgtattcagattttaccaattggccacatgtcctttgtaggaaaagaaaatctcagatcctgtattttcttttttttttttcttttgagatggaatcttgctctgtcacccaggctggagtgcagtggtgccatctcagctctctgcaatctccacctctctggttcaagcgattcctctgcctcagcctcccaagtagttgagattacaggcatcctccaccatgcctgctaagttttgtatttttagtagatatggggtttcaccatgttggccaggctggtcttgaactcctgacctcaggtgatttgcctgccttggcctctccaaagtgctgggattacaggcgtgagccaccgcgcccagccttttttttctgttgtcatgccttgttggtctttgtaacgtgaaatactccgtcattaatttggaaacaaagcttttattttaattattgatatattttaataatttggccattattttgtagaaagtccctcatctggtgtttggctgattattccttatgaatcaatttgtgttatagacttttgacaggagaaaacaaaaaaaaatgatgctgtgttttcagcacatcgtgtcaggaaacacatgaagtcaaatttcatttccagtgatattaactttatcacttggttaaggtggcttcaccacagatttctccattgtaaagttattgttttccttttgtaattagtaagtatttagtgtggagatactttgagacaatgggaataatgtttcctatccaacttttacctactgattatagtatttattgataattcttgtcaaatgttgatttttctaattaaattattccttctaaatttagaagttggatttttattgcaaggaatgactttccttatttatttatttgtatcagggtggacaaatgaatacttattcactgtgctataagtgtttacttttgttacttattttgatgctcaaattatccaagattttcccaatgttagcccttctaatgagctaactttagtttacttcctctgtgtgctatagggaagacctatacttcctctgtgtgctatagggaagaaaaatatacaaagactttttttgtttactctgccttctttttgttagacccttgtgtcttccctatagaacagtgctttgtataatacttaataaccatattgaatttgccaataaaccaagcatcatttcctctaaaattttccaccttaccaaagtaaacttctaaaaagcaaattcaggggaatatacaaaactgtgcatatttatcatgggttgaaaaaaattcatatttttcttattttgtctaatctatgactttttacttttaacataatttcctttatatctattcattattttacagaatataagatatttttcaaaatttagagtaagtactcagttgagtcccttgtgtgaaataatagacgaattggtttgtgtgttacctctccatctgccatcctaagggaagttgggaaatctcaggcaagattaatgacaatagaaattttgttccatgattaacttatattctgtcagacagccttttggaacagttttataaccttctttcctctatgctatttccccacactatttgcttaaagatttttttttcaaattagtcatcattcacttcttatttcctttgtagaaaaattaaaagttataaaagagagaaaataccaaaatactacttatactttgattaaatcttgaaataatttttaaatggcacctgcaacttaccctagacctggtgaaattcttgtgaggacaatgttaactcatccaacattaataggatggtacttatgtggcaggcattgtgctcagagcttaattaagtttctgctccatcttcaaaagactaagagtatagttggagaggagatacataagcaaaaatccccaaaaaggtaacaagagcagtatacaagttgttctgaaaataagggagaggtgctgacttctcctggaggaagctagtgagcaagatgcttttgagaataagtgcaaatcagtgtccaagaaaagagattttcttcatatattttgggatggttgaaatcaaatgataatttattctaaatgatactataattgagttgaaggaaagaactgatcattttaaattaaacaaagaatgttatagatagctcttattattctgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagcttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatcagtggtgatatcccctttatcattttttattgtgtctatttgattcttctctctttttttctttattagtcttgctagcggtctatcaattttgttgatcctttcaaaaaaccagctcctggattcattgattttttgaagggttttttatgtctctatttccttcagttctgctctgattttagttatttcttgccttctgctagcttttgaatgtgtttgctcttgcttttctagttcttttaattgtgatgttagggtgtcaattttggatccttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttgctggccagggcaatcaggcagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaatgaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttcaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggttctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttgcaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatggagccataaaaaatgatgagttcatgtcctttgtagggacatggatgaaattggaaaccatcattctcagtaaactatcacaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaacattaaaaaaaaaaaaagaatgttataaaaccagtgttattagtttgggaacatgttctgtctgacaaatttgctctggtataattaggtgacataatggtcaaacaaatggatggaagtagtaaatgaagcctatctcgaatgttgtaaagcttctgacttttttttgtctgacataattggattattatgaattcttcatattgaataattaaaaaatactaaaccttgtgtccagaaatccctgaaaaggggatgcgcatggataagctccatgactgtatgaaatcctttacattacaagtcaattttttggtgaatttgcacttacgtatatttttctctgaaagaatccttaggtcttatcagattctcagtggatcccttgaatccctccaaatgaagaagcatttacggagtggtatgctgaaagcagaactccactagaattttagccccagactagctacactcagtacagtcttagactagtaatttaattttcctgtgctttagtttcttcatttctaaaccagaagatttaactatggtcagttctcctccacagacatattctcaagtgacaagtacatcctaaagatttttgcaactttaagtggccacaggttcagtttttcagcctttacagtgttgtcactaacagtgtactaagaaatttgaatcttgctgttcagtttcccttgaaaaacatttgtctactctgggcccatattactgcacagcagccctttggagatcagtgctaatacatttgggcagttgaatgcgctcagggtctccacagaccccaccatgccctatagtctcacaccagcaggctccactattttatatggctttccggctctggaagcatttggtatggtctcctcagatctgcacagtacaccattaagctaaggaaagagaatgtatcagattattgggaggtgatacagtgctatgaatgggcagcttcactgtccctttactgagagaattctgaggctctctgtgttcctatacataccctgattgtggaggaagatttaacactttttgctgaaaatgatttctctgcttggagttgaaactgatcaacttatattgggcgtcttatatgatactcttacacatttgccgtgaaccaatattttaagatgttatgttacaccaaagaggatctgaaattgttggaaagtgtatgataaaactgctcaggccctgtatttacacaagtaaaatgaaacctgaagtaattgtacatttcaagttacttcattgactagatcagggatctgcaagattttttgtaaagagacaggaaatatctgtttgctttgcagggcatattatctttgttataagaacataagccaccttagacaatacataaatacataaatgaatgatcatggctgtgtttcaataaaaccttacttagaaatacaggtagatttggcttgtggattgtaatttgccagcccctaggctaatcattagaatatggtgtctggtcttaaaaaccttgaagaataatcacaaagattaaaacaggatgctactacaggaggtattagaaaagaagacccacaggaaaagtgatctgggatggcttaacttcaccaggaggaggctcttgggtaatataatttatgtttgacatagaaaataatttcttgacaataaaagtggttacatttttagagtgaattattaaggcagtttgtggactctctctgaaaggttgtaaaaatagtataacttttcatctttctgagttggttttcaatagatatatgaacaggataatctctaggcactgggagatgaacaactagaaatgtaaattcaaacagttttacattcacagttgttcatctcccattggacagaagcagaccaacaattcagatttctgatgtttacattagtacttagtactttcatattcttaggaaaggattttttttaacccctttcctaatctctgaaatgcccaagtgttctaagtagcatggttgattaacatataacgaatctattagtagtgcatttaatgatgatgaaatgctacacacatttaaaataacagatataatagctcactgaacagaattatcctaaagttattttggaatcctcagaaaacatttacttgttctctgaagttatctgtgcagactattgtgatttcgtgaagggagaactcaagatcgtacacctacatttcattaacttttttggtcatgtttcatgtgtctctaaggcaatagctacagtaactttagttggtttttggctactatctcacttgtatcaaatagattcatagaaaaatatggtgacagcattggcgggaagtttggaggacatctaattcaaacctctcatatttaggacaaagaaataagaaccctggcttgggttttagggcacctgatgaggaactagaacttcagatatactgtttattacacaaaaatagatttttaaatttgagattttttgaccaaaaaattttatcataaggcagtaaactcaggtttcatagatctacataggattacttgttggatataacccatttaagtttaaatacccaattcttttttgagggctggactctggtcattctggcagttgattcttctattttcctacgagttctgtattatgagaatttatgctctccattccaataatggaataaaataagagcatgatactggagattgccatcccatgtggtgtgttaaagattcagtctatcctgttgcagtctcattgggaaggagcaatagggagacatatgtgatcactgcatcatacatattagatggtaaataaaatttaataaagagcaaagatctttttcctgttagggaataaatttgagcataattgcaaattacaattttatctgagaatatctgtgtcttacagacattctataatgaagaaaaaatgagctattttctagtgtaaatcttattttaagtcataatgatgtatatgtgtgtgtgtgcagaacaaaataggtgtaattaccttatctattccattatattttagcatctcttatacatgtgattaaagttgctccctttaaagtattgtcatagggagactttgacacttatttcagggattccacatttaaccaataagtttttttggaaagcttaacttagatttaccataccaattagtttttaactgtttgtgtttgtgtgtgaataatcagtttgtgagaaaaattagtctcattaaattagtcactacttcagcatgacgagcataaatagtcttttctagcttaaccacttggaacgtacagacttgaccctgaacaattttacctttagatgattttatgctactgatatcaaagaaatatattctcatctcggaatgcaattccaaaagaggagttccaaaaattacaacagtgtcatatttggaggactgatttccataagatgaattatgtctggtacacattaatttttttcaaaatgaagcatgacttacagtaacatgcacagatcatcgtgtgcagtttaaaaattttgaaatgtgcatacacctttgtaacttacacccttatcaaaatatagaacatctcatcaccacagggtttctcctgctctattacatcatcccctgaattgaagccccacccctgacccccttcatggctacccagggaaccactgctctgatttctatcaccatagtttagttattcctcttccggaatgccatgtaagtgccatcatcacatattctctctattgtgtctggcttctttcctgcagaacgttttttgaggttcatccatgatgttgcatgtatcagcagttcatttctttttattgccgagtatgaatgtttttatgcgctcttgttttctgatgtgagttaaaactatgtgagaagactgaattatcttcttagaagttacagaataaggctatatttgaggattttctcctccacataggtcactttatactataacttatcctattacacaaagtatatctatgtaaacaaaattactctaatcacaatgaaaactactagttcaaatatttaactataaatattttaggaaagacattgtatcagggtattagagtttttaatatatacatagttaacattcattttattaaatacttattggaagcctactacatgacagacataatactataagaattttctcatgttttgaaatgatatataaaagctctagaagaaatgaagtattagtaactgatctaaatctctgtatttatttataattgataattaccagttttagtattaatctgtcactttataggctgatgcaaatgaaaaagttatttgtgaggatacaggatctgagaaaagtgagttcctatacatcatttttcaaaaactgtcctggaggctttctttgctgcttgttgttgaaaaatggactccatagggttgaggcatcatggagactttaattaagttttaattaaatgttttccatggttttgcataataaggagatagtatcaaatctaattcctgaaaaatctaacatgcatcctggtaatcaacacatgaggaaactctaagcatccacatataatttagtgctatttcggttaagtgcattttaaaaggataatccttacacagtttctgaatatattcattaaaattggtgaacttagtagaacactctagggaagaaatttttaaataaaacttcaaatttttgttggtttgatatactgacaatttaataatttaatgtctctgaaattattttgtgtattttatttggtaatttgtaaaagtattacataagcactcttggatttttaaaagtctaaggacatagaatataaagtgtcgcatcactttcaaatgtgtgaacatagtaagagttgcctaaactgtttgtttgtaattgggggtaataatatattcagaccatagaattgtaaggcttacccgagataggatctcaaagtatttcactcttacaccttgggtagaaggcatactttaggccttatatccaaatgaagttatatggataattacaaacattaactaacaggattgaacatataaaatatatcacagttttttcattgcttcatttttaatacattataaaccttaagcaattgaaagtgtcctgtgcccttgagctttaagagatgagtttaaaaaacttataacatgtaacataatccaattgaccaaacatatgttgagttttaactatttgctaaggattgtattaagtactaggagtacaaagatgaataatgtaggattcctcacttcctttgccttattcagctttttccttactccttttagtttttcactcaataggtattttttctcctaattttaaggtctaccttttaactgtaaatggctagattggactacatggtgtctaagttttcccccaattctgcaattctatgccttctaaatgtatgctttgaatgctaacatggatatgtgcaaacactgaggcaggttttgcttagacatgcagcaagtttgaaattcgtttatatacacgtttaagaaactcagcttcggagtcagacgggcctaggtacaaatatttaccacttaggcaagctaccaaatctctgaatttttctctgtggtgtattttataaagtagggataaaaatactacttcctttataaagcattatgaagactatatgagataatgcatgtaagagacttaaacaggtgtgttcagaatataataaactcgaaataagtattagtctttattcatcaggcaatataaatataggtaatttacttgtctggaaaaatattcctaagtattcgcaagttaggtaaagtgcatttgtccttattttacaagagaagttagtgaactttaatgaggatgacaggataaatgtattttctgtctatgctagtcatgttcttgtcaagaaccacgctcagaaattctttgttggtagcagactatcgcacagtggaatcatcttacatctagtgttttcattgctcagcactgtgctgaaaacaacagctctaccatgtttgcccaatgagtaaatgattggctggatgaatagatgaaaatgattgctgttaatacactaaatataaaacaaaaatttgcctgaggcaatattagtaaatagttaatagagacaagattttagcttttactacttgttggtacttttacataatttcctaatcctctgtttcttacaatgatgcatacacatggacaacgctgcagtatagtggcttcacaaaatgtgatgcaatcatattttttacttatttataacaagaatcccaagtacgaactgcagtagttagcattaattttcctattttattttcagaaaatgtgggaccagaaaaaaatagatgacctagtatgacaactgatttttaattgatccagtaaatgttaccctgtttcagagagaggtgcttctttcccaaagttatagtgttatctcacctattcatagcaaagatgtccttatgactctaagatgaactttccagtagtgccctggagctcttttgcattcccatggacctattatgattatggaaccccattaagaagattccctttgagatattgagataaaaaatccagaatgtatatcattaaaagttataacattggacctcaatcatgcttccctttctatatctttgatcttaatgatctgagtttggaccagcaaggtattatgctcttagaacagctgctggggtataaaagagcattttagagagggatggagattgtgaaatatgaattgaaatcaggtctagtgaagttaattcagcagctgtgtataaagaagcattttgatgtctagtatggtaatgcatcaatacttatcgtcagataattttaattaagcaaaccttaaagtagtaaaaattagaaatattgtttaattaaaccttaaagtattaaaaattagaaatatttttagacttttctcctctatattttgtatgtggagtcagatagaaagtagaaatataataaggacctaaaaaactgccagtaggaaaatcagttgaaataatccagatgcttctactattttaaaggtcaaatctggtttgctcataaaacccagagtagtgtgagaggagatgtttaataaatcttggaatttggtagtagaataaaagtggtgaatttagagaccttaagcttggttggttagattttcacattatgccatctaagagtggaaaagatttcttccagctgtaaaattgtgggttaaaagaaatgtcacacttcaactttttttcctttttaaatccatatgctctgaatgttaccagatttttcagacttcaggaactgaaggctttttattcataggacaggctttgcaggaactactatagtgcaaattcatccccataactctcctaaaataaatatatttttctttggaaataccaactcttagatagcaagaataatttcctcgtggccttcatagcttttggcttttgtctgaaagatccagaaagtgcagaggttatgatgtattgctttagtgacacgaacacttgtcccttaggattgacatttcaggaacttcttcatgtgttacaaagccacatgcagagagtgtttgaaagtcattggatagctgacttcacccacagggagagtgacagggacctggagtaaagccttttcagtgaaaacctttaggcataattagattattctagcaggtagtggattcatgtcaatccagccatctccagaggatgctgagggctaccagtctcacatgacagctttcactggctggttgctgctgaactgctgaactgcgagttaacttcagggaccttttgaattgccttcagggtgtggcacaagaatgcagcaagctcaagagattttaaagattcattctccatatgagttggccctagggattcagagagaaactgagatggtggcggtaattctagggccctgtgaaatgtaagctatctataaaatactgatgcaatgtataatgagctattctggtgttagtgcattagtgtgccaatcctggcataataaacacaaaatatttatgaaatgcttaactgacatgtatttgaaatatacaccaaatattggtatcaaaagagggctgatactatgttataggttagttgggtttacataatctttgcttgaacattgttattatgggaagcatggttttaaaggaacagtgacaaacatgttaggtgcttacccgttatctgttttcttccattgtttagctgaagacaatgtaagacttttatgaccttcctgttccttactttctcagccatgagttcccattctgaccaatgaggtctaaggtccaagggctatggtagttcttggaaaagcctttacattcttggtaaacatgaacacacattgtcggcttagccaatctggtcatctttgctttcatctgtttgttgtttcatttagaagttgaattaatgagtacaaatccctcatacttccggctatgggaggtaaataaactcttagttatttaaggcattttaaaatcatggttgcaaaatggctgccacgccttttaggtatcacatttttccttgggttaaaaacaaagcccatcatgactgacgtccttttagatgtcactggccataactggttcacatagctagaaaagcagggcacaaacatagaaagtgccggtatccctgttgtcttcatttagtagttgaatctgtgagttcaactgcctacctctgaactttcattatttgtttaaagcattgtaataatactgttgctattttcagctgaacatgtgacaaaataagtagaatttggagggaggagaatatttgaaagttaggaagagtatgactgaaggatgagctaatgagtagattgtcttaagtggatcaactgttctctaaagtagtggaaagtcagttattaaatccataaaaggctttatcataaaatgaaaatctattctagcattattgtaagtattaataaaattactatgtaaaacattttgctagtccatttattatgttttctaaaagtattttctcaaccagtatttaggaaacatttctaactatgtaaacaactctttttttttttttttttttctgagacggagtctcgttctgtcgcccaggcgggagtgctgtggcgcgatctccgctcactgcaagctccgccttccgggttcacgccattctcctgcctcagcctcccgagtagctgggactacagtaaacaactcttatatagacaaactggtagaaggtagaggataaataatccaaaatgctaatcttaaaatgtctgtgtttgtattaagcaatcaggaaacattttgcagcatatctacttgctctgaactgaatggaagggccccagagctgcagcagtaaggttaatttattcacggattattaattattaattattatatgtgactctgtagtaacccaccatttataaaaaattgctttctgtttaaatttaggttagatacattgataaataacaattagagaacatattttacacatccaaccttaagggttcttattgttctttaaaactgattattataagatgtttggagcaagatttggcctaaaggccaattaatttgaaatacctcactaaaccaaagaagagttgatttagaaatggccaatttcatgtctaataagctactatcctaagtaaaaaaaaaaaatcagtctgttgtgtcaaaatgctttttttctcattcagattcatactggtgactatttcattattgcagaggagcccaatgtgggtgaaatgttacaaatactaacagtgaagaaatctggttctcttaagtctgtgtttttggctgaagctacaaagtttcccagtggtgtctgttacaaagtaacatgcaggacttggcagccagttacagataacaagacttccatcccgaagactgtccaagccacatgctaaattttgcccatctgtcaccagtctcctctgtcccatgtcagagtcaaatttggaaactggtgacattggaggtacttgttatgcctggcagaacaaaacccaaaggtcttattgctcatgacagttcagatgtacttgaacagtaattactgttcatatggagttctttgccatgttcttctgtttcatgacttcccatcttcctttagatggtcccagtatacagggtactgaatattagaagcagcaagaaatggtaccacaaattattttttttaaatttattttatgtgaaagtcaaagaatgctagtacaaacctaacatttgatggacatgtttgttgcatattacccagctaggtaaggctaagtaatacagaattaataactatattttcagagaaatattatttaacatattttagttttatgagtatataattgaaaacatcacattaaaagttattaatttacacacaatatgaatgaatctcagaaacaaaatgttgaataaaagaagccagacacaaaaaagtacatacagtatgattttactcacataaagttcaaaaacaggcaaaactagtgtgtgttctaaaacaatagggtagtgattacccttgggatagtacttgaaagtggggcaaagtaggggcttccgctacgtgagtaacattctctttcttgctctagctaaaggttacctgacacatttatactgtggaaattgatcccactgcacgttgatagtttgtatactttgtttgaatatcattcttcaattgaaaaagtaaaagaagaattaacttgtaaagtaaaataacagttactttagaaaacacaaaaccactataaaaattatttttcaacataattcagaattattaatgataatgataattatttatggaacacatctgtgttagacatggttctaagtgtttgaattacgttactttccttagtgattacaccatcttagaggtgttgttttttgttctgtttgttaaagaggaattgggatttgggatttagagaaattaagcagcttgctcaaggccacgtctcaagttaggaattgtgtgtaaatttgaacatttgtttgtttaacttcagcaaggaggagaagctttcgcactgtgccacgtgcttccactaaccatcacagttgcacattgagacaaattaatttcagactctggactgaattttcattttgaggatgagcagttttcttcttagattgaagtttccgtttccatgataatcaatgattgttattataaactttatcctcagtctgtactggggttttatatagctcaagagggaatcaaatataaagcagcaatagttgtttaaaactaaagtttggaaaggccaaaaaagattaatagtctttcatagacaatcccaatgggtaaagttggggatattttgatttggcagcctcatatattttttcttattttaggaagctgcttcctagtattggcctttgtacttctaaaacttttggttgagagaaaaaaaatggaagatggtaagataaaattccatgaatttaagaacagtgattttaaatttattagggctatattgcataattagattttaagaacctgagagtgtaatgaaccacattttatttctcattagaaaactgatttcttcccattggccatacacaagtcctggtgaaggagtaagtgctagggaaaaagggatataaggtagatgggtctataccttggggaagacaggcattaacttttgtgcaaatcagaattgcaagttaaagaagtgaaacattaatgttgtatagtttgaaaagcactgcgtcatctcattttaccctcgtgattctgagatcagtatcattgttacgtccattttacagattaggaatctgaggctcagaggccaattagcacaaacacatttacccagtaggtaacagaccgtgggaatgaaggggaggaaaattaattattgctagataaactaggaaggctttataaagaaatgcatgattaggtgcttcaggaacaagtcagatttaaacacaagaaagtaagggaagggcactgtggtttgaatgagctgtgagagccaaaactctaaatgcaggagaaagcatgtctcttctggtctatggtcaggcatttactgtgggtgaaaaacagatttcagagccatcatagtttggctggcaataaaattattttgtgagcacatcatggaggcctggttctgtaggctctagaaggagagactcttgtgtgtgtgagaaaacaccaatattgtgggtgggtacaataagtaaagagatagaagaaaagaaaccaggtagtgagttatgacaatagtgtaatgtgggcttcaattagggtgaagtggtagaaacaggaaaagaaaaggtggagggaagattgaagggcactccagtggtcattgtttcctaaggaggcccagtagtgctgcctttatataactttctatttgattaccatcacagaggaatcctgaggaatctcataaaaaattttcattataactctatttactcactattttgggaagataggggaaatgtattaaaattacagcaagagtaaatgcggtacttttcacttattcagattattttttattttatatagatacattatgaaatccaagtttgaattgtaaagctttggctttttgaagcttttgaagtaaatgtgacttgctgtattacacacagctatgacttcctatatttctagcttgtgcacctagcatatttgatagagcagatttttttaaatatcctctcttctatataacaagattactttttagtaatagggtaatatcagtaatattattactttttgatttgttctttaggttcaaaacaacaatgaaattagagtacattttaattttaaggtttaattcaaatattataaattgttctacaaatgcaataaaattaatagtaagcaaatgaaaatgttacaccttagaatttgtactgtttcattgatttaaatacaaataaaattccaagtaggctcataggatgacagaattaaggtaatttaagttctgattcttctttacaaagactgcactactattgcttattttgaaacagatagtactacatgtgttagagacacaaattgcagccaaagcaaactcagatgactctgaactattataaaaattacacttgttggctgggcatggtggcttacgcctgtggtcccagcactttgggaggctgaggtgggtggatcacttgtggtcaggagtttgagaccaggctggccaacatggcgaaaccctgtctcttctaaaaatacaaaaaaattagccaggcatggtggtgcacacctgtaatcccaggtactcaggaggctgaggcaagggaattgcttgaacccgagaaacagaggttgcagtgagctgagattgtaccatggcactctagcctgggaaacagagggagacattgtcttaaaaaaaaaaaattacacttgtaatgagtatgtgtagtttagttcttatctattagagattaggtcttatctattagaaataagtggaagttaattgtatgttggttgttctccaaacttccatgcagaataccatgtttatgaaagggtgcataattgccaatttggaactcatgtgtagtattaaactcaataataactatatagttgtttagacattagaccagtaaaatatttttaggatgttttgtcattgaaatttggtgggtatgtggtgatcataaaaagctaatgaacatattatcagccttatgaatggttttggattatctgcaggcagtgcactccttaattgcctgtgcctggaaaagactgcttcctctgccctacctttgtctgcctaatgcactgccttgactaacaccttttttcttgtgaaatgactttttccttcaccctgccttctgacatatgtcttcattacccttccattctcaatcagataccacctacattatttgatttccatgactgaatgctgtctccttcctttgaactcacagtgtactattttcattactctatagaccacctagtaatattaactttgcaaggatcgttgctgagagtacagtcgtacttatttttcatttttcagcacctagaattgaacacttattatcaatcagccaaaccagtctgtacacacttgatattgcttaaaccaaaaggaaactattacagtgaccccatttgtttttgctttgtcgtcgttgttatagagacttaaaaataggatttgggggatattacgtgaaagcctttaactcaatatgcatacttaatttcatatttggttctggaaaagtctaaacttctttaacatttctatcttcctccagaacaacatccagcctcactgctcttctcttactatcttactaatgtctgcaatttttcttctacatatatttttaaagtgctgtgaattagtttttttacactcagtgtctagtaagaattaccagtagattttggccgggcatggtggctcatgcctataatcccagtactttgggaggccgaggtgggcggatcacaaggtcaggagttcaacaccagcctgaccaacatggtgaaaccctatctctactaaaaaatacaaaaaaaattatctgggcatgatggcacgtgcctgtaatcacagctactcaggaggctgagggaggagaatcacttcaacccaggaggaggttgcagtgagctgagatactgccattgcactccagcctgggcgacagagcgagactccatctcaaaaaaaaaaaaaaaaaaaaaaagaattaccagtagattttataattacttttgtcactgttttatacatttcatttcttctttccgtgtttttttttttacttcttctttccatggtttttttttttttcttcctgaagaatgtcctttagtaattcttgcagggagtatctattgccagtgaacactccttagttgcatgtatggagggttctttgtcttatcatcactgatgaaacttagtttagctgggggcagaaaattttagactgttagttactacttctcagcatttttgaatattctggctgctgttgtagttgatgagatatatgctgccagtttaagcatcagttgccaatagataatttatcttttgtcttaggaggcttttaaagttttctctttatccttaatgcattctagttttattgtaatgcatttaaatatgaatttacttttaatttatctggctttcttccagcttttgctttctgtctgagaatacatttttctttttctttttctttttctttttcttttttttttttttgagacagagtcttgctctgtccccaaggctggagtgcagtagggtgatcttggctcactgcaaactctgcctcccaggttcaagcgattctcctacctcagcctcctgagtaggtggggttacaggcgtgtgccaccatgcccagctaatttttgtatttttagtagagatgttgtttcaccatgttggccaggctggtcttgaactcctgacctcaaaatctgcacgcttcagcctcccaaagtgctgggattacaggcgtgaaccaccgtgcccggccacattttatttcagttcttaaaaattcttaggcatcattatgattctttttaaaaatattggtttttcaccattctctcaacttgctacttctggaactcctgttagtgatgtgtgggagcagagagacattagtagtgctcaccaatattggaatagttattccttcaaggacatatgtgtgactatacctcttaggcccttgcagttaagcagagctatgtaactaattatggacaataaaatgtgagagaagtgatgtgtgttattgccaagttgaagcaaggaaaagcccctgcgcaactctctagtctctcttttcttctgctttagcaattacgacagagggcctgaatgaatggtaaacttctatgaagatactgatatttgggaatatttgctactgcaatgttgactctcttatcctgagtaaaatagaaagcctctcaagctaatccgcatgttacctaaaattctcttacatagttgtcatttacttgtttctctggtataatctttcagttcagtaattttttctttagctgtgttcagctcaggattagtctcttttccagttttaattttagttatggtaattttctttctagcatttataactccatcataaccacattctcagtttataataataatttacagtcttttatacttgaattatgttatttctatttatttctacaagtattttatacagttatttgtacattgttttcagatttttattatttgcatttccccaaaatgaactctctcaattgtttagaatgtgagctgtattttgtggcattttcctcatatgagattaaatttttgtttgctaattccttttgagtaacagatttttagttgtggttcttgttgctcttgtttgttttgtatttcttttctcctggaggttctatatattgcctactagttttaccattacctgcatccagctcctctctattcagaactaggccatgcactggcattttgggtctccagtctggcaggggtactgatattttacaagtcttgtggctaactcagagaataacaggacccagaacgagaagtaatcttggctccaattgctgccctgactgcagcttgacatagtctcagccctgggtaatagttactattttttgtcgaggctcctctcataaatcagggaaactaaacccaacctctggttttacatcctgagtctagcccctatctcttgacacagacggagcactttgagttcctgttattctcctccctcaccccattttgaaatttcttatttccagtccaagagcctagtaagttatactgctgttttgcatttctgttatagaatgttgatcttgtttctgagttcagttgtctttttcaatattatacataatatacataaatatataaatatctgtctgtatgtgtatatgtgtgcatgtttcattgctttggatctgaaggggagggaatgagtgtttatacttgcactcaaaattccatcttaataaggagtcaaagtctaattcaaatgaggttagttctctggctcatgatatggtgatccttcttttattaccaattacagatacttcattttgattgagttcccttccaggggatttcacttaattttttaaagattctctgagaaatgaggagtgttttggtgtgcattgaggcaaatgattgagtctgaaaggccatcatagtagcctcatgagaatcattaaaagcacctaccactcaactttgtcctttgctaaagcaaatgggtatatggattaactcagcatttaagtcttcctatactttttgacccttcatttagtagtagaattaatcataacttaagagaaagataaatgaagagatgtgagaacatcaggagtaaaatcacttaataaaatcttggtggagctagtgaagattatgacacattcattttctgtgttactgtgggtaggatgaaatcagattttattttattgtatatgggtgccactctctgaggttgcatagaatataaaatgcagtgtttttcaaaggagtgtccacggagatagaacaatgttttagtttcaagattagcttttcttttatctgtcttttgctgagtgtttactaacacacatgtgtctactttgggaatattttatagggaatcataacatctaaaacaatttcagggataatttttcacattgtcacagaatacctttttttactaaaacactttaaaaaaataagctgtctggccgggtgtggtggcttgctcctgtaatcccagcagtttggtagactgaggtgggtggatcacctgaggtcaggagttcgagaccagcctggccaacatggtgaaaccctgtctctattaaaaaaacaaaaattagctggctgtggtggcgggcacagtaatcccagctaattggaggctgaggcaggagaatcacttgaacctggaagacagaggttgcagtgagccgagatcatgccaccgcattccagcctggcagcagagtgagagtctgtcaaaaaaaaaaaaatgcatttacttgctattacattattccttctttatctaaaaaaaaatactttacaatggataatcattttgtggaaatagttttaaaacatatggcttacattttacctctgtactgagttgaatagtgtttccacaaacttcatgtctacccagaacctgtgacttatttggaaatgaggtgtttgcagatgtattcaaattaaaatgaggtcataccttattagagtgagtactaattcagtgatcagtaggaacagggaaatttggatacagacacagacagaggagagtgacatgtgaagaaagggacagattggagtgatgtatatacaggccaaggaatgcctaagattgctagcaatcatcagaagctaggatagaggcatggaaaaggttttctctcagaggctccggaaggaaccaaccctgctgatgccttggttttggacttctagctaccagaactgtgagagaataaatttctgctgtcttaagcctcccagtttgcagcacttttgttgtggaaaccctaggaaactaatataccattttacacaacatattctaaatgtaatgcaacttttatctatgttataaacaatttctgctttgttatcatgccatgatgttgtaaggaacctttgaagtgcattgcattggatttaccttgcccttaaagaaagtaaacaaggtaattttgctgtccttgctgggcattctgttgtcttgtcaacagctattacgtttctttatatagctttccctttttcttcctttgtgtctatgcagctgttgcactccaagaactgaaggtttccaggagaaaagagaaacccaaccaaccaaagtttactaaatcagttattgaatttcacctgcaattcttagtctatgggctcaagtttgagagtcgttggtttcctaatgtatattggccatagttgctctgggaaaaatggtgggtggtggtggtaatgcttactgtcaaaaacagattgggaaatgctgcctatggcacttctcctgtggcaaatttatactcttacaagatatattcaagactttcagaagttttaatgtaacaaaccttatttaaactaacacttgacaccagaaccctttctttgttgtcatctattaatatctcatgattctacagaaatcactttgaggaacacatttaaagagaaaaatgtctgttccttactaagcagttttctctaagctcacagctgacacattttttggggctttcaactcagactttgttttgaatatttgaggttaccaaaagcaggagggtcagaaacatgatgagttattctaatttgtttttaacagtaattaatcttcctaaagtactctttatttagataggattttgtttgttgtttctttggggccattttgtatgtattttcctgtcacaatctaggtgctaagaaagattaaataaacttctgtttggaaaattctgtgtaaaactgaagtcaaaaacagataagcagacattagagttggactacctgttttctatctgtatatttagtccttcacatttcccatggtgtcttgtttttgagttaattatgtggcatcatgtcatatatctaattattttaattcagaaaccaaacagggttgctgaagtagtgctgctgctagtctcttgaggagtgggaacaagttattcatgcattcagtcaaacagcctgataaaccatcttcgtgtcaagtgttgatctaggtgctggggatacagcaagtgacaaaacatgcaaattcctggctctataatagcacatatccaagtatggagagaccaaaaataaatgatacaccagtaagattgctagtacgagttggttataagcattatgaagaaaaataaagtaggcctgggcaagaggaatacaggtgagagtgagtgaaagtttgccatttgaatgatgatggtcagaaaaggtatcgctgagatggtaaaatgtgacaagacacccaaagaaggaagggaataatccatgtggcttggagtgagacagtgttctagaaggagggaacaaccaatgcgaaggctcagaagcaggagtgtctgtggttgacttagtaacagcacaggctagtatctatagagcagaagggatgggggtgaagaggtggggtcattgtgggggcctttaaggcctctctaaaaatttttgcttctcccttgagtggcataggaagtcattggaggactgtgaactgagaaatgatatgatctagctaacatttttacaggagtataatgaccgttaggttgttgccaccaggctcaaataccaccactcataaaggcatttttgaaatagactgaggtaattcctcacggaggggaactgctactgtcaaacagatgtcatcagaactataagaatatattagactctttcaacatcgagaaaatgatcaggaattgtaaggagtcactatggtgggaattttttttttttttaatttgagttgagaacctgtctgtattctttttttaccaaaaaaataaagacttgctcaagaaagacatgtgtccctatcagttctaaaaatatcatatctgctctgatggttaattgctgccagattaaaaaaattcttattaaaacaagttttatgttatgagaattgtaggtgaatttagaagccagagatacaagaatgtcttcagcttgtttgaacgtgttgttgttaaatagaattttgaaaactgatgaatagaataaaaaatttatcctgtttttctcaaactatgtctaagaaccaaataattgattagaaggatagtatttttatagaagtttatcaattagtaaagaactgtggttatatgaactatccattaatgaacctactacttataaaatgtatccccactcaaacatatcttcagtcagatatctgttctgattctaccccattgtgtcaactccctttctgttcgtatatcagtataacatgcttttctaatcagcatgttagatgtggatatattgattagtaaaatgcaaattatttctgaatgaaagtagtaatcacataaaagaaatgggattttataaagttcaaaaaagtggtcctggagaaccatttgagcctttctcaaaattattaataaacagtggtctaacagagttatactagttatcatttgaagaagaaaaccatcatggattatcaaagataatgcttttaaagtgaaagttttgaatgccaaatcaataataatacataataatagttatcaattatttaatgcataccctatgctgagtattgttccaagtgctttctatgcagtctcagttggaatattggtttggctgagtgtggcaaaggatcacaataataggagtttagataagctagaagtttattttttatttttaaagtgtaaactgatagaatggcttggctccgcacagttctgaggcctaggctccttccatgctgttgctttgctttcctagtgtttgactcattggtacaattcaagaactatcactctcttgcatgcacttctcggagtcttagttttcttccctgtaagggtcaaaactggaagttacacatatcacttttgctcatatgccattgttgagtacttagtcacttggccatatctaatttcaaggatggcagggaaatgtagtgtttcttcttggttgccctgtgtccaggtgaccacaggcctagattattttattccgtagtgatagcaatcatattaggtaggtgccattatgatcgctgtattgtaaataagacatcttagacaagaaaaaattttgataattttcacaaagtgagggaattctttaaatgtttcgcaaatatatgacttttgttcttcctttgcacatctaaaggaatgtcagtgtttctcaaaaatttagtggtaaaagaccagggttttttttttgttgttgttctttgtgttttacttaaaccattttatacatatttcaaaaatttataattttttttgtggttacatagtagatgtatgtatttatggggtacatcagatattatgatacaggcatgcaatacatagtaatcacatcatggaaaatgggatctccattccttcatgcatttatcctttgtgttacaaacaatccaattatactctttttttgttcttttaaaatatacaattaaataattattgactatagtcactctttgtgctatcaaatactaggtcttattcattttaactatttttcaccctttagccatccccaccttcccccaccagtcccccactactcttcccagcctctggtaaccatccttctactctttatgtccatgagttcaattgttttgatttttagatcccacaaataagtgagaacgtgtttgtctttctgtgcctggcttatttcacttaacatagtgatatccagttgcatccatgttgacacaaatgacaggatctgattcctttttaatggctgaatagtactccattgtgtataagcatcacattttctttttccattcatatgttgatggacacttaggttgcttccaaattttggttactgtgaacagtgctaaaacaaacatgggtgtgcagatacctctttgatatactgattttctttcttttggatatatacccagcagtgggattgctggagcatatggtagctctatttttagttttttgaggaacctccaaactgttcttcataatggttgtactaatttacattctcaccaacagtgtatgagggttcccttttctccacatccttgccagtattttttattgcttgtcttttggataaaagccattttaactggggtgagatgatatctcattggagttttgatttgtacttctctgaagatcaatgatgttgagaaccttttcataggcctctttgtaacttgtatgtcttcttttgagaaatgtctattcaaatcttatgcccatttttaaatcaaatttttagattttttcctgttgagatgtttgagctccttacatattctggttattgatcccttgtcagaggggtagtttgcacatattttcttccattctgtggattgtgtcttcactttgttgatggttttttggactgtgcagaggcttttgaatttgatgtgatcccatttactcatttccgatttggttgcctgtgcttgtaggatatttctcaaaaaatgtttggccagaccaatgtcctggagagttttccaatgttttcttgtagtagtttcataacttgaggtcttggatttatgtctttaaatcattttaatttgatttttgtatattgtgagagatatcagtgtaattttgttcttctccttatggatatccagttttcccagcatttattaaaaaggctgtcttattcccaatgtatgttcttggcacctttgtcaaaaatgagttaactgtaggtgtgtggattcgtttctgggttctctattctgttccatttgtccatttgtctgtttttatgccaataccatgctgtttggggttactatatctctgtagtataatttgaggtcaggtaatgtgattccttcagtcatgttctttttgctttggccattctgggtcttttgtgattccatattagtcttaggattgttttttctatttctcttgtgaagaatgttattggtattttcatagaaattgcattggatctgtagattgctttgggtagtatggatattttaacagtattgattcttctgatccataaatatagaatatctttccaatttttggtgaactcttcaacttctttcatcagcctttcacggttttcattgtagagatccttcacttttttgcttaacttaattcctaggtatttaattttatttgtggctactgtaaattgaattacttttttatttcctttttacattgttcactgttggcatatagaaattttactaatttttgtatattgattttgtatcctgcaactttgctgaattttttatcagttccaatggtttttttgcgggatttttagattttttccaaatgtaagattatatctgcaaacagggatcatttaacttcttcctttacaacttagatgttcttatttccttctcttgtctgattgctttagttagaacttccagtaatatgttgactaacagttgtcaaaagtgagcattcttttcatattccagttcttgaaggaaagactttcaatttttcctcattcagtgtgataatagctgtgggtctttcatatatgacttttattatgttgaggtatgtttctcctatacccagttttttatttttgagggcttttatcatgaaggatgttgaattttatcaactgctttcagcatcaattgaaatgatcatatggtttttgtccttcattctgttgatatgatgtatcacattgattgaattgcatatgttcaatcatccttatgtccctggggtaagtcccacttggtcatgataaatgatttttctaatgttttgatgaatttggtttctagtattttgttgaggatttttgcattactattcatcagaaattttggcttgtagttttctttttttttgctgtatctttatctggttttggtaccaaggtaagagtggcctcatagaattagtttggaagcattctttcctgctttgtttttcagaacagtttgagtgggattggtattctttaaatgtttggcagagttcagcagtgaagccatcaggtcttgggcttttcattactagaagactttttattatgacttcaatctcgttactggtctgttcaggttttggatttcttcatggttcaatcttgataggttgtatgtctctaggaatttatccatttcctggagattttccaatttattggcatatagttgccatagtagccactaatgatactttgaatttctgcagtatcagttgtaatgtcttctttttcatctctgattttatttatgtgggtcttttccattgtttttcttagtctgactaatagtttgtcaatcttgatctttcttttttttttttttttttgtttttggagatggagtctttctctgttgcccaggctggagtgcgatggcatggtctcagctcactgcaatctctgcctccctggttcaagcgattctcctgcttcagcctcccgagtagttgggattacaggtgcccactggcacgcctggctaatttttgtatttttagtagagatggggtttcaccatgttggccaggctggtcttgaactcctgacctcaggtgatccacctgcctcggcctcccaaagtgctgggatttagaggcatgagccaccgtgcccggccaattttgatcttttcaaaacaccaactttttgtttcattgatcttttatattgtgttattcatttcaaatacgtttatttctgctctaatttttattatttcttttcttttacaaattgtgagttcagcttgcttttgttatttttaattctttaagatgcatttttaggttatctatttgaatgttttcttcttttttgatgtgggcactaatagctataaatttcccttttactacttctttcactgtatcccataggttttggtttttgatacttctgttaccatttatttcaataactttttcaattttcttaatttcttccttgatccactagtcattctggagcatattgtttaatttccatgtatttgcatggtttgcaaaattcctcattattgatttctagttttattccattatggtcagagaagatgtttgacattacttcagtttttttgaatgttttaagacttattttgtgacctaacatacagtctgtccttgagcatgatcgatatgctgaggagaagaatgtgacttctgtagtggttgcatgacacattctattaatatctgttagaaccatttgttctatactgcagattaagtctactgtttcttcgttgattttctgtctagaagatctgtccaatgctgaaagtggagtgttggagtctccagctgttattgtatcgaggtctatctctctctttagtgctaataatatttgctttatatatctgtgtgccccattgttgggtgcatatatatttaaaattattatatcctcctgcttaattgacccctttattattatataatgaccttctttgtctcacagttgtcttgaaatctattttgtctgatataagtatagctatttttgtcctttttggattgcattgtcatggaatatcttttttcatttctttaatttttaacctgtgtgtatctttagaggtaaagtgtatttcttgtagacaacggatcattggatcttgtttcttcattcagccattctacagcttttgattggagagtttagcccatttaccttcaatgttattattgataagtagggagttaccttgccttgccattttgttatttgttttcttttttttttttttttttttgtggtcttctctttcttctttccctgtcttacttttagtgaaggtgattttctctggttgtatgatataatttctttaattttttgcttgtctattgcatcgtttttgatttgaggttaccattaggcttgcaaatactgtcctgtaacctatgattttaaactgatgaccacttaacactgatcacataaacacacaaaagaaaaactaataaaatgctacactttaacttttttccctactttttaactttttgttgtttctgtttctgtcttattgcactacgtcttgaaaaattgttgtagttatttttttttattggttcatcatctagtctttctacttaagagtggtttacataccataattacagtgtgataataatctgtgtttttctgtatgtttactattaccaatgagttttgtacgttcagatgatttcttcttgttgattaacatccttttattacagaatgaagaactttctttagcatttcttgtaggataggtcttgtattgatgaaatccctcagcttttgtttgtctgggaaggtctttatttctccttcattattaaaggttattttctctggatatactatatacagtaaaagttattttcctgcaacagtttaaatatgtcacgccactctttcctggtcttaaggtttccactgaaaagtctcctgtcacatgtattggcactccattttacgttatttgtttcttttctctcactgcttttaggatcttttctttatgcttaacctttgggactttcattattaaatgtcttgaggtagtcttctttgggttaaatctgcctggtgttctataaccttcttctactttgatattgatatctttccctaggtttgggaagttctccattattaccccttttaataaactttctaccccatatctttctctacctccttgttgtatcaaataactcttagatttggttatttgaggctattttctagatcatgcaggtgtgactttttgttttttttgttatttaagttctaggctacatgtgcacaatgtgcaggtttgttacatatgtatacatgtgccatattgatgtgtttttaattctttttttcttttttgtctcctctgactgtactttcaaatagctggtcttcatgctcattagttcttctgctttatcaattctgctattaagagtctctgatgtattcttcagcatgtcagttccatttttcaactctagcattccttcttaattctttttaattgtttcaatctctttgttaattttatctgatacaattctgaattccttctctgtgtgattttgaatttctttgagttttttcaaatagctattttgagttctctgtctgaaaggtcacatatctctgtttctccaggattggtccctggtgccttctttagctcatttggtgaagccatgttttcctggatgttcttgatgcttatagatgttctttggtgtctgaacattgaagatatttattatagtgtttgcagtctgggcttattttcatctgtccttcttggtatggctttccaggtatttgaagagacttgggccctaagcccaataatactgtggtttttgtagactcatagaagtatcaccttggtggtcttggataagattcagaagaattctctggattaccaggcagagactattattcttttcctttaattcctcccatacatttggaatttctctggctaagccatctggaactaggggtgtggtcatgcaagcaccatatggccaccaccatttggactgtgtttggtcagacctgaagccagcacagcactggctgtcacgcaaggcctactgtaaccactgcctggctaccacctatgttcaatcagtaccctagggtggatccacatgcaccctcccttcccaggcgctggctgagcccagcatgattttgctctttgatgtgactaaggtcctatgatcagcaggtagcaaagccagccaggtttatgtccttcctttcaggacagtgagttctcctatggcccaggaaggtccatagatactatctgggagctagagattagagtcaaaaaccttagaaatttagcttatgttctattctactgtggctaacctggtactcataccacaatacaaagattttcctgctgttcctttacctttcaataggcagagagcctctccctgtggccactatcaccacagcccacagggggttctgccaggccactgctgatgttcacttaaagtccaagggctcttcagtcagcctgtagtgattgcttccagacctggaactcgtccttcagggcactgggctcccctctggcctgggctcatccagaaattgttccaagagcctaggtctggacttggggactccaaaagcctgcttgttgctctacctcactatggccaagctggtacataaggtgtaagacaaagtcccttttacttcactatagccaccacagctgggaatgtactgcatggcatctaaagccagcacatctcagagcccaaggcccatagtatattaccttggtattgccaccggttattcagagcccaagggctccttagtcagcaggtgatgaatctcaccaggactgggtccttcccttcaaggcagtgggttcccttctgtcccatagtgtttctagaaatgtcatctgtaagctggggcctggattggaggcctcatgactctgcccagtgccctatcctcctatggctgagctggtacccaagatgcaagacaaagtcatctttattcttcattctcctctcattaagcagaaggaaggagtcacttttgtagcttccagctgcactgcctggggttgaaggagaggtggcacaagcactcccttggccaccctggctggagtcttcctaggtcatgtgctaccctagtccactggttctaagcccagcccagcactaggagttgcctaggaattataattctatatagtactatatagtatttgtgtcctagactgccttttgagcttacctatgaccccagaatgctttggcccatgttggcaaggcttaccaagaaactcaagttcatatgcctgggaagggcaactttcttctggctagggtgtgttcgaatgttccctccttgttcaggccctggctgagcccagcatggttttgctgtctgcgtgaaacagcagcactgagttcaatgtaagtcccccattcagtgcgctctcccttccccaagagcacagactctctctgtgctacagggctgctgctgggaggtgggagaggggtggcgtctgcgattcaagcctgtctctcctaccttcttaaatgcctctttccacgacgtgaagtaaaaccaggtattgtgatagctcacttatttttgggtcctgtgatggtgcttttctgtgtgcagatagttgttaaaatttggtcttcctgtgggggatgggggaacgaatggtataggcttctattttgccatcttgtgctgccctcctagactgatatttttgtaaatttctgtagatatagcaattgctgtaaaagtttctaaaccacctacttttgtttatgtacatatcttgttgtagaccagggaaactagtttgtgtactggcaccacttcttagatcctattctatcctatttgtatagctgggaattaagctgtatagttttaacaatcagctttattagaaaaaaattatactgcctcttatgcctgacatgcttatttgatccaatcttttttgcttcaaaaactgtaattgcacagctgcaattataactaatatacatgtgtatgtatgtgtgtgtgtgtgtgttaaagggtaattattttcataattttcagttttacctgtcaaaaattttaattttactacttacatagaaagcttagacttcattgtatttgcattttctatcagttagctttttataaaatactaattatcctcagggactgctttatgtacatttccaagtatactcaaaccttcttgtagtcatgagagctgtgagatcccttaatttccaaaaataatttgattatacttacactaaaagacacatgtcaatatgtttatcaaatacacataggaaaaattcaataaattttttgcaggatgggtagcagatatagctatcatctaggatagttaacgccatctcatgtcatatgtaaattctccattggttgtggatacctgctcaactggttgcggatacctggaatatcatgttgagaaagatcttgagtccaagtaggttcagctaggaaagcttgtcatgtgtgattaatgatgtctagaagaggagcaggtgaggaggcatgaattctatgtattttcctctattaagtattatgcttgttctgagcttccagcagcaaaggaaaagcattaaacatggtggattatgttcattatctaatgaaaataaacattcacatttgtaagaaagatagatgttttccttgttctaaattctaaaatgaatttgtttttctagatggaaggaacattgtaaaatatgatgagttggtatttttcattgattcagtaggtatataacaatggttttcagtagatatacaaactgtgatataccactttaaaaaatatcaatccttgataatctaagaccatatcagaaggaagaaacaaggattatttttatgagaattttcaaaaatattacattgtacttgtaaatagtgacaaagaaagctagaatatatttacagaaattcaactaatcaatctgtcagaccctctttttctctatacaaacttataggtttataggttcttttattttttttcaaatcctttcgtttttcttctctgaccaaaaagatgatgtacattatactgaagagaaagacactcagcaatgaagtatggatttggatataacagggagattaaacggtcctgaaaggtgatatatgccaacttccaaattataactagtgttctaacagtggtgttgacaacctgtgactatggcagaagcagcatggagatgatttttaataattcatgaaggcagaagatataattgtgtagccagggtgctctgctgctttcttctctaggcacctttcccacttcccaccacctcttctttttcttcagatactcatgcgctttattttgtcccttgtcaacattttctacccctctctctatttctgcccttctcagaagtatacagttttcgagtttagtaggagcagatttgatgatgatctctaatcttgttattttttcagttggcaaaactgagtttaagctgttaactgtttaaggtattacctctcactagtgaaaccttagtaatgtttcaagctcaaaataatccctttttatttgatttttgttaggttttgaagggaaggtgagtgttaaagacacacacacacacacacacaccaacacacagaaagagggcggcttaacagcaaatgcaggctttatgctcagcataaaacctacagaagtggagcaccagcctaatgccagagcccacagttggttacaggctgggggtacttattggtatgggctgcccggcaggatattgataagatgttcccatgatgaggcggttctggcccttgttccagggggatgccatcctggtgctccaagcctttgtccagcaagatatgatagggatgtttctttagttcggcctttgtccaccttgtggtcaggtggttaggcaggatctttctcatgactcgaacccctgtgaaatatttcactttgaccaaggtataaaaaatagcagggagcttacaaaatggtgcagtttggtctaacagttttatctatcaaaatttaaaactatcagtattattcatacaataaataacactattataaataactcttagtaggtaaatgcattttaattactgttggtgggagtgtaaattagttcaaccattatggaaggatctagaactagaaatactgtttgacccagcaatcccattattgggtatatacccaaaggattataaatcatgctactataaagacacatgcacatgtatgtttattgtggcactattcacaataacaaagacttggaaccaacccaaatgtccatcaatgatacactggattaagaaaatgtggcacatatacaccatggaatagtatgcagccataaaaaaaggatgagttcatgtcctttgcagggacatggatgaagctaggaaccattctcagcaagctatcacaaggacagaaaaccaaacaccacatgttctcactcataggtgggaattgaacaatgcttggatgcagggctgggaacatcacacactggggcctgttgagagggggtagttgggggagggatagcattaggagaatgtaaatgacaagttgatgggtgcagcaaaccaacatggcacatgtatacctatgtaacaaacctgcacgttgtgcacatgtaccctagaacttaaaacaaacaaaaacaaacattaattgtagagatttccacttctggtcacagtacagtagcagaaactagatttagggtattatgtgaaacaaccccttcaaagtagacagaatatatgaaacaatagattttaagacaaaaggcatcaggccacgaaacttagtaacctgtgagacagaaggcaaatgaggtattgcctatgattgtcccaggttacagtcttaagagagtttctaggctattgtactgggagggtgaacccagccagcacctgtcagactccctgatttgagaagacagagctgagagtctggggaaactcagtattctagagtttccacgacagagtactagaaaggagagacaactacacagtgagagaatgctggagatcttcagaggatccccctcgggtctccgtactgaccatcaaagtcactgggagaagaataatttgaaaggattaaaaggaatagtgtctgacactcacagggtaaagtgtctgctcctactagccagactgaaaaatttataattagtgagtgatcgggagaatactcagtagtggggaggttggggctagaaaatgatacctccaaatgaaggcatcagaagaagtctcagaagcaaagtttctctctgaactcctcttgttctcctgtctctcattctcccttgaggctagccaaacaaaccagaatccctcttctccaaggcaagtcagagacaccagagccccttttcccaaagctattcataaaacctcaaaataaacgttactgtaactttccctccacctttctgtgtaaaagctggtcataaagaaattatctggcctaccatgtttgattgtaagccataggatccccatttcagaatgggtccttccccatacccagaaggaagaaatgcttcagagagagtccccaagaggaatctaaatagataggccttgctgggatttcccctccatctataaacattggctcatatcctttgtgtccaattatatttctacacagctgttcatacttggctgaacctatgcagaaaaatgaacagcttctcctgtgtcttgggccttcattctgaaggcttttctgtcgcataaaattatggttaaataaatttgtaagcattttatcctattaatttgtgtcttgtcagttgattttcagcaaaccttcagagggtgaaagggaagttttccattgccccaacaggaataaatagccctagtagtgctttgaacctatctaataagttataaaagaaaaccagaagggaccaaactgtaaccaagtaactgaacttttcagatgactcagaataactacagaggtaaaccctactgggccataaaacaaatctcaataaatttaaaatgatccaaattcatacaaatatattctcagaccacaatggaaataatgtaaaattagtaacagaaagatatttgaaaaaattccttaaatatttgaaaaccaattataacacacttctaaataacccatgggtcaaataaggaatcaaaaatggaaaataaaaagtagtttgaactaaatacaaatggatatacaacataatcagactttgtgagatgctgctaaagcagtactttgggggaaatttttagcactaaatgcttatattggaaatgaataaagatctctaattagtgacctcagcttccactctaagcaaccagaagataagtacaaattaaaactaagcagaaaaaaggaaatactaaatatcagagaaaaaatcagtaaaacagcaaacaggaaaatagataagatcaatgaaacaaaaaactgggtctttgagaagattaatgaaattgatcaatctctagccagactgataagaaaacaagagagtgaagatgtaaattgccacaatcaaaatgagaaaggtgacattactgtagattctacacctactaaaaagacaagaaaatattgtggggtgggtgtggtggctcatgcctgtaatcccagcactttgggaggccgaggcgggaggattacctgaggtcaagagttcaagaccagcctgaccaacatggtgaaacccccgtctctactaatacattaaaaaaaaaaaaaaaaaagccgggcatgatggcacacacctgtaattccagctactcgggaggttgaggcaagagaattgcttgaacctgggaggcagaggttgcagtgagttgaaattgtgccattgcgttccagcctgagcaacaagagtgaaactctgtctcaaaaaaaaaaaaaaaaatactgtgaataattttatgccaagaaattcaacaacttagatgtaatgagcatattcattgaaagacacaaattaccaaagctcattcaataagaaatcaataacctgaatagcagtgtacttatatataaacaaattgcatttgtagttcaaaatgtccaacaaagaaaactccagacctataaggcttcgctggtaaattctactaaacatttaaggaggaaataatatcaattctataaaaactcttttgtaaaatttaagaaaatacttcccaaatcatgtgaccagcattgtcatggtaccaaaactagataaaaaaattccaagaggaaaaactaactgtagcccaatatccttcattaatattaatgtaaaatctctaaataaatattttagaaaatcaaacaatgtgtacaaaggataatgcgtaatgaccaaatgaggtttatcccaggaatgtagtgtaatatggttatgaactaactaattaacaaattttaaaaaaaacataaaaaagaatgagatcatgtcctttgcggggacatggatggggctggaggccattatccttagcaaactgacacaggaacggaaaacaaaataaatgttcctgttcctacttacaagtggaagctaaatgatgtgaacacatggacacatagaggggaaaaacacactctggggcctataagagggtggagggggcgaggagggagaggatcaggaaaaacaactaatgagtacaaggcttaatacctgggtggtgaagtaatctgtacaacccttatgacacatgtttacctatgtaataaacctgtacattttgcacatgtacccatgaacttaaaagttaaataaaagaaagaaaacatttgatcatctcaataggtacataaaaagcatttgacaaatttagtattcttttaaaattgtatttatttttaaaattatttttccataagttattggggtacaggtggtatttggttacatgagtaagttctttagtggtgatttgtgagattttggtgcacccatcacccaagaggtatacactgcactatatttgtagtctttgatccctcactcccctcccactcttccccccaagtccccaaagtccattgtatcattcttagcctttgcatccttatagtttatctctcacatatcattaagaacatatgatattaggttttccattcttgagttgcttcacttagaataatagtctccaatctcatccaggtcgctgctaatgctgtcaattcattcatttttatggctgagtagtagtccatcatatatgtatgtatatatatatatatatatatatatatatacacacacacacaccccacacagtttctttatccactagtattccttttgacagaaagtctgagctaagtaggaatagaagagaagctcctcaacttgttacagggcatctacaaaaaaacccttatagctgatatcataattaatggtgaaaatagtgaatttttcctagtataatgaggaacaagagaagaatgtatactctcactacttctattaaacattatacagaggttctggcaagtaaaattaggcaaaaaaaagaaattaaagttgttttgattggaaaagaagtaaaactgtctttatttgcagatggctgattgtcaaaaatctgataaaatctgtaaaaaagatactgggactaataaatttagcatgttggcaagacataagacaaatattaaaaattaaatatatttttatatactagcaacaaataatatttaaactcacaaagcaatatcacaatagagagaaaaggtatggaatagtttgggataaatctgataaaatatttgaaagaattgtatgctgaaaattgcaaaacactactgacagaaataaagccctaagtccacggggaatatatgtcaggatcatgggttagaagatacaatattgttaaaagccatttctccccaaattgtagatttaatacagtcctacccaaaaactcagcatctaattttttggtagaaattgattaacttattctaaaaatcatgtggaaatgtaaaggacccagaatagtcaaaacaactttgcagtaggagacacgttagagcactaacattacctgatatcaaagcttacaaatctacaacaatcaagaaagtacggtgttggcataacaatagataaatatatcaatggaacagaagaagagagcccagaaatagacttactcatgcacacatagactgctgaatttctacaaagctgcaaagccaattcagtgggtagttctgctgttgtttttcaacaaatgatgctaaaattattggatgtccataggcagcaaaaaggaatgcaacagaaaatatgtaatttaaaacagatcatagatctaaatgtaaaacaaaaactatgaaagttttttgaaggagacataaaagaatctttgtgatattgggctaggcaaagatttcttacatgtgatgtcaaaagtacaatccttaaagcaaattgataaaacttggccaaaattaaaaatttctgctcttggaaatagattgttaagggaataaaaataagctacaaaatgggataattttacaaagcatacatctgataaaggatatgtattctggacacatgaagaaccatcagaattcaaaaagaaaacaactcaatttcaaaaataggcaaaaattaaaaaataatgaaatcctgtcatttgcagcaacatggatgagcttagaggacattactttaagtaaaataagccaggcacagaaaagcaaatatcacatgttctcgctgatatgtgggagctaaaaatgtggatcatatggaggtagagagtaggattgtggttactagacttgggaagagtagtgggaaatagaggatgaaaagagattggtttttaggtacaacaatacagttaaatagaaggagtaagttctagtggtgttcaatagcacagtaggaggactacttaaaaataacttattgtatatttccaaatagtgagaagagaagatttggaatgttcccaacatgaagagatggtaaatgtttgaggtgatatcccaattactccaatttgatcattacacgttgtatataggtatcaaaatgtcatatgtaacccataaatatatacaatcattatgtgtcaataaaaaaataggcatatcacgaaagaagatatttgatggcaaataagcgtgtgaaaaggtgctcaacattttaaggctttgaagaaatgcaatttaaaacactaaggaaatatagctacacgtctactggaatgtctacaatttgaaaagctgatcatattggcaagaatatagagagactagaactttcatactctgcttgtggaaatgtaaaacggtaaaaccactttgcaaacagtttggcagtttcttaagaattgaagcacatgcttatgttgctctgccatttctctcctgggtaaacacccaggagaaatggaagcatacatttgtacaaagatttgtacatgaatgttcatagcagctttatttgtaatagccgtaattggaaaaaaaaacactaatgttcatgaacaagtgaattgataaacaatctgtgatatctccatacaatgaaatactactcagcaataaaaaaggaatatactatgtatacacacaacatggatgagtctcaaaacaattatctcaaaaagccagacagaaagaacatagtgaataattccatttttgtagaattataggaaatgtaaataaatatttagtcacagaaaataggtcagtttttgtttggtggtgcttatggggtggcaaggtgtggaggctgggaagggctggagggcaaaattatgaagggtatctaggagactatttggaataatgaatatattcattatgttgattttggtggctgtttcatgggcatgtacatacgtcaaaacttatcaaattatacactacaaatatctgtggtttcctgtatatcagtttcacctcaataaagctgttaaaaacgctaattgttttctgctgccctttgccagctcttaggaattatctcccaaccatacaattttagctacaagtaaaatgcataaagatgcataatcaacgttgcttagtactcagcaactgtacactccattgacccctttttcttgtttgcaagtggctctgtaagatcatagaattccacaaagcagtttttaaatgctagcacagatgagattttaagtcaacaacaaccttgctgggtgatccatcatctgacctatgcttgaacaggaaacttacccccttcacaggagtgtattataactttggacagctctcactcttagaaaattggggctactgataggattttacttatatttttactggttgggatgaaaatatatgttgttggaagaagtttttaatattcaaaagcccaaatcttggagtggacaaacttccttaagagcagtagcactgtctactgcagtgatttctcagctgagtccttctttagctactagggcagagaaagggcagtatcaggtgtcagtggcccagtgggtatggcaatgggtacctgatcttcactcatgttttgttcaacataggagtatttttatgttttactgttctgattttatatgtttctcttgacaacatttttttttctttttaaatcactggagtggtggaaagaattttctttgagcagagaggcatggatttacgtatttctcacccattttttagatattttatacattagtaatgttagtaagacagagtgagtgaaatactcaggtattagaatggagagttgctatctcaacatcattgttttcgtattggtttgctgggtattttgttggtataacaaaataccgtaagctggctggcttaaacaacaggaatttattgtgtcacagttctggagactgcaactacaagatggaggtgttggcagctttgatttttgctgaggcccctccctttaatttgcagatggccatcctctcattgtatcctcatgtggtcctccctgatctgtgtgttgtctatgtcctgatctctttttttcttttagaacaatcagattagagctcacccttataatctcctttagccttaattatctctctaaaggctctgtctgctaatagtaattccaaatacttagtctaaaatactgaagattaaaacttcaatatataaattggagggggacaaaattcagcccataacagcttccatttttataaaatgaggacttacctttcaagattcttttcagcaatgataagataatctatgtaaagcactagtaaattatcaggcacatattagggatgcagtagatgataattattctaattgtgaagtaaatatgaatctatgcttatacagataaaatttattttagatcattgatgccctaactataaatgccattttttttctctgtaattttaaacgtgctgagctgtaataggaacctataaagacatcagagaaaaagcaatccaagttacaacacgtatctatttttaacaagcttaaatttggatgtgaatggcaagacttgacttttatttacacagctcatcacttagatgaagaacattatccctcagtgctctagagctgttaaagagaaacccaatgaggagcacaggttatgtagaaattacataatggcagtggtgaccatttgcactgcctccaattctcctcatgttttacctcaattccagaggagaaatgagaatatgcccaactgtgttttaaactatggtcataggaaattcccttgagagaaatttgagaagcctgaaattcaaacacactagtgaaatgcaaatagttttatttattaatggccgctaatggtctgtaataatcacagctgattaagtaaataagcaaatcaattattagaagtgtttgcagaattgaattcacaagttttctaattgttttttctttttatgcatttagccatatctgatcttgaattgagttaaggaaccaagcttcaaaagaatacaatttgaaggagcagaggagtatcctgtaattataaaacatcatgatactctttaaaattctatatgttactcataatttctaagttcaatgatctgtgctgttatattaattaactttcaaaattctaatagctgagcagatcacttgatttcacttgcctacactactttttgttaattaatggaaaccataaattcagagcccttgcaaattgtgctgcttcattgcatttagtgctgttttaatttctactcttaattaaataatgaggctccagagcacattcctaactgtgaggcaaactagactgtgtttctagctgggattccttctagccagcccagtcaatcaatgcatgtcttctgtaatacataggagtttattactcaaccttggaggctcatgtggctcatgtggtgggagacatgctgtaggaaaacccgtctttgttttgatcaagttgccaggattgcattttcatctcccctttcttgctcctacctggactggaaggggtgaattattttattttgttgtgattgatgcaagcctcacttgtatagaaatggagcaatcaggatacagtgtgctcttttccttccttgaaggtgactctctttgttattcattctgaagtaaacaaatatggattgggcgtctacagagtacctaggggctacagcagtgaacaagaagattcctttgagaaagcagataaatctccattcacaccagtttctgagccctgaagtatttcaatagcgagtacctgcactgtattttgagactcttctaacacaaaggaattttaaaaacacaccatttgtaagaagttgtcatagtaaaaaggtgtgatagaagaataataatttaagctgaagttcttataatggataagccaggcttgggttttacttaggctaatggtattaatctgcttctctccttattcataaatacatttcctgtctggatttatcatatttcactttttacttgcagaatctttttttttaattgggttgtttagcatcgaatgaaatagagcatatttttttcatgccataagttattcagctttaccattaggtttagaacatcagttacaacttatttttaagggtgaccaaatcatttatcacacatatgctttactataaaagagaagcacattttccatcattgacaaagtaactcaaggaccagagtaagccagaatatcaggagataccaaatgactatactcggaagcaagaaatacttaatttgactgacctagataattcttaattattcatgaatcatgtttccaatggatgggttatccaatcccttttctccttcctcttgatcctgcccttagccatttaatttctttctggcaaagaaagtgaaatattcaattttatgacttggcccactttaagaaaatatattggttaatcatgattcagaattatatataataaaatattgatgaaaagggattctaaattatatgcaataaatgttattacaatatttcattcactctgacagtgctactgaaaatgtggttcatagatgcttagaacacctatcaaaagaatttgagaggaagtgtttagaaggattgacagcaatttgcctttctcagaaatccacatacatgatcagtaaactcttattgaacaggatagaactacccaagaatcagggtaaacatacaatcagacattagtcttttactacagatagcttaattgctgatataagatgcccttgatttttaaatgtgtcatcaatttttagatacatctcaacattagagatgttaaaatgtggaaaaatacttattttagaattgttgatattaatttattattttatttaccatgagagagttcctttttgcagagggagtaaggatattctgagagtgattattttttttgtggtaattgcaaaagttatatgatatagtagaaagtgagttggctctgacttcaggcagactgccatttactgggtttatgagtttgaacaaggctcacattcctttatggtgaagaggaatgaaaatatatctcagggttgtttagactttcttatctcaatttgactaatggaatagaatatttggaacatgtttcatttaatttacaaaaaccaaatatgtgcagataaaaacacatatatacacatacacagataatttttgatgccttaatagaatataatagtttcaaaatttaccttattatgtagctatgacattttaaatatttatcataggaaaattagactgtaatcatgtgaatagtataaatcaaaagttttagaggtcaagaattacctcctatgcttttattatctgactcccatggtgaataatagctcattgaacagatattggaaatatattaaatttgagtattctgtcaaattagtttttaaattatctgtttaaccaatatatttgatatacatcttctacagaaatatttcacaactcaatattttaaattatttgcaatcatcatatagtcgagttattactaattttttagtgaatttgtattatatttaaaactttaaaatactaatgatcagctaatgaagattatttttggagcataaaatattttctttaagaaaataaaattctaacaaatagtactagataatcatgaccaccatgttcagttagcttttattttgaatagtcattttgtcaacagaattatatgctaacatttgagttcattaagtgagctagacctttattttatattttacttatcttatgcttgatatctattaatgttttgatatcttgaagtgcaatagtagaatattagcacttttttcatctaggttgttaagaaattcaaacttatatttggacataagctaaattggtaaattaacagaaaataaatttattatgtttcctttatatttgttcaaatagttatattaattgacatatacgttagtggcatattatggtgtacagagtattttacacatgttttaaatgctgttactattataaaaatgtattttagaacaataaaataaagaaaattatgattttttaaactcagcaattattttactgtccaatgattgctactgttaacattatgaggtgttttctgtcaggatttaaaaaatatattttaacttaatcagaagtattgtatctttttaaaatattatgtcataacatattcaatttaatgacagtctcttaataaacataattcgtaatatgaatgttaataacatttagaagaccattcacttcttattgaatatatttaggttggttccaatttttccatactataactagtgtactgattacatctgtacatatgctttacgtggtgtcttttgatcaccacaacaactctgtgtggtaggcaagtactggtttatacatttttcttttccgtcacagaactgagaggctaagattccaacccaatgtcacaaaatcaggaagttcaggtgccaactgagaaatccagatatttgatattgtattaattgttctttcttttaaagtgctcccatcattaaaagggtttaagacagagtttgtgcccatagaatatgacaggtgtagctgttgcatctgcatattggcggtggcaatgtcatggagtatgtagcttttttgatgagatctcagagttggtggagcatgtgacatatttgggaataagattgaatacaacataaatttaatcgatgtatgggatagaatatttgagaaaataatgatgttcttctgcagccagctaaaatgaaagggattctatgtaatccaactagatcagctgaaatcaattttggtaatttagaggtaaacaggtatttgagtaatgctgacctcaaatctgattaaccaaaaacatgcttagagaatgtaggactaaattatttacatgtacagattaaataatcagtaacccacaaatgcatttcaaattaaactgcaaagatgtaacttaagacatatagtttttagaaaaacaaaacatattttaccctttagttaggttaacattgttattttttcttatatccagtaaaagatgtgacagtttctcactgagccatttctcgtagtagtatggacttaatcctatcttctttttaaggggctgctctttaattgaatcatgggagtctttgtgtttcacatgagcaaagttggcgcacatcacagccagtggacaagtagatagggccataaagagctcacgcttagccctgagcaaaatgataactggctcatcgagaccttccccttcccaaaatgctgagggcagctgagaagacagccatagagaggaatgatttgcagtatttataagtgggaagtgccgatgcgtttctggttcctactctgacttccaaacggcgagctaccccagaataattcaagtatacatcttcttctgtccatcctggcttagtccctgttactgggagagctgtctttgctttttttgccttttaaaataagaattctgacttgattttttaatacccagaactctccaaaataatcatgctgttcttcaaagatttttcaagacagatttcatgcttgttgcctgggcccacagatgcagtgatttgaagtgatatacatttttcattctctcatgaggtactaatacaatacatttaaatttttctgagcctcaatttcctctctgcaacttggaagaataaaacctatctggaaggtttgttttgagacatacatgtgataatatgaataaagtatagtgaatacttaataaatggttgatattattatttacatagaggaggtggtcaaaatcacaacagaaagaaaataggttttggtatcaggtacatttattttggattttatctttgcctcttattagctttgtgaccttggacaaatccttttttttttttttttttgacagagtcttgctctgtcaccaggctggagcgcagtggcgttatctcggctcgctgcaacctccgcctcccgggttcaagagattcctctgcctcagcctcctgagtagttggtactacaggagcttgtcaccaagcctggctaaattttttgtattttagtagagatggggtttcaccatgttggctaggatgatctcgatctcttgatgtcgtgatccacctgcttcgggctcccaaagtgctgggattacaggcgagccactgcgtggctctgcgcccagcaatacttaacagttactacgctcaaattctttattattatctgaaatttctcttgagttatttagatagaagagaaactgggaagatgtattttgggggatgtttacagcgtcagaagaacttttctggaattatttaagagcaaattgagaataattctatagtggtcattaatttttggggagcacatggttgaatttggttgttgatactttgtgatgaagataatgtatcatgaatggttgacattcactgttgtaataataatttaagctcatataatgaatcagttcaaatcactgagcatatttacaaacgcgtatacataattaacatttaattcccctgaatatcttatttcattatccacacagtttaggaaaatatattaaatagacactggcaaccagcaagcttatgctctatcaaaccataagagaccataagacctttgagtttcttctgttagtgaccagatgagtttgagttaacttttgaagtaaggatacagcaagttgtacatgcttttataatcatactcactaaacaaagctttgaaagaatggggttggaatttggacttaatgggtaagaattgaaaatgggctattgtgtcttagaaacttcagtttgctgtagttcacgttactgagctcaaacattttctaagccaacaaactggtaactttacaagtttccttcctaaccgtgctcaccacattcatgctgtgttgaactgccatgcaaattcaataaggtttgattttctttctttgctatttcttacttgctttctatgttactttcttctcttttctgagaattattttctgaaccaaaaagtaaatgtttagcatcaggatcaattgtcaaataacaaacaaatattcaagttctaggataaaatgacatcttgtgagcaacccttaaattcccattaaaattttcactaggatgggggtggtggtggaacaactcataacattaaatgccaagacataaaatcaatctattcccagaatattgggagcaattagtaataattggtaaagtgaaaaaataagaaaattaatttggatgggactcagtgcaattcacaaaatgttgaaaagatgtatatcttgctattagctagtaaaatttttgaattgaaaagacaaattacaatagcttttttgaaaaaaaaaaatgagactcccaattgagatgaccaaaagttgaaatgttaaaaatacagaaatgggccaggtgtgttggctcacacctccagttccaacacttgggaggctgaggtggtaggattgcttgagtctaggagtttgagactagcctgggccacatggtgagacccccatcactacaaaatttttttttaaaattagcggggtatggtggtggtgtgcctgtggtcccaagtactcaggaggcggaggtgggaggaccactttagcacaggaggttgaggatgcaatgagctgtgttcaggcctctgtactctagccttggtgacagagcaagactctgtcttaaaaaatataaaaataaaaatgaggaaatctttattaaaagagaagtagaaaaagtagagttaaataaagacaaatctaataaaaattactgtgttaaatttgatgataaaattcagtggaagagctaatattcttaaaatgctgtggacaatggaaacacaataatttagttgaaaattaattaaacccatagattatattaactaaagatcagaaagtataaggtagaggatacggagaggtaaaatttttctagtttccttatctttaatgatagggaataaaaaatctccaatttggagggggaggttattgatagtttggtatttatagtttaaaaatgtaaacataaccactattggagttattcttcacaccttgcaaattactagaccatataaaatataaacagttataaatcaaaggaagcattataaaacagcataaaactgtataatggaagacaaatataataattctgccaattaaaatgaataaactcctctgttagcacataagactttcacatttcattaaaaattaaagtctcactgtttccttcatgcccaagaacagagaactttaaaagaacaaatagtcaggggaaatacccagagaaacacaaacagaaaaataacataaatggttatatgaattttataaaaatgtattttccagaaagattttgtttttttttttatttaaaggagcattaaaatctcagtgaacttataacagaaataaaaatgaggcagacattgttagaattagaagcaaaactgataaaaaataaatgtcttggaagaatttgttatcctatttagtcaataaaagactaagtaaaataaaataacacaactaggaaaaattagcctggttaaaatagtagacataaaattgaactctcaatctttcaaaaacctcaccctcttttaaataattgagaaacactgatttacaaaatccttttaaacttgaaatcatacagggtgcattctttaacgtaaatattcattgaacgaatgttaaggaaggcaaatagcctagaaattagtgacttctttcagagaaaaaaaatctccaatactaaaaatccatatcctaagtgagaaaatggaaactagaattattgtatgttaagtgatgcagccaaagcagaacataagggaaaactcttagctttatgtcctttcattattaaacattaaaattaaaacatattaattaaagattgaagtcacaaatatagaacaaataaaacaatgcaaacaaattaggtaaaatagctgaaggcagaaatcaataaattagaaaaaacaaaaaatttaataacgttctttaaaacaatgtttaaaattaagaataaaagataactaatgttaaattagaaagggtatacagactgtaaatgcaatgtttttaaaattttaatatttaaacttcaaactattatatttgaaaacataaatgaaattaaacatttctgaaatgaaaacatacaaattttcaaaacgttctctagtacaaatcaaagatagctagaacaacaattctaatgaatagtacataataaaagattattccttgcataaaagtttctgaaataaagtgattttacctgagttccttcagatttttagagaaggaatgcttctctgtacccttccagagcatgaaaaattgagaatattgcacatcccattttagggagccagtattaactttgctcactgaatatgataaatttattacaaaaacactatatgtctgacaaaatagaatagatttggtggcagatatattaatttgatctttgagctatctctaccacatccccttctttgcttagtgaatcctcattttctttgtgctggctgcagtctccccagcttaaggtgatgaatcatgattggtctaattctaagaatgacaatcttgttcctcttttctatcagttcatcttccaaaccctccttagagcttgggtatggctgattgactcaattctggccaattgcgcttaaggggatctctactgggaagcactagagaaaacagaattggtgtcctaatacaaggatcaggtagaagacaagggcttgttgtctggagtggctgcagtcatttcataacatgaggtggcaagagggaaagaaacaaaattctttgtggttaaaaatgatgaaggagaaagaaaaaaagagcttagattactgatgattatgattggcctgctgaaccagtcgtgatatcacctgtgttctttctgttaactgagataacacaacacacacacacacacacacacacacacacacacacacaacatgccactgttacaggtttttaaaattaatttggtttaacacttggaagcactcatctgatacaaaagcaaaaatccaaaataaaatattgacaaataaaaaaatagcagttcacagaattatttaccacactttagtaaagttatataaagaagcaaggagagtcacacattagaaactgtattaacctaacaccacatcattaagtctgatgatgctacaaaaatttatattcattattattttagaatacaattaaatttggaataaatgtattaagttttaaaaataaaatgctggtgactttattagatgtagttgagataagttgaggatcctcattattgtacactattttaatttaaacactgttctgaaagttctagctaataacatatgttctgaaataaacttacacattttgaaaaggaaattaacactattatttgaaaaaaatatgattacatgcctgtacagtcaaagaaaataactgaattaagagtgttcattaaagtggccctcagtgaaatattctccaatctaatggaattaacagaatatatatagagaccatagaatatggtgatgatagcactgacatacctaaaattgaggaaatttatcaggatacaaaactatgatcaacatccatttctatcaggggagacagacatttagtttcagttactatgaaggtctgttgtgctttgttgtgaggttattttctcatcttttatcaaggcctagatgaaatatccttaagaacatttatcatctttcattcttatttcatctctaaccaacaacattctgataaattatttagcttttcagatgactagaatcttctagtacttttattactaataaaaacatattcccataaatacaccaataagttagcattcttgttaactataacagaacaggaaggatataaattgttcaataaatgataactgtgaaaactggtttatataaagaaaaatctaatgatagcatatttgcataatatatgtcaaaatgaattctacatggattaaacagaaaaatttaaataaataaaaaaactttaaagaatctaggaagaacatgtacatgaatgaatatttaacttatatcccaggttcaggaagaattttcaaatagggaaatcattagtatgcatgatgaaatcttgcttagattagtaggtaataattattaaaaatgtatttgaaatttaaatgccccaatataagtaagcctgcttattttgggaggggtatcttctttttttagaaagctgaaaaacaattttaaaattccaatatgttttctgcattccctccccgtcttgggtgagggaaatctagaggacttttaagagcttttacaagttctaagattatttggaggctgtctttatgtcccccggtcattctcattttccccttggattgaacacattaagacaagcatctactcttcctgtcccatgattgcaccctcatttcacacagggagaagtcagatagcactcagtctttaaacttccttgccaggacctgcttggtgcccagaacaggagagaaggaaaggtgggctgtctacctctatcatcataagttgaggcaactggtgttctgtgagcttttctcccagcacctgtcatacaggacagttgagggctcctcttctattgcattcttgcactgcatggggcctcatagtgcttgctcacaatgaaaatggagaaagaaacaacatgaaaatggtggtagaaaacttgcatattgtgatataatcagtggtcctgcttgagtaagcagctagaagaccccaggcacccagaggctcttgggagaccccccttcaccctcatacagggtgagagagaaagggttctgaatttgactgcaattctgcctaaatgtaatgtcattacaaaagtcttggcttctgcattctgctctacctctcaaggtagcctgttaggggcctggaaattttccataaaatggttcaaattcatccttaattatctaccatataaaatgcaaattcaagtataggaagggtatttcgaggatatcaatatataatgtatgaaagtgcagggtgcataacagttgtgcgtataaagctaaggctgagaatatacaaggctgagaatatacataaaaggaaaagtaaaaaagtaaaagtaaaaaagatttttttaaaagtaaaaaagataccctagaaataatattacaaggttaatgaatcagtgagtaggtttgccacaaataaaacaagcagaggtttgattgtcttagtatacaaataattcttataaatcagtaaaagtaaaattcatatgggccaatggtataaatagatattttacaaatgaaatttaagggcacttaagatatttggaaccattcaaataaaaatgaaatttttctttgtatagattgagcaaaactatttttaaaaataattttgggaaggatagggtaaaatggtgagaagtctctttaaaaagcacatatatatgtgtcttatatatatatgtttacatatgataaaatgcaaatcaaaaccacaatgagataccatctcacactagttagaatggtgatcattaaaaactcaggaaacaacaggtgctggagaggatgtggagaaataggaacacttttacactgttggtgggactgtaaactagttcaaccattgtggaagtcagtgtggcgattactcagggatctagaactagaaataccatttgacccagccatcccattactgggtatatatccaaaggattataaatcatgctgctataaagacacatgcacatgtatgtttattgcggcactattcacaatagcaaagacttggaaccaacccaaatatccaacaacaatagactggattaagaaaatatggcacatatgcaccatggaatactatgcagccataaaaaatgatgaattcatgtcctttatagggacatggatgaaactggaaaccatcattctcagcaaactatcgcaaggacaaaaaaccaaacaccatgtgttctcattcataggtgggaattgaacaatgagaacacatggacacaggaaggggaacatcacactccggggactgttgtggggtggggggacgggggagggatagcattaggagatatacctaatgctaaatgacgagttaatgggtacagcacaccaacatggcacatgtatacatatgtaacaaacctgcaaattgtgcacatgtaccctaaaacttaaagttcaataataataaaactaaaaaaaaaagaacatcaaacaatagagaaggttaaacattaagataaaattccttttctttcctatctcacttgcagagacaacaattgttaacagtagttttagttttgttctggtgatgaatattaaaatcttaaaaccctcatgtacttttgcttgtcaacttgaagtagtactttcaacttatgaaaaatgaaaggtttaaaacaccctaacttcctgccaatctttgtaagcttttatttttctaattattctagatttcttgatttattacctacatatatatatatatgatgtatatatgcatgtacgtatatatatgcctatgtgtaggtgtatctatatacatataatattttttatcagaactcaaaggaaaggaattaataggcttcattacctttccccctctttttcatcctccattttataaaatgtgatacattattattgcatttgtcaaattctgtaactgtagttattttgtgcattgctagtagattgatagtaaaaactgaaaaccagcaaacattattaaaatattataattctgtacacatgtatcatggtaaagcatagtgtagttggacccatagaaaagttacattctttgtctacaaactttattgctgaaaggatactcttccaatcatcaagttgtcattgattctccctcatttatttaccattttctgtatttatttttccattggctgcctgtatttcttgtactctatgtcattatcattattggagtttttttttattttgatggaaaatctggtctagtaatttctttcacatggaatgtttgagtgctaaattttctatttgcttgcatttgcaaaaatgattttattttcctcttaccctagtttggcagggtataaaattataaattcagtgtttttctttaagatttaaaaaatcttgctttttcatatttttgtgtatatattgctagtgagaaactgaagataatgaggagtatgatgttagatgcacatatggatcctgttggtttgtatgtaattggtttattttctctagatgcttttaatgtcctttctttattttggaattctgaaatctcatcaggaagtttgtaagcatatgtctctggttttgttttttaaattttatttatcttgctcagccctacttgaaccattcccatttaaaagtatgtgtctttctgttttgctttcttttattgtttccattatttctttcttctctccattttgttcctactgcatggatgttgggcttcctggatttttcatctgtgacctaaatttatactctttatctatgtttttgttgctttttattctgtgagactttacttctgttctacagaccatgtgcttagttttcagttgttttattctaccattaaatccactgtttataaactctgaatcaaaacctatcaatgggtcatgaaataaatttaattatttaaattatgatatttaatttaaaattaaatgtcagattctaatttcaaaactgtaaagggcacaccatattgacaggaggcaccgcacagtggtgctgatgggccaaaagtgagctgtcccatgacgctctccattgtcaagtcaggaggactttactttgagagtggaaaatcttagtaaatttaatttcttagtccagtgttgtatccttttttgccacataatgtggaggtttgacattctcttaagtgctgttaggcttctttctctcaggcttcaacactcatacatgtaactctccactgggagatgacccattttcttaggagaaatgttctttggccttaatcttgagagaaaaaaaaaagtcactagcctccatctgcaggagaggaaaaggggataccttgtccagccattctaaataatagtgctttaagtaatctactcatatgcttatcttggctccattctgaacttgtactcactcactttgaacttgaagcttctacagagctcccttactgtagttttttatggcctgttttattctataccaaattacttctgatttctatgtttcagaaattcctgaaattccatactcctcatatgaagcatgttggcaccttttcttctacattcaaaaatgttatggtttcattttttcaaaaatactttgtctttttaatggaaactcttgagaagggaggaagacgtgtttgttttgcgtcttcaactggataagcataaccttccttgaaataaattcggctttatatggaaaaaatctgaaaattcttaccttttacctaatgactccacttcaggaaaatcctgaagagaaataagccaacatgcagaaacagatttaagtttatattaaattgtaagaacaacacatactacctgaaagacaaaatacagtatagaaggatggttaagtgaattatgatttatccatctgatagcacaatgttgtaaaaagtcgtatgtctgagatttgctcaagttatatggaaaatcttcatagttaatgtcaagttaaaaactgcatacagaactacatatatataataagatcacaaatctacaagtaaagatttgtgtatgtttatggaaaagaacaagaatcaattatgtcaaactattagctgtagttaaatctgattggggtcctacttattgtaatttctttttgtctttttaataattttttaagttttatataatgaacatgttttatttcacattaatatattatgtaaaatattttaaagataaatttcatttttatatccttagtccctgggaggagaatcctgcctctattttttgcctctatctgtgtagtgtgatagcagttataatacttcatttaagaattatctctttgcatctgtttcatcagcataatttgactatgggttttttgcaggtaagggcaatatcactttttttaaaaaatagtattttgtgtagaacaggtgttcagatttttttttttctggtagtctttccgaactttgttgtttctgaattaataagcaacagtccttaaagtgtggtctgttgacccctagtgtcaacaaggcactttcaggtatcctgtgaaggtaaattgttttcataataatactaaagccttaatattgacctttttcactgtggtgacaattgcactgattgtataaaacaatagtgagttaaattcatcttagcacaaatgtgaaggggcagtggcctgaaattgtactcacagtcattgtattattcattgccacacactcatagtaaaaaaaataaattgccagtttcactttcaaatgtctttgaaggaacagtaaaaagtactaattatattaaatcatgactcttgaatatatcactttttaatattccgtgtggcaaagtgggatgtttacagaaacacttctgctgcactgataaaagacccatttcaagtgcaaggcagaccagtggacttcaatgtagcagaccacacaaagttcactgatctggcttcagattccacattgcaactaacctttaagacactaccacctatcaaattttgattcggtatcgaagaatatccataactgtcttaaaaggctattaaaatatttcttgtttccacaacaacatatctgtgtgtagccagattttcctcatatacttcaaccaaaataacctattgtaacagattgaacgcagaagcatccagctgtcttctattaattcacaacattaaagagatttgtaaacataaacatgacgtgattctcactatttttgaatataggtattttacgtaaaaatatcttatgttaacatgtcatgggtttattattgttatgtttatatgaatcaatgagtatatatatatatatatatatatatatatattttttttttttttttttttttttctattctcagttggtgcggtggctcacacctgtaatcccagcactttgggaggccgaggtgggcggatcatgtggtcaagagatcgagaccattctggccaacatggtgaaaccccatctctaccaaaaatacaaaaattagctgggcatggtggcgcacctgtagtcccagctactcaggaggctgaggcaggagagtcactcaaactcaggaggcggaggttgcagtgagctgagattgcaccactccactccagcctgggtgacagagtgagattccatctaaaaaaaataattctcatattattaaatgtttagtatagtgaatactggtcaggtgcagaggctcatgcctgtaatcccagcactttgaaagtccaaggcgggtggatcacccgaggtcaggagttcaagaccagcctggccaaaatggtaaaaccccatctctactaaaaatacaaaaattagctgggcatggtggcatgcgcctgtagtcccagctactcgggaggctgaggcaggagaatcacttgaatccaggaggcggaggttgcagtgagctgagatcataccactgcactccagcctggctgacagagctgtatatatatagacaattacaacccatgtatacagaaactctttgggttcttcaataatttttaagagagtaaagggatacttgatagttccacagttttttacttattattaaaaaatgctcagtgacttactcaaagatacatgttactaaagggcagaggcagaatttaaactaagatctgactgctccaaagccctcctaagcatttctatattcaatctttgaaaactaaagttgttttttttttttcagttctctgacagtatctcttcctgaataatttcttgcttaatcataactttcattaatctagcatcaagcaggttctgagtacttattggagtgtatttgagtaaagctttcaaggaatttggtgtacatatctgaaatatccttgacatctccagcagttatcaaccattctttcttcacttagaattgacttccagttgtcacacctgtgcctattcaggctttcagatgctctataaactactttttttacttctttgtctcttccagatttgaatgttcttaattcttagtgagcacattgttatcacagttgctgttaatagttgctatggtaggttacaagtaaaacaggtattgttaagtggcttctataatttgctattagtcactactacaatatttctcatgcaatcagaattgaaatttctatatttgtgtacagcaatcattgtgacagctctgtctccagtggcttgtaacagcccccattgcttatagtttcagttttcatgtgggaatggtgctaaattatggtgctcaccaatacggcttctttctatgcagctctgcagctactgctggctcttctgggaattttttcttttgtatatccgtccctggtggatcacttgccctttcctgccaaacccttgcctctgtctgaattctggtttggctcttcctttgtggcccccagagcctctgccaatcttgttggagcatttgcagcaataggaaaaaggtcccccttcttcagggcacccatgatcttgaaacagagactcatgaagactcatgaatgggtttcaactcccatccatcctctctgccaagcccttgtggagaccacagtccatgaccctgaataacttctgagagctcacgttgtgaaattgatgcagaagttttgtgacattgatttttaaataccaccacagtgctccaaatgccttctggatggctttccaatttcaggataagaatacaaaacatacactaattttcaaaagaaaatatcatcctcccactttcatatctggtccttacagaaaaaggtatgttacttccatacagaatgtctgtgtgattcaaacattcactccttgtgactttagtcttaaattgcctttttttttttttttttaccaaaaacaaaaatctagatgatattttactatgtttaatcatcaatccagagagattccctaaggcttaaataaaatgaatgacttaagggattggttatcacttgtgtcctttttctgggatctccttctcccatttatactctgatgcattagcttgcttctcagtgtcaactcttgcttgtctagacccttcccagttggtaatttcttgaccctgactttttttttttatatgtggccttctgatcttggctttctctacttttctccaaggagagatctactgacaacactatcctcagtttgggaggcctgttggctttccctctgagattcttccgtgtattcagtctcttatcacatttggactgttcttggatgcgaatgttgaggtgccgaacatactttcttctggattctcaagcctaggtaaagttagaccaccagatagccatatatacagaccttgtggaaacgattttgctccatgctttaacattatgcttttaacttcactgagaattatattaagttatgtctatataaaggttctgcaacatttattagcaacctgtgagaagactttgcccataatttttatattttggtcatccttacataaaaatgcacgataaactcatcttagaatactgtgtgtaaaagatttgtcttccctaactgttttagttattttgggctgctataataaaatgtcatagactgggtggtttgtaaacactagaactttatttctcacagttttggaggctgaggagttcaagatcaaggtgttggtagatccatgtcagtaaaggcactcttcctggtttgcagaaggtgatcttttggttgtatccttacatggaagagacagagggcaagagcaagctctttgtctcttcttaaaagggcattattccattcaggaaggttctaccctcatgaactaatttcctcccaaaggtcttaactccaaatactatcacattgtacgttaggatttcaacatatgaactttgggaggatacagacattcagtccagaatgcacttaaaatagtgctcatagtttattacatatataatgtatagatacattacataatgaatggtaagtaatatgtcatatttcctgtttcacattggctactaggaagcatagagctatatgttgtcctcatttgctataaatatacttagaatttgacaatcatgtatttagtttatatttatgagattcctcaacttaatgtcttaaatgactccatgaatttatgccctgcctcattccaacatatatctaagcataaaaataaagaaatgatttcagaacaagagtcacgcaataaagagaggaaatagttacagagatcctgtagatgcagagaaattgaaggaagttagagataacaaaataagctaatgttatctgggccagtgacggtcagcataactctaaatcgccttttctccaacacatgatgtatttctaccagcttcacttttcccttcgtggtattagagtcttctcatctttattcatggtaagaggactcagatgatatctttgccttaaaatctttccctctgacccatcctgcttggtcattagaggaagcgtcacagaaggaagaaagcagtattatgcggtgccttccaagacacagacacaatggagattgctgtggcaccaatgcgtatagagatgtattaatgtgatgataagtagaggggctgagatcttgtcagtactatcttattgcatgggaagtttacagattaaattcttttttctgtgtcgtattttattcatctttaatatcccttataatagcttttcagctgtagaagaaacctcctttcttttcttttcttttccaactacctctttcatagggtcaggagctccctctgagtccactactcttagatgatttgtccccaataatttatatatcatcacttaggttatttttagttgattattttttggggtataaaagagtgaagtgcttataaaagcttcctggcaaggagagccagagtgagaaggtacagctgtgagtaatgagtctaccacttatctctgggggcttgcaggacaggtttttagcctgtttctcaacatttctttggacttgtttgtaaccttggtagtcacagtgtgggagggtaaaagggaagagcagggctatgtaagtagcaatctaatatataccgtctctttctagatgagattttatgatctaatgtattctttaaaaggaaatacaattgtagaaattttcataggaattcagagaatcactgcagaattatccttttaatcatataggtgcacaacaaatacaaatccacatacatatttctttttctctacctcatccccacacccctcctgacaaaactcaaactgtgttttaagtgttctgtgcttggtggtggctgctgccattttcggcaattattttattttttttcaaaatctgttgctttgaaaggccccgtagtgttatgtagggtgtaggtctacacagttattacctactgtcagcaaaactgaatagctgggagggaataattatacaatcccttttgccataagccacttctgaacatattgcaatatgtactggattcattttaaagtggttgtaactaaatgaatcacaacctttggggatagggtaacagatagtatattaagactgtgtaaagtctgtaagaagtcagtatattaaaatctgtcaggaaaggtcatccttgactatgggttaatatctgtagtcagtaccttgaatagtgccaatatgtgttggctctaatctttgatatgactctaggcaggatatgagatctgaaactttcactgatggagtatgaaccagattgacaaacttcttagtgaagagaagtttctgctgtgtgtgtgtgtgtgtgtgtgtgtgtgtgtgtgtgtgtgtgtgtgttttcatgattctgggtattttaatgttaaagtatatataggattttatagtttttggactttgggatctagggagaaaaaggatgtatatcctttcctactcaccctacccccaaccaattacctttggcgaggtatcagctgtgttttgctaatgagcattgccggaagacgttctggaagctcacagaacacagggacttgtaagagtcacagtggaatcagacaacctgtcagtctgtttatacatgtatgctggcattttctttgcaagacgtgcaaaccaattagagggaggctcccttagaacacttttgagggggtggacacttctattaatgtttggcgtgggcatctgttgtattggagagaatgagatgaacaattttataatcaatttttggaagagaatttgaaatgaaggttacgaaaaagattttgttgtaatatgagttagcagagaaaagttagttttgtatctctgtacagttgaaagttcaaaagaataaggacaagcatgtttccttggccatgcttttcatcgaatacctattgtttttataattagttcattataaaggagagttgtgaatagtgacctttgtccagtctggctcatgaaaagcaagcatactgatttcctctgggcagtgtgatcagttaccagtaatggagctgaaatgagtgatcctgatatgtctttgcacattttattgtgcaaagaaatcagggccttatgcagtttgggagaaggctgggactttaatgttagtaccataatgtcttgccttcctcccccacctccttgcaaatcagtacttactgtcagataaactcaactggtgcctttagaagaaatcaggtgaatatggggcagaaacagtggagttgcattttgaaggttttctattatatgaatagcagccagttagagaatatctaaccatcagcagttttattttaattctttgctatatggaacctcagggaggaaatgttcttgtctgtagtaaagtgtttcttttctctctaaattgcacaatgattgaaaattgtggctatcattatttgtactatatgcaattataaagcgatggtgataatatttagaatttgataatgaagctctgtaaacatttattgtaaaagttggtgcttagcttcagcattccagaattactgttaccacatcctattgaaaaactgataaggatctgtaacactgaacaatatgtgggtattgtcatctcattctttgtaggtttccttctggctggaaatcttggagttggtcattataatcctttgctttaaagtcgaggcaaataagatacatgttaatttcaatttagagacaaaattgtgtcctgcctgtttcttacttggactaaagcttacattatacaaaatcatgtatttgctttgttatagtaacaatgtaaaaatagaagttctgtaaagagttaatcagttatttgcttctgattgtttaagtgagacaacctgtgggtcttttaggtcttggtctttcgttactgcaagacgaaagagtaatacacgtattgctttaatgccctcatttatacatagaagtatcttaataaaattgtgaatgacagggcaccaaatcattgtggttataatggaaatagtcaaataattgttatcagtagaccctagtctgagtctttgtggttctgctgtttattaggaacatgatcaagagagttgacagtttttctgatattcaataagatttttgtgctaaacaatatttaatattctagctctaatagtctatgtgtttatagtaatcataatcatttgttaatatgctcagcaagcagtatttatagtcacctggggaccaggactttattagatgttgaggagattataagtgaatagccataaaccatagcttacaagagcttgcagtccagaggagaagacagccaggtaaacaactaacagacagatatacaagtacagaatggctagtgctgggcaagatccatctgcctatgtactgctgagatacttgtttaaggagtggtatagtctgaatgtttgtgtctccatggatgggatttgtgccctcgggaaagaggccccaaagagctgtttccctttctaccatgtgaggacacagtcacaaccataggcgtcatctttgagaaggccagcactgactagacgctgaatcttccagcaccttgatcttggacttcccagtcttcagaactgtgagaaaaaaaaatatattgtttataagccacccagtttatggtattttgttatagcagcctgagttgactaagacagggaggtatgtcagcctgtggaccttaggggtcttctgggaagacaggtggaaatgatttagaatcagattctctggctagaagagtcttcttcctggaagttttcaaaattgacagggaacttatactaagataaaatatatacttgacctttatcttattttttttaaatcagcagttattctttaatattatcaaatattcagtagttgttaaaatttccaatcatttcataagagtcataaatgtactttataatgtgtttgtttgattaaagtccatatatggtgaatgggtgatatgtctttcaaaactgcaagtcccttgcccaaccccatcatctcttttcttttctttgtacatttttatttaaccaagttggaaaacactctgcaggatattatccaggtgaacttccccaacatagcaaggcaggccaacattgaaattcaggaaatacagagaacgccacaaagatactcctcgagaagagcaactccaagacacataattgtcagattcaccaaagttgaaatgaaggaaaaaatgttaagggcagccagagagaaaggtcaggttacccacaaagggaagcccatcagactaagagctgatccctccacagaaactctacaagccagaatagagtgggggccaatatttcacattcttaaagaaatgaattttcaacccagaatttcatatccagccaaactaagcttcaaaagagaaggagaaatacaatcctttacagacaagcaaatgctgagagattttgtcaccaccaggcctgccctaaaagagctcctgaaggaagcactaaacatggaaaggagcaaccagtaccagccaccgcaaaaacatgccaaattgtaaagaccatcgatgcgaggaagaaactgcatcaactaatgagcaaaataaccagctaacatcataatgacaggatcaaattcacacataaaaatattaacttgaaatgtaaatgggctaaattctccaattattaatttttaagaaagttttaaaattcacatataatattgtacatatttatgggatacatagtgatgtttcaatacatgtaatgtattgtgatcaaattaggggaattagtatattcaccatatcagacatttatcatttcttggtgttgggagcattcaatatcctcctttagttatttgaaattatataatatattattattaactgtagtcatgctacagtgctataccaattttaaagtctaatgggaatcaatcaggacaataaaggagtcatccaagtattccctggagagccatttttgtgtgtgtggaagatgcttaagtgggggtggccaagataatttttgaactgaaattggaaaccagatttgttcagactatggttgcacagagtaccatcttgcactaaatcaaaacctttaattttgttggactatgatgaaataatcctaaagtgctatggaattacttctaccactgtagtagtttcttctaaaaaattagacctgacctttgtttttaaaaatgtgttaattttcagagttgacagatgttttggtgtgattctggatggtgcctctcaaaatatcctccaactgaactctgaagaaatgtgtccagttttctcaagagagacaactggaaaaaacaaaaccagcaatggcagcatttggagaatgtaataggcgagctgccacacaggtggaaacagatagttctttttctgtgagggctgcattgatgaatacagaagtggcatgattggattagtggccatagaaacaataacacagaaatgaaagcaaggtcagtctctaggtgagaagtggcaatagcttctaggggagtcctcaggtattatactagcagaagcaagatgaaaaatttaaatttaagtatcttaaatgttcgttggtgggggaggggcatagcccacataagaggaccaaagatcccttgctcctcttatctcacagattcacctttccatttgtaaaatttgtcactgtcctctaaatttcaactgatctaacatgccattaaatgtaagacacaccattattttaggtatcactaagaaagaaaagtgtaacaactaagacttctttatcactgtatatgcactgaaagagctctttaaagtccaacttaaagaatctataatggttatactatttcagctggcaaatatcagagccaaccaatggtgcaaagaaatatactggattctgcttggcataaaacacctgagtttacagtccaagagctctttggtttgcaaagagaaggatggagaaaaggaacagcactttccgcacagggagaaggattgggaaaatagtgataacatcctttgcagctgccagaaaatacccctaatttttaaagataatttcaattgtaagatgtgctttgatttcagagatgtcaaaatgtgaaaaaagtacattttagaatagaataaataaggtatgtaagagcttttcagtgttgccaggtgttgaatgttgaaaggcaactaggccacttagaagaatactgatctgttgacaagttattttttagttattttagcaactcaccaatccactagcaaccagcctgtagtcataagtaaaagtgaaaatagacgcactgtgctttactctcttctctatgtgagagaaagagagggtacacagaggaagaaaaacagtgaaactgactctgtcttgtcttttgaggacaaacttcctgtgttgatattcaacccatttggagcctaatagtgagctaggatccaacctggagaatcatttgatggttgaaaaggcaacatgatgaacaagagccaccagggggctagaaagaaaagaaatatagaatctaagttgaggtaggtaataggatctaaactaaacattattatttttacttttgtaggagttcatgcattacattgacttctctcgggttttcttgggctacagaatcatggatgatatgataaaataagatgttaatttatattcctttcattctatgcccctcaatcccctcaacagttgggtaaagctctcatgtgcataaaagtcagttggagggctatttagaaaatgttcagtccaggctctgatttttgagattttggagtttggtgaagcattctgaaatctaaatcctgaaaataaaggtcctgaaatttgtgtttttttcaaaagcatctccagttatttataataaagatatatatgtgtaacgctttgagaagcatgctctcatagttaatggtaaattaatttagatgatcctctcttcattctcggcactcctcagttcaagtttcctttttcttcaagaatccatagaactagaaaatttttcccccacagaaattatcttttgttgcaaatcaaaaacactatctttggcccagtttgagctagatggaaatttcaaaaaatatatatctttacatagaaatatacttatttccagaggtttccatagatttcacattatggaggcaagctaagtgcttcaaagtacccttcatcacccattgaatccaatcatggctgggctgctcagtggcaaatagcattcctcctgcaattctgcttagttttgaaggctaccaagacacaattcacaatgttgtttttcttctggaaaacaaacaacagaaaacacagaagatctattcatattttaaatggttgacttggtaatacgttcagagggaagaagataacatatgataatatcgttaatagatgacacaaacatttgtgataatggcccagcacgttgtacagagtaatgtggatggttggatggtgtgagtggaagtgtgtcagctggcttttagcccactggcaaaatgtttggacaatttgtgttggataacttggtggtggatttaagagaatttgttttccttcacaaatgaaatgatgtatgcaggatttgatatgtaattctttgagtaagagataattgctgtacacactaaccaactatttgcatttagttagcaacagtttctactgaactttatctcatgtttccttaagtaaatgtttggaagtatgtttgtcttatttagtaactttaaaaaaattttaccacatctcaatgcttctcaaaggttatctaaatatctactcaaggaaaacattctttagttactcagcatcacaggcttcagttttctcatatgtatgacggcttgtaatgcataatattcttaccagccctgacatgcagtagtagttatttatatggtattgtattgtgtattttagaactacattcaattacaattcagtctgtattcattttaggaaggatgcatgggaatgtgttctgaagcagggcctctcaaagccaagtccttaaaccacataccttagactaatcttggatgctggcagaaaatgcagattccttggttctgtggactgaattgtctcccttcttcaaattcatacattgaattcctaagctccaatgtgtctgtttttgaaggtagggattttaggagataagtttaaatgagctcataaaggttcattctaatccaatgcaattggtggcctttataagaagacaaaaagcgttctctttctctgtctctttctccacacctgtgcacactgagaaaaggccatgtgaggatgcagcaagaaagtggttgcctgcaagcctagaagacagccctcacattcaaaatccaaccatgctgccattccgatcttgcaattccagcctccagaacggtgagaaaataaataaatttctgttgtgtaggccactcgagctatggtattttgttatgacagcccaaactaagacagattttggcaccaaaaagcagggttgctgctgtaacaaatacctaaaaatatgaaagcagctttggatctgggtaatggtaggctagaagagttttgaggtacactctggaaatacggatgttaaaggtgattctggtgaaacatcaaggaaaaaaaggaaatatggagagaagcttccatgttcttagagaatacacaaataatcatgaacaaatgatagaaatatggaccttacaggccattctagtgagatctcagatagaaaaaaacttattggaacctggaagaaaggcaatccttgtgataaaggtggcaaagaacttggctgagctttgttctagtggtttttttgaaaggtggaacttgccagtgatgaaattgaatatttatcagaggagatttctaagcaaagtattgaaagtgtggcttgggccctccttactgcttatagtaaaatgcaaaataagagaggtgtattgaagaaggaattgttaagcaaaagaaaattaaaccttaaagatttggaaaattctatcctatccataatgtaaaaattgagaaagcctgttcagaagaaaacatcaaggatgtggctggactaccgctaaagaaattatgggattatatgaacagagacactgccagtttcaagtgatgggaatggagacataatgaaatcaaggaagaccataatacttcttacattctacaggacaggatgataatgctcctcgcctgggaatgtatcaattcttcaacaaaagggaagaagaatccaaaggcaattcaaaggtaaccagagccactgacttgtctttaataacccagatggcctcctaccagagtcatcggggcagggtcgcctggagccatgggagtttgatctcaacctggcagagccttaggagcaggacatgctatcctggtgggtctggaagcctcacccagcaccctagtgagtccagaaggcagaacattaagccaaagaacaagattactatcaaggctttagatttttatggagttttccttgagagatttaggatttgcttggatcttgtcaccactttcttccttccggtttattccttttagaataggaatgtctatcctatgactgtcccactattgtcttttggaagcacataacttatcaggtttcacagatttacagctggagcagaattttgcatgaggatgaatcatacttccaaccccacccatatctgacttaggagatatttagatgagactttggattttagactttagaattgatgctgaagtgagttaagactttggggtctcttggggtggaatgaatgtattttgcatatcagaatacaaattatgggggtgagggcagaatgttatgaactgaattgttccccctcagttcacatgttgaagctctaactttcaatgtgactgtattttgagaaagtttttaggaggtagttaaggttaaattgttggaatcctaatttgataggattagtgtccttataagaagagaaggagagagaaagttatctctctctccacacacatgcctctagagaaggccatgtgaagatgaggacagcaagaaggtggccacctgcaagccagaaagagagcccttaccaggaaatgaacaggccagcaccctgatcttgggcttcctggcctccacaattgtgagaaaataaatttctgttgtttaagccacccagtgtgtggtaatttgttacagcagctggagctgactaagacactttgttccaatccagtcttactaaaaatgaaatagcagaaatgagatgactcaggaatccatattataaagactcccctacccttggcacatgtacgtagccacataggataggatagatcatgctatagcagcaggatggcaggggttggggggtgaggtttggtgggattatttgatatcaacatttaagtgcctgagtggccaaggccccaggcagggttaggaacttgatgctgctggcagacaatggtctttgctcagctagccagtgaaaagttttgatcatgtatggataattctgatgacctctgcaagagaccagccacacgctgagccagtcttgcctaccaggtgtacaggccacagaatctggcaaatcccgggacttctgcttttacttctctcaagaagggttgtatataatatgaagggaatctggggtaaaatctgtcaaagtttggggatttgctaccacaggtgtcctgcaaagaagctttcttgtcttctctccccaggtccttggaatctctatactatctccaacacaatcctctcagactatatttagtgttacatattttgttttctttttattccacatcttcctctcccactaatgtctgggcttgcttgcatatactcacactcttaatgcacttcacagtgagcttgtcctggtcccagactttcaccaaggaattgataaactagtcactgcaaatatattaatgggctttcagatgatggcttgtcagctaactaacttactttttaatggagagccttcataaggcaaagctcagaacaccaataatttattctactgacatatatttcaggctgtttctctctaattttatcatgtaggcagcttctcctgtgccaacatgagccaaatgtttagaaaaatgagcctatagaaacacttttcttatgatttgtctactattcattctttaatttggcttttgcttatgactctctcagttctaactttacacagttccaactcaggtcatcaagaacttcctcttttctaaatttaatcaacacttcccagtcttttgacccggagaggcattgtacactgctaattattaccctggtgttgtttaaaacaacacaactaacaacactaaaactgacagcaattgtgtgtccactgcatccaaaaaagaaaaattccagattataattaacaggtataagtatatgcccttgattcctagacccttattcctctaggtctaaatcaaaagaggaactactgctggaggaatgaagttaagggagaaagagggatcttacttcccccctgttgcctttgcagatttttaggcctaaagtaagctccaactaggagagaacagttgccttacagcagggtttttcaagctctacattactgagattttggaacagatgattcatttttataggtggctgtcctgtacattacaggatgcttagcatcatctctggtgtctcaccatgcttgtggcatctcctgtccctagttgtgacaattaaaaatgtctccagatattccctgatggctttgagggcaaaatctctctctctttttttttttttaccactgcccttccgaaattgagaaccactgttttaagggaaatgaagttgggagctttaattattatgcaggagaggatatttgaattactgtacagaactgttcttgtgactaaagaacataggagaagtcatgagactggccgaaatttcatacagtgctagggaagcaaaactttaaaaaacccgtgaaaaagagtaaagttgttatgattgtacactctttttgccattttttgtgtaaaattattatatgcatttctttatctttagggtatttgaatatacatttcagtttgccccaggcagttttgttccaggttaactgttcatagagcctcctttcactctcaaagtgtctgattttcaataataaattatatgattgccctatactttctgttttctcaactatactataagcttcatgagggaaataactttttatttgtgcactgacatatccacatggtactctgatgtagtgatcaatcaataagtatttgtcaaacctaccataaaaacaaaattcactcacttacatatcagcaggattggtctggcccctatgaaaacaatgcaaccaggtttatagggaatttccttctgtgagtttggagatcttttctaggaggtactgggcttcttccccagattcaaggagtaggctggttatacacatagctgagtgtgtttcactgtcattgctctacaagacttattatacttaggaaggataactattactcatattttacactttattggtaggcctgttcttatgattttttccaaaggggaataaacaagcatagaatttagttagtgagggatagttcttatacaagaatgcagtgccaaagaagaatgccttaaagaactgttctagattagcatctttgttttctcatccttctttattttgtccttcaccactcttgagtatgcgctggcacacacatataaacccatgcccactaaaaaaaaaaaacttttacatactttgccttatctcgtgattttcaagttcccactttgggttacttgctgaagaaactgagagctactcttcatttaggagcaaatcaggcgtgatatgtaatgttactggtagaatccacaatttggcctttgataagaacaagatggcataattagcaagtcttatgacttgtcgcctatctgaagaaaagcataaaattgtaggattatagcaaatatccatctgcattaatattttggaaaatgccttaacacctctagaattgctaatatgttcccttctaaaataatggtaaacttctagaaataattattattcaagcagattgagaattaaataatgttattttctcgcccttgctgggagctttcacatgaattaaatttctcatgccattgagaatcaggcattatcaaccccattatatatatttgagttaactgtgattctgagagcttattatttaaatgcaggttttcctgactctgaaccattgtatctttcagtatttcattagaaatgcttcggccaaaattggaaggcacaaagaacaaatattctaacaaatttatttgatttaatcaggggaaacccttgtgaacttgaacaaattattaaacaatacttttttcatctgcagggtgaagataatgagtaaccacctcctaggactgttataggactatactcagataatgtgtacatagaacttgacaaactctcagcacatattagggttatgaaacttttcatcaagcgcagagaaagaatgcattctgatacatttatcaatgatttttaacatgtttaggaaataattttggaacattaataattctttacatgttcttttgttttatgcagtcagcaggtatttaatgagagtatgttactttggcaacattgtgctagacaccatagagaacatagagaaacatgctgtcctctgttgagtcacttactttctgattaagaaggcagaacatacacattaagttagagaacaccaagttgtgagattatacctatatgtgcaacagaagtttggtaaaaggagaaatttctgtgggccctaaacttaagagatgggatgaactttgttagttggctccttaagagctgtggaatatggagagggagggagcaggggagggaggacatgtggaggggatggtgatcatgagtaaagttatggagatgtgaggaggaaccaagttcttttgggaaaggagaagagtgaagcaactggacagagccaaaaaagaaagctgtttgactggcaactctgttaaatgcttcataattttccttacaaaaatcttgaaaagtaaatttgtaaactaggcctgtttcactaggaattgatcacgttttcttcattcctttcagcagcaatagagttgtgaaggaagaaaggacatgatagggagcctaagaaatgaacagtctcctagtgtgggttttctccacataagatagtatatacaaacatgcaaaggctaatctgtgaaatgttttacatttacatgtgaaataacctaagttgattaaaaatgttacttgtactacataaatgcatcttcaagtagcttctgtcctactctttgaattttgctttcactaaagaggtagggaatcttcactggaccgattaggctcctttatttccctacctctgatatttacctgctactgatggccttctaatatgtattgcagtggaaagataatatttctttagataaacttttgagaaattttaataactttgaagcctatttactagcatttatcatatctatgttttcaagtgtcctttcatgccatttttaacagctttattgcgatataattcaaatatcatacagtttattcatttgaagtgtgcaattcaatcacttttggtattttcatagttgtataaacatcaccacaatcaattttagaatattttcatcatcccaagaagaaaccttgtatgttctttagccttcactctccgcttcctccatccccccagctctaggcaaccacaaaacttctttctatttttatagatttgcctattctgggtgtgttgtataaatggaatcttatgaatgtgactgacgtctttcacttagcaaaatgtttccaggttcatccatattgtagcatgggtttcaatacttcattcctttaatattccattgtatggaaacaccacattttacttgtcagtatatcagttgatagacatttgggttgttttcactttttggttactatgaacaatgatgctataaacatttatgtgcaagttttaatgtgaatatatacctaggtatctatgcatcataccgtattgctgtgttttaccctttcgtgccattttgatcttagagctggcttcatgatatacctatatccctgcatcccagacacaagcatctgtcttcaaatggtcttgtttcatttgtctcaattttaggccatctgcttttcttatgttcatattctctgtcatgtttttatataaatccagggtttataatgccaaccaaatgcatatctttaactcagactatttctatggactttaaatctctgtatctaaatgctctttaccagataggtcttttttaatatcctacagggacttctaaatcaattttttatttgcctccattctaatgtgctcctcctcctatatattatactatgcgaatgacacatcctaataagaaatccaatagccatatgaggctcattcctttccttatccaattcatcaccaaaccctattgattcagtttcctaaacatatcatgaatctgttacttcttctccactctcactgacattgccttagtttaagctctcgtcttctctgtgcactggcctcttgtcactctgtagatcattcccttcctcttccatctattcttcctgagcctgccagaaggattgctctgaaacacagatctatgcatatcactcccctgtctaaaatatctcaatgattccgagtaatctgcagaataaaatgcaaacttctgggcttggttcaccaaacctttcacaatctgaccctaatgatctctcaagcttctttttgttttcatcctgtgtacagacatatcaaaatctctaaaagttctcagatgagctgtaggtattttcaccttcatgtcttaacattagttacctctccccatactgtcctgccctcaggccactttgtggtttggttaaattctactacaattatttttgtagcaaatcaacattttattaaaactgcagttatcttttagttattcaagataacttgattctttcaaaagaactttcagtaatctcagtttgatacattggactctttaagcatcttctactttatttcactataaatagtattgggctatattttaagtgtccctttactggctcaactttctcaactgattgttagttctttgagttatggaactatttctgttttacctttgccatctgtgcactctgtacattggtaagcactaaataatatgttgaatgaatgcatgagttctatatgctgtaaatattccaagaactctcggatcttatgtttcaggttctctgtgtttcatctgaccctacttcttccatatctagagccagagacagtattaaatacttgatatgcaataactggtggcactcttattctaatgcccttttcttacacctattttcatgccaactgctagcttgcttttctttttggttctcacagttattcttgctgttttgccttagttttggcaaggataaatgcttagactgatctccagaggccacaggacttgatctcactctatggctagtgagagatctgtgtgtgcctagtcttcatgctgggaccttattattctgtgcagctctgcaggtgactgtttgcgaaaggatataatgggaaatgaaacatttgcctctgtaatagttattgcttaaccactaaagaaaagtccaaatacatttccaagctttctgtaagtttcttctgactctccctttaaacaattgaatttattagacttttaaaaaggaaggagattgggggcgaaatgggaattcaacccctgcatatcattttttcctcacacacgtagttctagaatcacttctttaaacatctacttctgttgtaaggaaaatagcctttattttggaaccccatggggcttctgatttctctcattcaaatgaatgtatttgcagtttggaggaataattaatagggctctcctgttgaatgttgaatgagagagtgaatgccttttagccaaaagaggttcttgtttgtacacataaaatgtgatattctgcataaaaattatagttaacatctaataccaaaaatgtattacaagtctcttaatcagttaatacaacttttcaatgcactttttttttacatttgagttttgattggtaacatgaaaggtctttgatttggatattgattaacataaaggagtatagaaaaataagaaaatgtttagcttttttaatatttcatacagcgtttcatatgaatagaaaaccattacattggtgattatataatttagtgtttatcatcaaaaacatatttcccatgtttttaatctctaaggagtttcttctttaaagacatttgtaaagatttcagacactaaatggaaatctatttcataaagcaaagagaaacaactgtggtattgtaaggatcagaagtagttagcacactgaagttactgtttttttgtttcaaaatacagtattttgaagaaatatgaatagattttcaagcctacaggtcacctcagacattgccaataaggtcaagactggaggaaattaaagcaaaagatataaagtagtaaattttacaatgagacattgtttattccaggatataaataagattcatatatgggtatgaaagacatcttcataaaatgtaatatactgaatgactattttgtaatttgtttcagaggtttctgttttgaacttctgaagtcattttcaattctgataatttctatagactgagaactgtttccttcaatatttataaaatgtttcttgagattaccccctcgatactcttaatcttggaaaaaaatttttgaaatctgtaagaaaaatcaagcattcctctaagttggtttgtataccactccatcctccgcttgaaaaagagagaaccaataaaaggtatgatttgaaagcgcagatttatttcataaatttctgaaccaccctttatggatacccacagtatataaacaaccataatcagtataccaaacaacagcaacaagcacactgagaaacaaaggcatttggggaagagcaaggagcaagtgggcagcttcttgagttgctttttgttgatgatttcctactggaagtctgtaaatacaactgggtatagaaacagtcaacacaaatttgcacttttatggagtattgtgtgatacaaaatatactgggaaaaatattttatgaagaagcagtcttttgatgaaatgtatcccataaattttatgcttgactatataaaaagagataagctgaaaagccaagtcattttctaagttaagagcaaagacttgctgaaatgacatgttttttcttttcactggagcttaagctctgaggcgaggcttttggagggttgagctatagcttttcaagtatattgacaatagcaagcaacagacagtcttgtttagcttctgagtaggtttttttttccccctcctttcaggtattattgttaaatactgtttttaacctgttgtaatgtaatgaaaatggctgtcagcaattcagttcttaccaccaatcatgtaagcttgatgtaggaatattcactaagattacacaccaccaccagcagcagtaacagcagcagcagcagggaccctgactcttattgctgataataatgaataagttgaatatcaggctatgaaagtagtacatggtgagacttgaagaatgttgacagttactgaaaccttttttgcccacactgctcttgccctgccaactcttgggcaatatttcacagcaatctgaagcctaatattccccacatttatttatttatttatttatttatttatttatttatttactcatttacttaacaaacacgtatatggcacctattatgtgccaggcactgttctaagtgcttaagagaacctgatagggtatatattcttattttctttaatttgcagatgagaatacatgggtaaagtagcatatcattactttcccaatgccacacactataagtatttgaactcagtctacctctagaatctgtaccttcaatgactgagctatagacttctgcttctccagttgaagaattttgttaaagtgtgtccctgactgacagacaaaataaaccccctaaaagttaaaacagaaccaggtggccacagcttgctgagggagtggtgacatactctggattcttagaaccgtgttgtaaaagtaccacaggacttcctgtattagcttgccacatggaacatataatcctggcattcattttttaagaaggaaggggaagagaaggagcaaaagagaggaagagagaaaaggaagaaaagaagaataacagaatgaaacaaagtgcacaaaataaaaaatttattaaggtgattggacctggtgaatattctaaaacattcaagcttgttcagaagccagatacaatcaagccaaaccaattcctgttgataccaagataaactgtggctggaacacccccctccttcctccctcaacacacatacactggggcatttgaaagaaacatctcacagagacttctggtttggggctcacaaaccaaccaatcacaggtcactgccaatcagagctcagctatattgaccaatcagaactaagtgagtttcaacggattgggaatctgggcaggaacatttgctgtaaaactggaaccctctctatgttctctagaatgtaccttcctctttccctgatggctgctgcctcttttgggtttgcagacttcactggaataaagcctctttcctccaaattccattgttgttgttattgttttggagactgggtttctctcccacacccaggctaaagtgctgtggtgctgtctcggctcactgtaagttccatcttctggactcgagggattatcctgcctcttagccgcccaagtatcgggggctacaggcacatgccagcacctctggttaatttttgtatttttagtagagatggagttttgccatgttgtccaggctggtctcagactcctgggctcaaggcatctgcctgcctcagcttcccaaagtgttgggattacaggcgtgagccaccacgccagacccaaatttcttttcaaataacttttgttcatgttctgtacagacaggcaatatttgaaaatactgttgtaaaaaaggagcaatatattgatagccatgaatatattgactctaaacaatataaaggtattgtaaattgctaacaggtcttgtgaattgctcaaaggtgaactaaggctttagtggaggggcagaaacgtttaaaacctaggctgtgaggggatctagaaagcttcagaaaggctctaggtatatttggaaaagggaattatggaaggtaagatgggtgtccacatggacttctgaacagagttgactgttttagaatactcaccatgtctaatcaccttattacatttttaaaaattgtatatactctgtttcattctgttattctcttcttcctcttcttccttcctctcattcttctactctcctcttcccccactttcttcaaaaattaatgccaggattatatgttctatgtggcagtctaatattttactttttgtttattgaatgcaaaggacaaaagctctcgtattaagtatactcattgtgatttagagtgacagtccttgggtacattcaaatccacattggtgtgtgggtttgtgttagcacacatagtgttatatttttgtttttagttaagttaaaatgcttatcagccaggataagtgttttacaataacacatacccacacacatctcagcagtttaaaataacattttatttcttactcatgttatacatttattatgtgaggacaattgcactgaattgtcttcactttagatctggcttgataaagcagcgactggcctggaatatcagttaccatagctgagaggaagaaactttagaaggttgtacattcacaattaagatctaatttacaaatcattgaccagaattagtcacatgaccctgtctcatcactaagggccaggctgtgccatcccagcctgtgcccagaaggcagagaagccccatgacccaaagtagcaaagacttgaaagccagaataattcatataaatattggtaatttttttttagaaaaatcagaggatttgacaacattgctccacagccctcaataggaaagggttagcgccaaatagtagatgtcattatataaattatatggcaaatctcccatttaccatgtcctcctaatctccctgattagtttcccattattatatttattgttcttgcactgttctttttcttatagagagtttgaaaggaaggtatctgtagccatatttattaaaagtgaaaaaattaaagatgcacactcacaaaaaaacccaaagcaaaacgaaaccaaaccccctcaggtttcaaaaagaatggaatcgtatttttttttttttttttttttttgagggagttaaaaaaatgtctctggttgctaaatactatttaatcttggggaaaaatgtctgtcagaatttacttgatttgtcctctgaggatatttaaatgatctaccactggtctaagtaaatctaagaatggggtacatgcagatcaatttattttttcttaaaaaatcttttaaaatttcatttggggttacattttaaacttatcattaaatatacacatattgttataaatagaagttatagtagttcagctttgaaaacactagtgcaggccaggcgctgtggctcacgcctgtaatcccagcgctttgggaggccgaggcgggcgatcacgaggtcaggagatcgagaccatcctggctaagacggtgaaaccccgtctctactaaaaatccaaaaaaaaaaaaaaaaaaaaaaaaaaaaaaaaaaaaaattagccgggggtggtggcgtgtgcctatagtcccagctactcaggaggcagaggcaggagaatggcgtgaacccaggaggcggagcttgcagtaagccaagatctctgggctacagagtgagactgtgtctcaaaaaaacaaacagacgaacaaaagtagtgcaggtagaatttaaaataaactatgtgcatgatgtcatgcatttttccttttgctgtcttagatgttcttaggattttattttctctaaaaattttcaaggaaaattccgatactttttatcttgacagtgataggaagagagttgaatttagtcaattagttgccaaatgaaacagttactaatgtaagtagactgaatgtaaattttattgtttaaaagaacgttggtcagccaaacatatttgaagtttagaggaatcatttttggaatttgtgaatgcatggttgaaagtaagattaaaatatttttctagtggcactggacactactgaagttaaacgataataaaatactatttaccattttatgtaagaggatgatcaattctgaatgatgtacattttaggaattgatctatagaatctaaaagttggtatttcacttaccattattgtgaggcgacctctacatattgcagagaacaatttttttttaccttttactattaaattgggatgaaatgtggctattttactctaaatatgtagtgtcacactttaaaatatattaaaatttagatggtttaatatgtattgccaattcatataaaaggctacagacaggtgagtgaataattttaaggaatgacaactcaatgtgttattcctttcaaatgaaagctgtaaaaactcattctgcctactctactcttagaagctaatataagttcaatttcttttcatatttcaattgtaactgaatttaaaatgcctggtttccttcatctcttacagtaacatttctcaaaatattttctgaagtgcatgtaaatcctatctgggaaaaaatatatagtagattggcttttgtgtgggttaatcaagtatggatagataaaaagacactctccttaaagcaaagttgttaagcatttttgatgaaggtgcatctcatagttaaatatgataggcaccaatttctctttttcagagagaatggaactgacatcacagcatattcagggataatacaagtatccatatattctgaataaagggaactggggagggatggtgagccctttaagaactttcctcagatatgttacttaccagctttgcatattaagaaggacattttgatcacaatatagagaatccctaagcaattaattgtttcttgttgtttttcccacgttcattttcatccctaatgtcccatgggctttctgctaggtacttttctttttctccatcaaattttggttttcagtattttagtatttcaggattttaatttgtttgttgaatttcttgtcttgtatgttcttattcattttgtgacatgtataccatctcttgataggaatatgcctatttcagtactcaagacatggtctggaaaatcttaaatctttcccttgacattttttttctgtttttttttccctgcgatttttgaactttactttcttgatgttatacacaactacttaatatcctgtataatggtgtcattttttcccaaggtctcaatgatttccttaatcagccatttcttccattgaggcagaatggtgttgagagagaaacctgtcatttcattgctttttcaacctcctgagagattgtcaactagtcaagtagaacatttatcatatcccctactcttaactgtgtgagaatatccaggtagttaaagactttctgtatgtttctgagttcattttctcttcactattaggaaagcagtatttacataaactcttgtttagccatctttcatctgtctgtagcctcagtgcatagtgcaatatctaattattgttcaatatatttgttgagtaatataataaatagttgattccagttcagtctgctgtgtactaaaactttttgtatctatctttattcttttataattatttattttttattttaaaaatttattgtattgtcaggaccacaagcaaaatgtgttgcagtgtcttaattcttacacacatgctctctccatgctctcccctcaggtttgcagatttcagttcatgtcttctacatgtcacacagcatttttttcacggtggcctgccttgttattactgtattgtcatgagttctaaccaatgtcttagagaaaccaatgagaatttgtttactaaatatattgttttgaacccaattttattaattattcatattgtataaatattcactctctttaaagttttaagtattgtatcagacttaagccataacttcaagttagttatgactgagaatggatgagttcttcctccaaattattctttccgggctatatatgtattcataacatcccattgtattgttttatttgagcttttttcccttctcttctatattacagtttaagcgatcctgctgaatgtctattttatgatctcaaatatttgaattataagttgcttctactataagaagacactggaattaccacaagaattcacatgtttaaaagatgctttcccacccgtaaaagtgtcagtgtgtgttcattgtacacgtagttaaaatgtgtgttgtagatttgaacagagaccttttaacttagactcaagattatgtgattattaaaacacactcacatctcaaatccttggttgtcttataatgtcatgacctttaactacaagaagagatgcaaatactgcatattctcacaatacttaagcggttagaggggcattttagacttctttaggtttttccacttattctcagagggttagcagaattgatgagtgagtatcaggtgggtttgatacatttgggcaggaagagagcaaacttctctattagctgtcaaatatacatcaatacgtgatgccttccctgtatttaacagcagttcgctagaccatctcccagtattctgttgatctagtaacttcaagttttttgtcacatagaatgttataatttaatcaaaaaggtaagtggcaaccttctttgagaaagtcttatacctgtaatgtaacttcatgaatccaaagataaataatagaacagtggtctttaaccttagctacatatagaggactttagagaactgctgatggctgagatccattcccagagattctggagtacaaaattttaggaattcaattttttaaaagattctaaggtgattataatttgcaaccaatttcgagaaccactgatatgatgtagcacatacagatcaccattggatcttcctaagatgcagattcattttctggggtgtctttaagtgggggcctgagagtttacattccaaataagctcacaggaaaagctgatgctgctggttcatgaaccacactggagtagagggtgtgtagaatttatctttttttttttcctctttttcataatcttctactctccagaacttggatgcttgttttaattccatactatatccctggagttttttttttctttcccattttgcttgtgagtttttgctcacaagtttttctaagaacttgtttctaataaaccagaacatagaaagacattcctcgacccttgagcttcttctagcaggaaggccaacttgcatttatagtgcacataattggtgagtgcctcaggcaggaagataaatatatctctggtcactggaaggtttctttcagtggtcttatcttccaggtctcaagttgaaatattgtcttttataactcccctgggagtccttcttattaacttctgggacaaactgtatccaagtgattcaggcaaccaccctcccctgcagcgaacctctacttaattgcttgtttttgataattagctccaagtggccctagtttcttgaatgttgaaagcaatattccaatattcaatattctatttaaaaactcatagccttttctgtgtctttttctaacttaccaagagactctcagatctctgaactatgttaaatggtgtttctcaaatattattgtgtgtgagcatcatctgggctgcttattaataatgattcctgactccatattcagagatcctgatttggtgactctttagtaggctctagtatctgcgtctttattatgtgccccactaaggtgagtcttttgtaagcaatccaaacttggagaaacactaatttgacctggcttctcgagctttaatgtacattaaaatcaccagataatcttgttataatgcagactgtggcttggggatgaagtatttctgacaaaccctcaggtctaagaggccacaatactctaggtactaagactttagatcatgtaattaataccacactacagcacaattcagactgacaagtgtacgttcctttaatcaaataaaggacatttttacacttatgcttttggttagaacataagcttcctttttttgtttgtttgtttttgtttttttgagacagagtgttgctcttttgcccaggctggagtgcagtggcacggtctcagctcactgcaacctccggctcctgggttcaagcaattctcctgcctcagcctcctgagtagctgggattgcagatgttgcactaccatgcctggctaatatttttgtatttttagtagagatggggtttcaccatgtggccaggctggtcttgaactcctgacctcaagtgatctgcccgacttggcctctcaaagtgctgcgatgacaggtgtgagccaccatgcctggccccaacataagcttcttaagagaaaaaaaaaaacaaaaaaacaaaactcaattaatagaataccaaacttggaagggaccttccagatacctaattcagaggtcttttgcctaagctcaactcaagggcccaaacgttcagctccacctcattttgtttaaagaaaaaattaaatgtaaacgtattttaaaaagacttgactctccagtttttctcaggtttcaaataactctgaaagcctttgagtctggcaatctgctggaatccattttgttttgcttatggctcaggaagaaaaagccgttggtcaacatcacactgctaattgttgaagagctaggattgggcttaaaacttgtcaccaggctgggacaagtttgtttgtttatgcttaagtaaaatctgagtcatggtgctgattttaatggttctctggatgtgtagaacttataaaaagacatagaccctgttttgctttagtattaaacatcaaaagttataaaagactaccctggagatttattgttgatggagataaggttggtctttgccttttgcttgctttagtagatttaacataagagagatttatctaaagcatcaataaactggcatctctcatgttgaaaggaggcctcagctcttcaaaacatcctttacaggtaacatgaagttcttttccatcatttgtggaatgtattacagtgaagaaaaagaaaaaaaatatttaggaggaaaactgagtcaaaaagtctggtatggactgagcagaaatttttggagctgaataaggctgaattcaatcaaaatcctgccaccttctgtgtgacagatcctaggcaatttattttatcatctctgaacgattttcctatctgtgaaatggagataataatagttaactgcagagctgtttgtaattctatagcatgatagatatatctataacatgaaacacagcaaagaataattatcagctgtcttcatagatttgttttcttacatattatagctactgtaaattctcattttttcatatttgctttctctgagtaaaaggtataattttagtatatttagtctactgaaatcttggaaattttacatagtttacttaaaagacataaatatagatggaagattgtaataaaaatattcaaatatatatatactcaaatatgtatacatttaaatataacattcaaatacatacatttatttatatataacattcaaatgtgtgtgtgtgtgtgtgtgtgtgtgtatatatatatatatatttttttttaacctttttattaaaagccaggccaggtattcagaataaaatttatgagaaaaacaagatgacttgtactgagttataaaacggaagattattagctttatagaaaataatcatttggcaagataaaacatttctctgagacttttgctatggatggcccagtatttattcttcttgaggaaaattttgagcaatagaaaaactactagtctatagtggagagttttcttattttgctgtgtccttgggaaaataatggaattcatttatgttcattcatttaacccaggagttctccaccagggacaattttatcccacctccacctgtaaaggggggatatttgacaatgtctagagatatttttgtttgcctgaccaaggcaggtgtgctactgtagcatctaggggataaagaccaggaatactgctcagcatctcacaatgtacagggcaaattctccacaatacagaattatcagatccaaaatgtcaatgctactgaggttgagaaacgctgatttaatctataaattaaaacaaatgatacctattttaaaaacctgtggctctaaagcatgctttcttaatgggggcaatattgttttcaaggaagcagaacgttgctacttagtgggtgaaggaaaaatcttaggtattacaatagatagtggccctccaaaggtcagtgctacccattaatatgaagagagctatagtatatctgtctttcatagaatttcatagggggaggggtgggaacagttagggaaaaatgtgtaagtaggctacttagtagtgataatgaaaaaagttgagaaacactatagatatatcaggaaaatttatcactcattaaatcatgtccgcatgttctgccctagtcttttccccttttgtgccttttaggcaccataatagttagatcatgggatctggcagccataaaggaactgttgcggccaagaactcctgaccactcctaggcttccttctgacttttattttattttatttcatttattttttttaatacaggacttcactctgtcactcaaggtggcacgcagtggcataatcatggctcaccacagcctcaaccctctgggctcaagtgatcctcctgcctcagcctccctagtagctgggactacagatacattcaactactctcgactaatatttttaattttttctttgttgaaatggggtcttactatgttgctgaggctcaactcaaactcctggccttaagcaatcctcctgtcttggcctcccaaaccgttgggattacagacatgatctcttgcacccgacccctctgacttttaatcctccaacctaatcctgccacacacccacccactctcacttagtctttctcagatacacctctctcctcctcctttcttttatttctttggtcaattattcattctactatcaagtcagaaaataaccctacaactgacacatctctgtctagggaaaagaaagtcaatagttgaaaggaaaattgagtatgcacgtgagctattgcttcatccctgacagtgtgaaatactcttcagaatctactcatgtcttctgtcatttccttcacctgcttttccttaaacaccaatattaaattaatccaatcaacaaatactgcttgagtgcctcccataggtagggcatagtaaattcttcctcttgggaaatttacattctgaaagaagaggcaaaaaataacaataaacataagtaaattatacagtaggctaaatggtaagtgctacagaaatatacagcatgataatggggacttggagttgctggaatttgaggatagtatgcagaattaaatagagtgatcagggtttacttcatttaatattgtatagcaatatgtttcttgatgatagctaaaaaatagctaataactttaaagaacttaatatatgatgcctacatttaattttgacaaaattatctgtgaagtaggtactattgttaccttcattttacaggccagcaaagcagagaacataggcaactttcctaagttcataaaactttcctaaagctttactaggaagtagcagagccacattcaaacctacaaaggcctgctctaggcgcttacccctaactgctgtgttatgtcgcatttctattgagtttaatggcattacaatgcaattcctgtttaatcatgtttcataggtaatacagcacagtgattgtaaaagaaaaactttgcacccgacatttattaacaatggtaaggaagactttaagattcttgtgataggagagatttaacccagctctgaacacagcaaagactgctggggatttatagccaacgagcagagtgagggagtcagtggatgagaaattactaagaggaacttgattcaatatcaagggtaggatgatttagtcaaggagggagttcttgtcatggctaagagagtggaccctggcactggcctgctggatctaatttgtagctcccacaaaccagctgaatgatctcaggcaggtcacttcagctctttgtgcctttgttctccatgtatactaattcatagggttgttgtgagggctcaagtaattttaagcaccatttatttactgaatattcaccatatgttattctagacaccctctttatattgccagtaactggcacaacaatactgtgaggtagatattattgtccccattttatagatgaagaaactgcggcacatgtagcctatttagagattcaaaacaagcaagtgaaaaggactacatataattttgtttctaactgatccgccttttctgttttattcagtctttcattagctactttatgatgagtattgtcacaacattgtgagaaataaaggaagcacctgcctagaattttctctggagagaaaatgttatggctattttttttttttggcttttaaaaattacacccagtctcagaaaacatgcctcgtttcctttcaaggttcatcttccacctctcgtcttgatcccagcatctccctctcctctgaggcctaaggcatgtgccagagttatctctctctcccttgcttgcatgttttactctgtcactgctggctcattccctagtacctgtcacatgctcgagtctcacatcttcaaccttatgactttagatatcaccatgtggatctcactcttttccttccaggcatcctcattggaagacctatttgcagatgttgcctttttgccttttcttcctcagctactatttgctcttcagcttctccaaattatgcttccactcctcatcactagattgcactgcacttgacctgtccctgggacttatgctgtggaccctctttttacctgaacctccctactttcttaatttctggtacatacttttctcatggtattcctcttacttttccagccattcctgtcaatctctaatgcccacaccaaagtgatggtatttctcagggtttcaccttgacactcttttctggccatgctgctcattctctcactaccttaatgtgtccctgtttcatagatcggcagccggatagccctcccgatccatgtgttatcctactgtccactgaatagctccacagattcatcacatctaaaagtaaacttatcctttcccttcccctgcagatttattcttcctctggtaattcttatcttgggtattggcactgccattcatccatgataatatatgtaccaagtgtagtctaatacatggtggaaactcaataaacagtcactattaatttaatcctcacagaacactaatatataaacactattattattgccattatataaatgagaggagacaaaagtgattaagtggcctgctcagagtcattcttgctttatttctcaaacaactaccaattagtaaccaagccattttcattatacagtatgtctccatctccctctgcctttgttcaaattctctttatttctcacttgaataaaactatggtaataactcccactggccccttcttcctgtaatggcacctcaccaccctccatccatctgcattctggtcaggtcaaagtgatctttctaaagattttacctgttcatgatattgtctttcttaaaactcttcagtggctcccatgtcttgcacttcaatataaaccctgtagcatggtgtagtggggccacctgagcaaaaatcttttttgtctcatctctttccatgcccctgccttagaactcatggtcagaccacacaaaatagtgagtgagtttctaaatgaattacccttcaaagtttctaaatgttttaccattccatgactttattctaactgcctcctttactcacaatgttctgttcttttttgccctcctgaggaactcctacttatcctctacagctaatataaaatatcaactactttaggaagcatttctacctgacatctcaggggcaactgaacactatttcctctcaatacattgtgtatgtgtattttgcatagcattttaacagttttaacagttatgttgtcttaatttaggtgttagagctgtttagagattgaactttgggtttgaattcttcatctaattgaaaagatttgtgtctttgggtaaaccactctttcccttatctacatctataaaacagggatcaaacagggttacttagggttattgggaacattaagataatcacagaagtgtttggcacattagactttgtcattttcctgctctcaacattccaatgggttcctataatacttagccatagaatttaaattattatcttttgctatttaaaagtatttcattctaactttatagcgagaaagtttggaaagtgaggggtacctctacttattgttgcctttataatcctgcatgatccagaccttggctatcttgccgacctgatttcccaccattctccctttgtttccccactccatccttattggcaaccctgctcttttttactgcatcatttaaactcttgcctcaccacttgtgctcctgcagattcctccacctggattgttctttccactgatgtccaaatggttcactatcttcttcaatgcaagctgttacttgaaggtcacttatctaaagtagactcctctttattttcctctgatcctctttaattttcttcatcacacttattgcttcatgtgagtcattgttttgctggtttttgtccactctcattcactgcagcataaacgccatgactgcaacaaatttgtttactgatatatcctcagattgaaaataatggctgacttatggtaggcatttaaatatatttgttgaatgaacaaatgagtgaatcattggattatgttaatattattatttgttaaatgtttctgaaaggcagagatctgctcctctttgtcttcatacaccaagttcattgcttataaagtgtattccttggagccttaaaggttttcacggactttctcctggggtccagctgtcttggtttcagggttaaagtaggtccaattttacttgttgtatacattgatctgcacagtaatagtttcactgctaaaaggctttgaaatccactaaccaagtgtaattcccaatacattcagtaaatcattcaataaatgtttgctggtgaatgaatgaggtagaaaaaaaatgccagaaatattatctttaacgtgaaggaaaacgtagagctgacattttcttgaatagcctacccataattatctttccccagcagcattaactttacttgtacatccttgcaaaactgatttagattttattaaaattaaaatatgaattttaaaatatttttctaatacagcctattgtcttttctgctgttgtggcattacttttattgttttcttgatattattaagttagtcactgaataccagtggtagatactgaaaaagtaagtgctaattaaattaccaaccataagataattactttattattagcaaactaaaagatgatgctgattcaacattctccgcattttgctaaactatttcttactaaaaatctacatcttcaaaatatctagtgatatctgattcagacaagattaaatttttatttgttgactcttgaaaatattacataattatacttgattggcatatgtaattaatgtaaatgaactcattttgtttgaaaaaataggaatggccacaatgacataaaactttaaatatttagtttaatatagcactttgggagcctgaggcaggcggatcacgaggtcaggagtttgagaccagcctggctaacatggtgaaaccccgtctctactaaaaatacaaaaaaaatcagctgggcgtggtggcgggcacctgtagtcccagctacttgggaggctgaggcaggagaatggcgtgaacccaggaggcagagtttccagtgagccgagattgcaccactgcacaccagcctgggcgacagagtgagactctgtctcaaaaaaaaaataaataaataaataaaaacttaagtggtaataatacaaatataatggccataaaaggatcaaaagcagttccatatttaacagagaggttatttctgttgcttgtgactataataattcatattctacagtatctttccaccatggtaatttccaagaaagtgttccaatttttttccagtcctatcttcccctcttcttgaggacacacacacacaaaaaaagatggaagatggtggtgatgatggtagggtttgaggtggaagttgagaattgaaatcaggatgagggttaatttcatgatcattacaaggagggaggaagctaattctggccatgaagcaagaggtgtttgttagccagagccactttgcataggaaacagtagagggtttggacatcacatacgccatgttgggaagaagtgtgactgtcttccatggctaaactgaactgaagaaaaatgcatcaaggtagtccaaacagcttactaataagtgatctagttagattagagagatatcactacttagaaaatcaaattaatcaatttgaaaagaaggaaaagtgatatagttgacattggaaatgtttttgacacctttgtcatagtgacagtacacgtgtttgtgtttttcattcttgaggtctagataactttcagagaacagtgatattttgagccataggaatttaaaaataccatatcttcccttttttaagttagtttaacctgtgatttacatttgacaattgaagtcttaaaaatctctagccaggcgcagggctcacacctataattcctgtgctttgggaggctgaggcgggcagatcacaaggtcaggagtttgataccagccttgccaatatggtcaaaccctgtctctcctaaaagtacaaaaattggctgggcatggtgacatgcgcctatagtcccagctactcgggaggctgaggcagaagaatcccttgaacccgggaggtggaggttgcagtgagccagaattgcaccactgcactccagccttgtcagcaaagtgagactccatctcacacacacacacacacacacacacacacacacacacacacacgcacacacacacaaaatctcttcactgaccaatgtagaaacaaacatatttacacacaaacacagaccaagtttcactttgttatatgacaatatgaaacaatgcaacaggcatattttaataaagtgtataattattaatcatttaaaaaattatttaatggaacatataacaactatatatagatattaacatttggaaaaaaaacctaaagaagatgtattttgacacccctcttttacagatatggaatctgagatacagaaaaggtaacaggttcagtcatatagtctaagttattaatatgaatcaagtctagaatcaaggtttttaggctcccagtacagtgctttttatcaatgattatataagagaagtctgtatagatcatttatttaatatttagttatgtatccactcattcaagtattactgtgaatgagtagattcaaaatatattttgaagtcaggtgtcaatttacacaagatatgggaatatttcccttaataaattcttgtacatctaaatattttcctgtgactataactttggctacatttcatgctacttttattctgttctcttctaaaagtttataatttatttattattatttggcattttcttaagtaaatagtcctactgggggtcattcttttattaaaaatgtctagtgttgctgcattaaagtttaaagttacagagattttctactttgggaaattatttgatgttttaatggccaaatacacagtgaatttttgcaaatattatgtggtattgtgtttcttggtttcaaagaagtgtggtgtgtgtgcatttcatcgtatttgataggttacctcatattcaaatttattctttgtttgcttattttttgtctacttgatctgtcgctttctgacaagtatgggttataatcccctagtattactgtgaatttgttaaatctttcttgtatacctagttttgcatatttcaattctacattatttggtgtaaaaaagttaattgtatatatttttggtcaatcgtatatttaattgttacatatcttttcttgttcttgaatttactgttagtacagtcatcccttcctatctacaggttcctcatccaaccaacctcaaataaaaaaatattttaaaactattaaactatataaaaactattaaatattaaagaatattttaaaaatatttcaaaattatattttattctatttttattttgtaataattattaaaactatagtattgcaaatattacaatattaaatattatagtattttatttgttaaatataacaaataacaatatagcataacaattatttaaatagcatctgtattagtctgttttcatgctgctgataaagacatacccgagactgggaagaaaaagaggttttaatggacttacagttccatgtggctgaggaggcctcacaatcatggtggaatgtcaaaggcacatctcccatgatgacagacaacggaagaagcttgtgcagggaaactctcgctttaaaaatcatcagatctcatgagacttattcactattgtgagaacagcacagaaaatacctgcacccatgattcaattacctcccagtggtctctcccacaacacatgggaattcaagatgaaatttgggtggggacatagctaaactatatcagcatttatattgtattatctattataaggaatctagagatgatttaaactatatgggagaatgtgcctaggttatatgcaaatactgtgccattttatataagggacttgagcatctgtggataattataggtagccaagagggtcctggaatcaatcccatgtggataccaagggatgactgtattgctatatttcctttttatttctttccacatttgtctgatgtatcttttctatccttttatttcaacctttctgtgccattttgtttcatctctacctttacaatcagcacatagatgaatttattacttttttaaaaaaattataatatcctgttttatgttttctggttgccatctttgttgttcttgcttgattcaagttattattgatttttttaaaaattggccatttaaaaatattttatccttttttgtgatttggattttttatcttgtttttttattaatgattcctaaatttttaaaacatatttattctaatatttttaaatttagcatctaatattattcaatgtttacattctcctctgtctttcctaaccaaaaagacaatgttcccaccactcccattataccttataacttaattacatctgcaatgatcctttttccaaataaggtcatattcacaggttctgggtgaacatgtcttttatgggggcacaaatcaaacccatgacaacaagcaaactcttagtcaaatataaataccaatacaaagagtggtatgtaggctgggcatggtggctctcgcctgtaatcctagcactttgggaggctgaggcgggtggatcacttgaggtcagtagttcgagaaaaagtgatatgtaaatgaaagttgatgtgagggtttatttacattgctgaaatgtgaataatggagagttggcaattaaataaatatccaaagttcagtattctgtaattcatagtatgtctctagaacactgaatctcaagatgtaatattcctacatgcattgaaatatgacgttgtaccccataaatatgtacatttttgtgtcagtaattttttaaaagatgtaatgttactataaaatcacttggggtctcctatttaaaaatgaagatattttaggctccactgccagagatcctgattaatatctgacatgggacccatgaatctgcattttaacaggcagaggagaaaaatttaagttttgtaggtctaggacccaatccagtttggggggtcgttctaaaagaaaaataacacaagatcacaaggataaaattaggtacagtgtcacagttaagtatcctagaagcttaagcttgactatcttgttggcaaatctgcctcagaaggcacaccaagtaattcatgcccatgttccatggacgacactcaatggaacactgatctagcataccctttctaccttttggttgttgttgctgctaaacatttcttcccagaatataatgctattacaagttgagctttcctttacaaccttgtagttaattatttaggcaatacctttaatgttgattaaaattatgactacatcaggggatagattgatctttgttattgcatgtaagatttgtgaatttcaaaaattcgtttgatatagtccttatgaaacaggagagttcccttatcccccttgcacaatgtgtgacaggggtgtggcttgctgctttcgtcatctccgtgctcaaacccctaggggagcatgcagatgggcaggtgcagaggctatgggggagtgcttttgggctccaaccccacgacagcatctaggggtgggtgtctgcgactcctgaagcccaagtgggcatgtgttacagtgggatctttgaactttgctgtctgcagatgacttgtgttaatcagcacaacagaccctctgccttattgcaagggcagagggccagcgtgacagctttctgtatcccgagctcttgcccagtgtactggaaaattgtattacacctgggttcaaaggatgagtgcaaggttgtattgagtggtggaggtggctcttagtgagttggatggggagcttgaagggttatggagtgggaaggtagtcttcccctggagttgggccacccaagcggctggactcttctctgatcacccccggccgagttcccttcagcatccagacgtcgctactcttctctttctctgctgcatcattctgctgtcactggtctgcctgtcggtctgttcctgtgttcctttcaatgttcaactgcttgtatctgtgcccactaaggtatcaggtttatatgggcacaggatgaggggctttgtagaccagagttttcttggaaattgcaacatttgggcatgaaaacaggagtgcccattctcacttaggtccaggggcacaagcccaagggtggaggcctcaccagggatcccacccttctctactcagcactttcctgccccactccttattacttattgttacatcagtattaaatatttatattttctttcctggaagcatcatgggatagaataagggacattggttaaaattctggtttcctttcttggaggctccttatgcatgctacaaatatcagattgctccaaaaattaaacaaggtgatgcatgagtgcctgatacgggggctattacataggacacagatgcttggtcaatatttctttcctcactagttttttttctttttccctcactcacctcgttttgctttctgtaagataattttgcccctagattattgaagaactcttgaagaaagaaactaaaaaattatctgtggaactttgcgtttcagttcttatattgttactgaaattttgttacttattctgtctgatagaaaaattgggtttataataataatcataatattttaactttttaattgggtgctttctttaggccaggctctgccatcagcgctccatacagcgctccatacaaattattaattttaattctctcatcaagcctacaatgtagacacaacaattatctctaattttaaggaggaaaaaaaactgagacttacaatgatttatgtaacttttccaagaagtcacacaatgaggaagtggcaaaacagagacacctatgctgccctgatcctgaaatcctactcttggccactgctataattctgagataatattccacagagttgaatcaagtttattcatattaatcaatttctcttacttaacaatagacttctgtgtgcattaccagccagtggtaatagaatgctgtttgcttcattttaaatactggcacagagatattgtagttttgggcattttaacccagggaattactgagaatataatttttagtgattgggtagaaatgcttttaatttccattgtctcttggcagttacactttttagtaagattctttgctgtacatttcagtttcgctaatgtgattatgtgggctaacatcaaaagggttcattgcttaatgaccaagaaccaagcatgtcaggatgcaggaattggaaatggttttaaataaatcaatttcaagtgaattaatctttgaaaacagtgcctgagcattttccatatgaaagtcatttccattatgacttcatagtaccattcaaagtgtctttttgatgtttattgtctttatggtagcaagagtagctacattgtgttataataacatggtttatttctgcttctaaattatccacggatgagagtggatttatatagctgtgtatatttgctcagagcctcttcaatattcttccagaatcacttgtacattggctttggttgtgtatgtatctttgtgaaaatgacagcaagcactgaatcagagtgatgcaccatttactctgtggtgttttatgtattgtcactgcaattgcatgttcacaggcagctttgtgtacttaagatttacaagtcatttgtttgcttccaagaagccatctgagatgacagtatatattaaagttgctaaacaaattatatatttcttgtaccgaaaacttcagtgatttaagatgcatcgtctttcttccttcctttccttcttcctcctccctccctctttccctcccttccctcccttcctgacttcctcccttcttcccttccctcccttccccacttcctcccttcctcccttccccacttcctcccttccttctctttctctcttttcttccttccttctctctttcttttcttcctgtttttccgaaaagcaatacatcatttgtaattcattacgtaacttcactaagaacctgaaattattttttattagaaatcccttttctttcagtttttgcttttgcatttatattgtctttgtgactcagcttaatatttaagtcacaaagcaattcagtttttaatcattttattggtattattaaacttggattttatcttcccctaattaacgaataaattgataagatcaaaatctcagatatggatgtgatagctttttaacaataaattttccaagcacttagtgtgtacaaaaaagatgccagagctaagaaaaaaaaattgttgttagaagaatctaatatgctccataaaccagtaaaataattatttcaaattttattttaaaaatatacatgggatgcttataagtaattaaagtaaacatatacatcagttccttactaaaataattttaaatttttttagagtatgatgatttcacttaaggaagttttctgggacttaatctgaaattattaagtatccatgttgtaaggtcaggttaagatattttattatttttggcagttatttatagagttccttctctctccccaaattatatatctattgatcattatttaattcaaagaaagcttgtgccaaagtaaaattataccagtagtgtttgatgtagaagaatacagtgaaggatagcctgtataccacaggcagaaatacagaatcctatatatttgtaatttgtgcttatgaaatactatttccaaatctgattatgtgtaggtccaagtagataaatttgaaaaaagtaataaatatctttttattctttttttcttttgttcctttttacttcctcatttcttcaccgcacaaatatagctctgagttataaatgaaaatacaaagtgatgagcaccaataccctacagtggctttcagacatagatttctggtgcctatgaagaactttgtcacacaattgaaagactttttcaaactgtttgggatttgaatcatcaaatttgaaagaatttggcagttattcagcgtctccatctgcctcccataaaagctgctattattaagtcatcccagtgagatgggaatctatgctttcttttaggctttgagagaaaatgattcagtaatctctttttttaaacttatttcagtgtttaataacttgaactgtcaaaaaagattttttcatcattaccctaaattctttttgttgtcatttaaacccaagaatcagatgaacagcctcatagaattaatatgtgaatgcaacatcaaaggacacaataattacaacccaggctgttttgtgtcagtcaagccatcctaattcttaaagtccagaactgggattcttattaaaaatgattacattttagtatttaatactcctaatatttatgaagaggtaatttattgaatgtgcctctgaatatgttaaattgtctaaaaccatatttaaacattattttttataacatacacattgttaccctttcggtttcctttggttgaaattattaacctgtgaatagcaatctgaatagcaggaatgtatagaatcctaatgtagaagtatttattcttatggaaacaattttgctaggacttcaactgttctggaagttatccacttggaacttagaataatgtcagtaattttttgtaaaaatagaaattcaagtttattgagccattccatttattgtcggtgtttttcatctatttcaatctgaacctattttccttgatcagcttcctgatccttttggttcaagttctaatccttcttgtgatctgcctcacctctacctctgttaggttttctgcatattgggtactatgtttattatttggatgatgggttcaatagaggcctaaagcccagcattatgcaatatatctatgtaacaaacacacatgtactccctgaatctaaaataataataataataataattcaaactcacagaagcagagaatagaatggtggttaccaacacttgggagtaggtacaggttgagtagatgttgaataaaagatacaaaatttcaattatataggagaaataagttcaagagatctattatactacacggtgactacagttaatacaatgtattatctacttgaaaattgttgacaagtagattttaagtattctcaccataaaaaattaggtacagtaggtaataaatatgttaattagcttgatttagccatttcacaatgtatacatatttcaaaacatcatattatacaccataaatgtatacaattttaaatttgtaaattaaagaaagtttcaaattttttcatcaaaaaaacctaaaattttaaaaattaatgacagggaaaaacatttttaaagaaaaactgtggctggacatggtggttaatgactgtaatcctagtactccagaagaccaaggcaggaaaatcatttgcagcctgtagttcaagaccaaaatagtgaaagcccatctctagaaatataaaatcaactgagcaacatagtgaaagcccatctctagaaatataaaaagataaaaagaaaaactgtcataaatatatgatatatcataaaatgtcaccataggacacacacatacacacacacacacacaaatcaaattgtagaaagcatctatttccacctcacagttcaaaaacaataaaaaatatggcagcctcacagaaaaaataatctattagtttttctctcttcctataccccagctgtaggcattgccatccccaaacttctggcattattgttgccatactattattagctgtccctgctatcagtcctgaagatgcttatagttcattttctcattactttgttacttttattgctactacacttctgtcacctagttagtcactaggttgccagaagtaatttctggacccaattttcggacaagaaccagtactagaaatggatacaccatatagagcttttataattgcaataatttacctgtaattagatttgtttgcttcataaagtttccagttactctctactgttctttcatttcaacttgccatctccttttagcatttcctgcagagcaggtctagcggtaacaaactacctcaccgttttttatctgagagtgtcttagcttctccctcacttttgaagaacagttttgataaatatagtattcttggttgaatgttttttttccccctttggccctttgaatatataagcccactgatttctggctctcaaatgttttaataagtaatttttataaacttattgagcatcttttatatattattagtcatgtaaaagactaacctgctttcaaaatttgctctttgtctctggtttttgacagtttaattataatgtgtctcagtgtggttctctttgagttctttttgtttgagtttgttgaacttcttggatatttatatccatgtccttaatcaaatttaagattttgaccattatttttaaaaatagtttcccttaccatttttctctctcttctccttctgaaactcccacaatgcatatgttggtccacttgatgtgttccacaagactgaaaggctctgttcatttttctgcaatctttttatttcttttcctcagacttaatattttccattgtcctattttcaagtttattgattctttattctgcctgctcaaatatgtctttaaatacctttaaggagtttttcatttcagttattgtacttttaacctctagaactttttctttctttttagattttctgtctttttattgatatttccattttgttgatacatcattttcttgacattctccacatctcctttacttctctgaacatctttaagacagttgttttaaagactttttctgatagatctgccatcagttttttttttaggggcaatttctatttgtttattcatttatttgaattggccatactttgtatgccttgtagaaaactaaatatttgagtatagtagtatgataactctggatatcagattatcctccttccccagggtttgctggtttttatttgttttgttgttgtttacttatttttttttattggtgtaggctgtttctgtgccaagcatacacactttacaagtgtgtaaagtgaaggtcttctcaggtcttttctcagcctgtgcctccccctggacaagtgcagtaactttctgattccccctgtacatgtgactgcttttgaatgtcctagtctttaatgtatggctctcaaaagggggcaaagggaaaaattagaaggaaaaaagacactggcactgcctttttaaatttcatgcaaatcacttcaaccaaacgaggagcaacttgcaacaaagggtaactgcaacaacaatagccactgcctctttgtgtgcggctctgtgatcagaagcagcaattagtgatcagagcacaaatccatggtatttggaggacaggatgttttgtgcccaccctggctcctgcaagtggtatacaagctgctcctggagcacatgcacagtttcctgccagagggctaaggggtaagtggatgagtagtggctactatggtaatagatgaaattgacctaaatttacctcagtttttggtttcagccttaccctggaagttgcaagccttcagtatacacctgagttctaacagttacatcaaacagattctgccagtaccgtttttgtctaggtgaggagacagacttcaggtgcttcctactctgccatgtttccaaaaaccttcttatctattgtgttttaaagaaaaactaatacttgttagaaattactcaagaagaaagaaggaaagggctttcttcttctagttttaaaaattcagccccaaacagaacatatcatttagaatggttgaaattccattacaaataagagaaacccaattcagagtagctccagcagcagtgaagattgtgttagcctaagtaaccgaataatatgatgtatgaattaggaggtatatctggcatcaggaacatcaggaatgaggacactgagggtataccagaattctgtccatttcctccttctcctagactgagagatctatgctcttaagatatttttgctacagaggagagttctggtgccttacagctcatagctttgcctgtttatggacattagattttgttttctccagtgtggaaaaatgagatgttatttgaggatgttaggaaggagtttggcttgatctgggtttacattttggaaaggtaaccttggttgctccattttattgtggggcatgaagggtacaaaagagagagaagccagtaaggaggttattatagtagttcaaaggagaaataaatgtggcttggtgtggcatgggcagagcagaaagggtgggaatgtttcaactgggatatattatggaggataaaaaacaggtcagactgattgatttgaagatgtgaagaatcaaagaggaatcaaggataactcctgtggttttggctaagaaatttgatggatagtggtatcatttaatgagaaaggaaatgcttagggatgagaaaatgtggtttaagattaatacatttattaagcccttaagtagagattcaagtgacaagctggttatccaattgtagagttctgatgggaggccagaatggacataaaattattgaaaaggagttatatgattatcattttgtgaaaataaacatgattctttatccagaagatgtaatagaatcaacataaaaattctaaaacctggcagagatacaacaacaaaaaagaacttcaggccgatatccttgatgaacattgatgcaaaaattctcaataaaatactggcaaattgaatccagaagcacatcaagaagcttatccatcacaaataagtagacttcattccccaggaagcaaggttggctcaacatacacaaatcaataactgtgagtgatcacataaacagaactaagactaaaaaacacatgattttctcaatagatgcagaaaaggcctctgataaaattcaacatccttcatgttaaaaactctcaggaaactaggtattgaagggacatacctcaaaataataagagccatatatgacaaacgcacagccaatatcatgctgaatgggcaaaatctggaagcattcccctgaaagccagcacaagacaagaatgtgccacctctcaccactcctattcaacacagtatagaaagttctggtcggggctatcaggcaagcaaaagaaaggatattcaaacgtaaagagaggaagtcaaactgtctttgtttgcagattacaagatccgatacctagaaaaccagcattgtctcagctcaaaagcttcttaagctgataagcaacttcagcaaagtctcaggatacaaaatcaatgtgcaaaaattgctagcatttctatgcaccaacaggcaagccaaaagccaaatcaagaatgaactcccattcacagttgccatgaaataataaaatacctaggaatacagctaacagtggaagtgaaggacttcttcaaggagaactacaaaccactattcaaagaaatcagagatgacacaaacaaatggaaaaacattccatgctcatggatagaagaatcaatattgtgaaaattgtcatactgcccaaagcaatttatggattaaatgctatttccattaaactaccattgacattcttcacagaattaaactattttaaaattcatatggaatgaaaaaagagctcatataaccaagacaattctaagcaaaaagaacaaagctggaggcatcacgctgccagacttcaaactatactacaaggctacagtaaccaaaacagcatggtactggtacaaaaaacagacacatagaccaatggaacaaaatggagaactcagaagaccacacatctacaaccactagaagatatgaatcgcttctaaattacaggaaaaatccaggattatccctaatattcaataagtaataaatatcctccagaaattgttgtagatttattcagactcaaacaaatgaagaaatatcattccccaacatatgaagatataatattgtaaacattcaatccaatttccattttagcagatttataatgagtcacagcagctggtagcaacagccttaaaagacaagaccacgcccacaaatgattggactagtagtgaactcaaataataccagcatactacctggatattttagtgtgagctcttgactaagtaatatgaacctattccagttaggtggagggagaagaaagttggtcttaatctgggtcttgagttagtgcaaggaagctgaatctacacaaaaactggatttgaggaaacaagaatcataggtaagcaaataaagtggctctgcagagaaatccaggagaatacagaagactgaaagtcaggaacagaaataaaataccattccatgctatgagagattaaggagttgcctcaatgcctgtttccccttcaggccctatgatgcacagcatactactttttttttctccttcgatatcagtatttcctgtcctacatatagacttagagtacccctcttaggcagagttggtaatgctgattcagttaggaaaataatcacagatgttgcagagtatttatgttcaaagatatatatatagccaaattatttaataggaaaaaataatttaagtctgcaataagagaaatgattaaattgcagtattcagaatatccgtacaaagtaatgttacacaaccaataaaaacatatatttatgacagttatatcttcatacatgtattcatgttatatattcacatatatttatatgtcatatataggttgagtatctcttatccagaatgcttggggccagaaatgcctctgatttcagattttttggattttgaaatatttgtatatacataatgaggtaccttggggatagaaaccaaatctaaacacaaaaattatttatgtttcctatatattttatacacatagctgaaggcaattttatgtgatatttcaaaaaatgtgtgcatgaaacaaaatttgtatacagttaaccaacagaaagcaacgtcactgtctcggccacccaggttttttggcatcactgtaattcatgattcttaattcatcttcagataagcaatcattttcttacacttattaacccattaaatatttaacagtaaaacatatagcataccattaatacaagtgaaaaaataatgtgttcagggtaactaagcagcacagtagcatcaccaaaataccttatcagctgttaaacaacagtgatggcaaacaagggtagcctttcagtcttcatctgcaatgatgtgttttgattaaaaggttactgtacactgtattgtaacccccttggggacactgaataaactgtgtgttgtgcacctgtgttttcaatgagacacatcacatgagatcaggtgtggaattttttacttgtggcacaaggtcagtgctcataaaggtttggatttggggacattttggatttttgaattagagatgctcaacatgtatatgatattgatgtatatatgtatcaaatgtgacattgtatatttatatatatatgacaattatatattcaatgacaattcagttacacatatagaaactaatcttatggcgtgaaaagaaaaagcagaatgtaaaactgaaagtaaatacgacacatttatacatgcattctcatatgccatcagcctcacttgcctaggtctttataatgtgattatatgttatttctacacaccagccaacctgccagaagggcccttaaaggtctctgagttatctttaagagtttctcatagggcagtctacccacgctctgtaacaggttcttctttggcctttgttgtggacattgtgtcttgacctcactgttgatggaccttgtgagttctccagtcttcagagactcgctgccatctactggttattgttaccagttctgctcctctagtcttggagttgggtcccgactctcaccaatacccacaacataatcattccagattttaataaggcctgggaatagtagaactacagcacaaatttgtttctatcaatggcggctccttgtatttaaagcctaaatattacctcatatctgctttctcacgaggtccccatatactaaactagttcaacttccagaaacagtttctagaaaggttcatatctaaagtctgaacccaaatgtactacagttacagagagaggaggaagacatttatgtgcctgaagtccagcgcccatgaatatcctgatccaggatgcaggatggtggaaacatttatctcctgcataggatattttctctcataaggaaaatgcatggattcccataacctccataattataatatttatgctactctttgcaaagcctacatcattcagttttaaatattttactgtggatgcagccccatccaggttgtgatcccctggattataaagttaaggtttgattagggtgacatgtccttctgccatgagtgaattcttaattttttagtgaccaaatgcttatatgatagcacagcatgcactgaagaataaaaatgaattttatcatagggtaatccaaatgtggatttgaggaacaaaatattttctaactctgtaaatgacaatcctaccaaaagagccaatttataacactgcaaaaaaccactaacacctcaatctgaagcaagttttcccagtaaaagtaccagccaaatgcctgattaactaaaagatttgcaaaagtggccctttgtagaaggaaaattcccttaagggaaatttctagactcaaaaactgcttaccatccccaaaatgatgttattcaaaatgaaacaatttaaattgctctcttcaatggtcatatgtgaacagtgattatcactgggtgatgagatttgctttttaaacaattttctatgttttaaaaattttctatattgaatgtgtattattaaaaataaaatagttttaagaagtctatattggagcttatttaccgtaatatattgtaaatgagtaatatagctgtttgccaaactagcttattagtggcttgaacaccactgacttgataaagttttattttaaatgaaaaattctcattctgaagaaaacctgatgcttctattagtcgcatgatgattacatctgtaaggattccagtcagaatttatagcagtcaataaacaagctcaaaactcctaaaaagtaacggatgagattgaatctcattttcccctacttaaattagaacattattaactctgtgttgtttggaacttaggagaaggttcattttatttttgttttttaggttgttaaaatccaagtagagttaactattgaactacaaattgttttttaaggaaaagtaatgggtaattttatggcatgggctttgagttcatcacaaattttcaacactaatgaaattattatatccttatgttatcatttttggtaacttttttatattgggtttaagtaaccatcttggcaataatttctaagctaattaattatatatgccaacagagttcagtttgatttagttgtatattcaattccctttttattgtggtggaactaggaaataaactctaattcaattttaagtacaaataattaaatgaattgggcttatgaatgaaatcttctcattggcaatgccaggaggtcaattaactagttttacagtatttctgtgaacgaaaatgcatctccaatcgtgtgataaatattcgctgtataggactgaaaacactgttgattttattaatctttcagttagtctggagtagatattttcattagatttacagaaaccactatacatttttgaaagtaacatttcttaatatgaatttgatgtggaagactatcatctcttttactcgaccaaaataaaactctttggagacactttatttttatttcgttttactaaagcaatgtttgtttaggttatgttgtgaagtatatacaaaccatgtggattttgatactgaaattcagttcaaatgtatatcttctataaacattaaaagagctctttcataaatgtcctaaaaacagtgattagaatcgtgcctgaaacagcatgattctctgattcatttgagttgttttaaaacaactcacataacattattgcctttggactctttcttcttttcatcagttgaaatgtgtacttttaaatcatttcttaatttaactttctcacttttttttcagtatgtaacttgtccatccttttgctgacctttataagtggttctctttgttataagaacaaagtaacagtgccctcttacttgataattatcaggaaactacaagatcaaagaaggaatagttaattttatgtcttcttctttctctaaatcttctatgctctttgatgtcactccttattgatcaggaaagaaagtctatctcaagtaggggtacgggtcagcaaacacaacttctgagctcaaagacatcatttaaaataaaaatagagattattttgttactgactaggataactacatatgtttattttttctgtcaaacacatagcaatcaggaaatattgaaattattttcattaaacctcacataatttttgcaatacagtattgaacttgcttatattaattagctgagtacaagtccatttcttacaaaatatattaggccaaagcctataacccctatctccattttataattatctatgcttagatagtgagcaaggactgaattcattgtcttatgttttttttaggtgcattcttttgcattagttagctatttgttctgctggataatttctattaattaaagttggtaatcccagaaaatgaagcccagtacattcatctcgagtcattatcgccttctctaagttttggataataagctcatctgcctctttgaaatgtctcatgactcagctgttcagagagattgtccatctaaagcagaatgcatgagataatgagactccttttccacgtcatggtgaaagagaacattctttgtttgcttagaaatgctatctagagatgaaattatgcctctaatattttatgacctgccaattttcattcagggttactgttttttttttcacgttatagtctaagatttattattaaacaatgaaacaggttaacactaccatttggctttaatgtttgactaccgaaaagctaaccattcatcaaatttgttttttaattgtggttccctgggtcactcacacatatacatcgaaacaatttattagtgtaaagattaattgtggtaattttattgtcttgggattagatgaagagaccttcaaaaactccttttgatgaaacaagtaataaaatgtagaaacagcgagttctgtggttcaatatttatatgtctgtgctagaagctttacataaatttgaaaactttttgtaggtatttgcagagtgaaaatatgccaatacttcaggcacacttataagcccctcttgtcttcagtctggttggctacgtccaataaagtttgatttctcctgaaggaccattatggtttattggcttaatgaagcaaattggaaaaagaatttgtgcagcaccttttctgtgctctgggtgctttataaaattgcagagtacgtttcagttttaagcaattcccaatgattagtttatttccagtgtggcaaaacaggacctgagaaaataactatgagtatcttgcacacatgcacatgcacagacacacacatgcatgcacactagttccagcaccttctgtagaacatgttaactgcctcaaagagagtatcctccaagcaatagtgaacagagtattactttctgtctttgtaaattttccaggatatcatgatcaacctaattgtgtggcgaatggttttggagtctgctgattaacattttattatacaggagatctctaaaagagagatttgtctcttatcatgctgattctttctcaaaatgaagattttcacaggtagaccattagtgccagacacctaagaattctacttttctttattaaaaacagtatataaaacaaaattttaaaagacttcttcatttacagaaggaagataagaagagaacaatgtacaggcctgtttagtgtttagatggagtagaagagatgaatctggaaaatgtctgaatgtcctttcagcaaacatgaattggagtagaattctgtctttttttttgagatggagtttcactcttgtcacccaggctggagtgcagtggcgtgatcttggctcacttcaacttctgcctcctgggttcaagcaattctgcctcagcctcctgaatagctgggattacaggcacgccacactatgcccaactaagggttttttggtgggtttttttgtatttttagtagagacggggtttcaccatgttggccaggctggtcccaagctcctgacctcaggtgattcgcccgcctcagcctcctgaagtgctgggattgtaagtgtgagccactgctcctggcctggcctctctttttttaacagacaaggtcttgctctgttgcccacgctggagtagctgtggcaagatcatagctcattgtagcctttaactcctaggcttaagcaatactgctgcctcagcttcccaagcagctctgactacaggtacacaccaccacacccaactaatttatttaatttaatttttttttttttttttgaaataaggggtcttgctatgttgctcaggctggtcacaaacttctgggctcaagtgattctcctgtctcagcctcctaaagtgctgggattacaggcgtgagcccctgtgcctggcctgtcctctcttattgatggttatggtttaaaaatactgattcttatgttctcatttgtagctaaaataatacatttaaaaggatactttattccaatattttataaatttccttttatagggtagattaaataattataatctggtactatttaagagcctcatatgttcactattccctgaaaaagtgaataaagtctctaagtctacttatgaagtttatggaaacacttaacttgaattatgtggctaggaacaaaattagaagtgtattgttaaaagataatttaaaaataaaattacagtacatgcaaatataaaatggacatatgcccaagattttgactcattaattaatgagataaccagtaagatgttacaattaattcagatgaatttaaagatatatatgagcaataaggaaagctgaaatgaatgtacaaatacatgcaaaactgctgtgtccacaaggcaataaagaattgcattcctcaggactcagtccattagcatttctacagagaggagtaatttgcattattatcagttttctacaatttacagggttataaaatagctcaaagacaatggaaggcagaggtaaccaagaaaggcatactagacagtacatccagcagtgcttttgcatttctcaaagcatttcccaatttttcctgatagtattaatgctgttcacattactatcttgccacaagcttgttctttaagcaaaagccagaagattttttttattattttttatgagtaaatatctgagaaaaataatttagttaaaccgcaactaataatttaggccacctattaaaaactatgattccaagatgaattgaatatgctttctgtcatctgagaccatttcttttatttcaagcaacaatgtctggtatgatatgtgctataagtaatttataaagtattgagtgagtgtggcagaaattttgtcttgagaagattagagagggtggcttttagtgatgttaaacattttacttcattgcacatgaacaaagaccttttcttaccattcacatctgattctcctcatgcctaacagttggaactgaagataaactttcctctctgtgagagaaaactgattgagtgtgctgtgcttcatcttaatcatatgcatgaacttttctttttgtttttgagacaaggtctcattttgtcatccagggttgagtacaatggcatgatcatggctcatgcagctttgacctcccaggctcaatcgatcttcctgcctcagccttcagagtagctgggactacaggcatgtgccatcatgcctggccaatttttgcatttttttgtagagatggggttttgccatattgttcatgctggtctcgaactcctgggctcaagccatccgcccacctcggcctcccagagtgctgggattatgggcacgagccactgtgcctggtccatatacatgaacttttaacagaaaatttaagagaccctaagtggagaatatactaattcaaaatatcatgttctagagatgtagaaaaaaactataactgaaaaatgaatgaaaaaaatatttaaattttaggggtagaaggtggaaagcccaatttgaagaaagcgatgtgcaaacctgggatcagacaagtgcaagagaagacattgagtgtatcctgaattagtttagcaaaattaaaagttatttaaaatagattttaggatgttactgtaattattgatttcataagaatatattatatttgtcttgctctacagagttttaccttgcatgttaatatcaaaatttattatagcaaactttgttcataacattttattgaaacaaggtttgaaagtttctttgttcattttcctgagctcaaggacctacaaggtaggacatataataaatgaatcctgtcctacttatcactagggatagttgtttcctcaagatatgttcttagtaataataattacaattaaaagaatctctgccctattaagtgtgcttctgagggacacttttttattttaaagcataaagcattgtcctattcagcagaagccaaatctaatacaggttggtaaaatgtcctgtatgcagttgtttgggatctctttgtgtagcatgtaataaattaccaaaatggaataaagatagctgagaaattaatactagcttttgctaaactagggacaaactttaaaatgatgaattatatatactaattaattggtacccttgctttttaaaaattctgcagttgtaatctattgattattggctaagtgttatatagagattaagtcttatttctcatcctgctatttcctacctttgcaactttcttcttgatggaaaaggggcatcactcctaaatgagattttttaaaaatattgaatcttcaaatttaaagagtagagcacaggattaaagtggagaattttcgtaatcagagctttattgaaaagtttagtgtgtataggcattgtagatgtgtctgtggaatttatggactcagttaaaaattgtcacctgataaaaatgaagttaactgtctattcaaatgatgagatttgcatctacagatatattactacctaaaagccgaggttgcatatattgccgatggactcctagaatgagtcaggcatcttttaaatctcagtaaaatgattgttatcttccagatactatctaaaatatcaccaatataagattcctcatcaatcacttctcaaccttttgactaagatcaagtgtaatatctatctttatcagtttaatatctgagatctcctttatctgaggacaatatatttaatggatttttggaacagagagaaggaataggagcttgtcctgtccactccatgcattgacctggtattgcaggacctccagaaacaccaccccctcccctcccacacacataaattctcaccaatcttgagggaatgttaaaataagatgtgctttgattggctgatattaaggcatattagaaatgaaagaactgtaaagaagtaatttatcttcaaattgggaaggcacttctatctagtggatctaaacggcaactagaaaattatattctgtagcataaaactaacttaatacttgatattagactcaggagacatgcattgggtaccgtgttgcctcttgttaatcatctgtctttggaaacattgctgaactctgttctctttcctcatctttgaaattaggttaatcacatgacaggatagttgtgagtaataaattaaataacatcacctatcctaatgcctgacacacaataaatgcttaataagtatttattggcattgcctcttgctagagtctggttggaatgatacatgaaacaactgagttcctttgccatgatactttaatacacattcttatctgtttcaccacagtagaggagtgccacttcatatcataggggaacagatacttgtgtcagcagttgctagataacactagaaagtctgggtgaaatagtaaaaaatacagagatgaatagtttaagaaaagcttcttaactgattctggtataattccctttaattaaataattggcttaacataattaccatcttttctgaagtatattgatgacgagaaggtggcctgtgaatgaaatgcacaattttttgactccagaattattaaagtataaattgctaaactataattgtggattataaactgatcactgatcatcttcagatgagtgattaaagattcaaacctgtagatctgaacacccacagcatcaaggtgaagttgcgggggaactgattattctctcatacttctttatctacatttctgtccagaaatggactgcactcttcccttgtaaatcctcgctgtctaatcaagcagccatttcaagccagagacagtcttgggcacactacacagttttgacgactaagtgacaacctatcagtggaacaagaagccttttcttgaaggctacttactggtttcgagcataaaaagggaaaagttcaatgagagagaacgaactcctaactatgttgttcttcttgggtgcattgtatatgctgaaaagttaatgctgtttttaaagttaattcatgataattgaaccgaagtgctctgaaagtgctgttagagtctatttatgaacccagtgccctctttgtcaattcagtaaaagcaccgttcagtaaaagaaaggagagagagatggctgcatggtgtgcacttagccatatgtgcgtcctttccccgtaaagtatctgtttttctaagtgcttttttttcttttaatctgtctacctcattgagtcagcggggctgctagtcccattatcactccactttgaggactgggaagggctgataaatgtattttggtcgtgatttaccacaaatcacttttgttgctctgaggtgtaggtcactgttgcaagtataggtcagcaagaggagagcacgtgggacaagtgaattaaataaataaactaccgtttggatgatcacactgacaaatatttttaaacaaatataatagacagtctttgttagcgtgtggaatatattaatcgtttccatgagtgctgttgggagtgtgtctttcatatgaagcatcagcaattccattttataatggcaaaaagttggtaacacctttatcttcaacaatagccggttaatagaaattgaattatgctttattaaaatgagaaaatactaagacacttaaatggtgatgtaaaataatatttaattacatggaaaatggtctctgataaattaagtggaaaaggagaatacaagatcatattatatattttgttctaaaaaagtatttatctatatggaagaaggattaccaggatatgcatatgatattaacagtaattttttggtgatgagattttaaatttttcttatcttttttgttctctctctttttttttttttttttactaaacatgaactataagatattgtaataaagttttaagaaaattgttaaataattttttaaaaagagtatgtgcatgtcaaagaaatcatgcttgtgaataaaaagaaattagaaagtataaaaggcttatttcagtatttctaattaattacccaactatactatattgttcctaagaattgaaccttttggaatcctctgaaagtaaaaccatattaaagaaagaaacatggagtaaccatgagcatgtagtttgaaaaagatacagaaatctcagctatgggtaaaggcttaaaaaaaaattgaatccatgatggcctctcattctgaaaatgacatcaggcagtatttatttgaagctaataaatgagagtgtattattgtatgtaaaactgtgttttaaattgtttgtaatataaaatgtttataatataaaatatttcatgtaccaacagaaaatcgcagaaacaaatgcaacattagcttgtgggaggaatttgaaaggtccagatgctagaattggctgaggctctttgcagcaccatccatataaaagtggatagtctgaggggtttacactagtgataatggaaggaacatggagtcagaatggctttctatatacctgttggcttgtgtgatttctttgggccttggttttttaatcttcagatgggagaaaataatacatacatatcaaagttgttaaataaaaagcatatttaaagtgactaggaaaatgcttgccaaatagcagtgattcagtgaatattagttctgtacttgaatttggagtctcccttggtgactcaaatttaattactaaaaaggctaatggcttcaaaagtagccatttaagaaagtgaattcacagcagggagaaaaactcacagaactccatgaacaggtcttgggatattttattcaatttaaaaccaaaggtctatgaaacagtgagttttcaaatttctatcatttgtttgggttcatatttgacttggtaagttcaccagtgcggattcctttagctaaagaacaagttggattttcatcatagaaacttcatattgagtagattaacttgattggcagccattctaagggagagattcagaaacagaataacaagtctgtggcaatttaagactaaactactgaatgaggaaattaggatggaatttcgtcatgatgacatctattaggcttccataatcgttatctcaagaaaaaaaaatcatacatcttttcaagagaataattgttgtagaggaaaggaagtgctaaaacagttttatgaaattacattctgaggtgttgtacaaaatagtactctttctgaaatgtaatttgcctttaaactgttcagaagagtctgaatggtgattgttgcctgagtttttatccaaaagttcagtgatggagcagcatctgggcttagtcctatctctagtggcacatcctgagtgactaagacatagatgtgaaagccttttctggggttacagggatccagtggtttcattcagcttacaaaagcagaatcctattggtttccagtcttacttctttgagtctgttttgtttttaaatcattgcagcctgctgggcgcggtggcttacacctgtaatccgagcactttgggaggccaaggcgggaggatcacctatcaggagttcgagagcagcctgggcaacatgaggaaacctcatctctactaaaaatacaaaaaatagctgggcgtgattccagctacttggggggctgaggcaggagaatcacttgagcccgggaggcacaggttgcagtaagccgagatcgtgccattgtgctacagcctgggcaacaagagcaaaattcggtctcaaaaaagaaaaaaaaaatcattgcagccgaaatgtccttttacctgtttctaagtcacaataattctgaaatgatcatttcactagctacaacagaaatattctccaaagctttcaagctaaaacaaagcagttctgtgattgtaaaaaaaaaaaaaaaagctttaaacatctgaatttggtcagggaaaagagcactctgtagtatcttttcaagcttgtaaggcacatataaatgaacggtattggacatatggaattgttcattttacgcaatacttactatcagatgttcttaaataacaggatgaagaacacatgcttaattagctcaattgtctatggataactgtgttgacgatcaacttttctttcagtttccagtttaggatgccatataatgcttgtacattctgcattaataaaattatctagcaccactaacatcctgccacagtgcatcgaaatatttctactcagcaacactattatcacttaaagctgcaggcagaccttaaactacgattttgtaggctatattttgtggacattatattctacaattttattcaatcatgaacacattttctcaatgcttttatttgatgaaacatagcatttaatattatacataatagcgttagtaattcttatggtcatctagttattgaatgactgttttaggtgtcatgaagtcaaatgcttatgatgtcaaaagtaggaagagtgataactgttttgaagtagaaaatgtgcgcctaccactcagctcccaaggatgctgtgcagcaacaggggcctaatgcgtgcatgcatatttgtttcccattgctgctatgataaatttccacaactttgatggctacacaaaacaaaacaccagtttattatctcatagttctcaaaagtgagaagtgtgaaatgggtctcagtgagctgaagccaaggtgttggcagggccacattcttcctggaggctctgagggaaaatcatttccttaccttgtacatcttctagaggctgtccacattccttggctcttgtacccctccatcttctaagtcaaacatggtgtgtgaagtctttgaccctgcatcacctgacactgattcttctgcctcccccttccacatgtaaaggacccttgtgctattacattgggcctacctgagtaatccaggataaccttgttattttaaagtcagtttattaacaaccttaatttctctttgccatgtgtgttagcattttctaaagacacagaaccaataggatctgtataaatctatatcagaagagatttattataggaattctcttacttggttatggaggctgagagattctcttgtttgcaagctggagaaccagtaaagccaggggtgttattcagtccaaatatggaagcctcagaatcaggagctgatggtgtaaatcctgtcccaagtctgaaagcccaagaggcaggagcactggtgctcaagggaaagagagaatggatgtcccagctcaaaaaaagagagtgaatatgccttttccactttttttgttctactcaggccctcagtttgttaaatgatgcccatccacattggtgaaggcgatcttctttatttaggccactgattaacttactatcttccaggagtaccctcacagacatacctagaaataatgttttaccagctatctaagtatcccttatcccagtcaagttgacacatacaatttaccataacaccatgtaacataccatattcacaggtcctaaagagtaggatgtggacattttaagcatttaaggcaattattctgcctatcacagaatgcatttctattttttggagaagctaggataccatattttaggtgaaatctctggatatttaaatgtttatgagatacgtagcatctcagtggatctgttttggcccataggctgcctgtttatagccactggtatactgcatgcctgactctatgcagagtgtttgtgtcttctcactcatggtttttaaatctaattgaggaagtaaacatttaaaaatatccataaaacaatattttaacaacacagtataagaaacatgatagggggctttgggaatgatccttgtagggtgaagcaagacaggtcctaaaaaatatgatggatttggatgagcaaaatggaatttaaaagacatgtaaaagatgtggtagttgggtgaaacaagactctcagcaaagatgggaaagacccttgagacatcaaaagtctggccttgctgggttaagaggaatgaaattgaggatcatttatctgataaaatgaaccaagtaatgtacagttttctatgctttctttagagtttggctttatttcgcgaagcaataattttttgtggtaagttcttgagccagagaaatagttgaatataagataagaatgttttttaaagaattatcacaacagagatgaaagcacaaaggccagaaagatgactgttttgttctccaggtgtgcaataatgagaaaactagactagggttctcaaggtgggttgaaaaaaatctgaaaagacatttcaaagaaagaatcagccagacatggtgagtgactggctgtgaggagttaatgagaaaaaaataaataataaaagttcagatatgggtctaggagcacagaggaatcattggttgaggtttatagatttgggtgattaatgtcattgaattaaattcatttttttttccaagagaaaagtatttgaggccaagaaccaagcttaatttatcttaaataaagagatgcctacattagatcaatgggaaaaaggtaagggaataaaaggggaaggaagagtggaaataccttaacacagcgttccaacacccaaaagaaggggaagttttagggtggaaaaagaaggattctgtgataacaaatacatgtttttgcagtgtgaaaattgcttgactgatatggaaatagagaaggataaagaaaaattgttaaaaagagtttgtattggaatttgaggcagaagtgaaatgttatttaagggaaaaagatgaatttcatgattttgcaagcttgaaatccttaaaagatagaaataaaggccagtagaatgatgaaaagcaatgttcctgaagatagagtggagtagacttctttgaagggtctatcaggtcacagtttcatcaatgagatgtgctcattttactcagttgagccagtgaacctcttttctgctttatgacaatactctattgactacagcagatactgactggcagaatctctttcctagaaatttcttattgggcctgagaagtttatttatttctgtgggtgacataaaatgtagccgtatgtactcaggctctgaatgcactgtgtgtatgcccatcacagcaattagaatagcggaaaaaagaaaaagcaagaggggcataaagaaatcagggactgacggacaggaaaggacagagagaggcagatattgcccacattcctgctggctttcctgtttctgctctgagcttcttctaaggtttctcccttctactagatttctatcattatcccatcatcttccctgtacatcttctttgattaaacaaggttgaagtgattctcttatttttaatcaaaagagtaataaataagacactaggaaaagttaaatccagaacactggctgacatttcgagggcacctcttcctcaagtaagaaggcagtggagaggattggcacaatgaatgatctggaaaaccagaaaacccaaagtggtactttggaaggctcgtgttcttcaccctatgattagtgcaagcctcagtgtagagaatgccacttctgagaatctctccttaaaccactactctggctgaagtgccctttcgatatgttacttctaacatattgctgtggatattcctatcacagcacttattatactatgtttaaattgttggtgaacttatttggagcagactctagactttaagctgtatagagtcagggattatatatatttgttgaaataataattcatatcttcccagtggagaccaatacttgttcattttgcacagtgcaagcaaagcctcattaagttaacacagctcttccctgaaaagtttagagtagaaatttagagttgatccttgcaatgtcataagaacatgcctaaagattgtaaatatgttgtttaatctgttagttcaatgatgaaatgtttaaagatgtatttagggattttgggaagttgatgattatgaaaaataattactttcaaaagctatctaaaatgttactacatgatcatgttagggttctagatctaagtataaatatggaaggcaaggaaaaagatggaagtttcctaatgagttatgattgctttggcagaaatatttttaataaggagtataatgtacagttaggggaaagtatgataataaaatcaagggaaggaaaatagccatcctataaaataggttgggcacttgactagtctacactagtagtttctagatcaagaagtttttccaagcgggtctccaagcccattggtacaacaagagatattcacttcttttaatggtctcaaagaaataagcatgtagttcttcacaataaggccggaggcttttgatagtaagaagaatatgtaatagtgatgttactatggacatagttcaagtctactatgactttttttggattaaactgtaaaagaaatggcaaacttaaacatttttccaaggcttgtccatgcactaggcactatgctacaggccttagacaaatttgccatctcattagaagtaattttaggagaattaagcgtttgaaaataattttgaagatgtaaagtttttgatccttaaaataagaacacatttattcatttgtactcatatcatgctttatctttaacctacacagaaaagcagccaacgtgtaacagggaggccaccatgtcattcaggtcaatgttgacaggtgtcagattctcagtccttcttggtcttcctgcacacacttgagctatctcaatcaattctttctcctcattgaaacccattccatcatcttctgaacatattgatcttcagtcatgcacatactcatcatactcttcatggtgtttctgcctgcaggcctctccttctcattatttctatattggtgactctgtcctcacagctgataccaatcatgcttcttacaagtacatttcaaaggcatggattctctagtgtttcactcacaggaaaataacactggtttctctcctttgtgcctgcagtatagattcacttagctgatttaatttgactgttagtcaaaattaaaaaaaaaacttttataaaatttcatgcattttcaacccctccccacattcccttttcacattatacacaagtggaaagagaagagtttcatataaagaacacacagaacaattgtaccacataaaaaagaaagaatcaatattaatcatgacctgcagtcatactacctttggctatgatcatctctgagctccagagaggggctcagctggctgcattttttaaaggaggaccctgtgggagagccaagaggtgatcagaaacacttctggggattctgcttgtgacacttcatgctggcagttctgcaacacaggctttcttgagagattatgtatgcttactggattgctagtagaaattctcacaagattgttcctagtctattgtgatcagggtagattgattctgcctcacctattggatagattctttaaaacattgggtctaactagattcaagaaaaaataatagcaacaacaacagttaaacctgattgaaatgttatgatgcagctgctatgcagcctgcttcatctcattaaatcctcaaaaatgtaaattagcttctgtccacatattacaggtgaggaagttgtggcttagaaaattaagaatcatacttcatcaattttgagatgcacatttttcacattttaacatctttgaaattggactgcttcttaatattgatgtgtctcatgaagataactggcagttttgtttgatttttctgagtgacagaaaaaatattagtgtatcttaaattcaatgatggtttaggttttacaaaatatggtatcttgtccaaggtcatccaattagcatgtggcagaactgactggaaatcccatgctatgttatcaaatgttacacctccaagaaagggaaactagagactagttggaggtgccccagctcattagaggtaatatgttcttgaagtgttgacaatctttccactggatgagatggcactgataaaagatttctaaagaactttcctattctggccccactttttagggagagcaattatgcaggctacagggagctatctcagtggctagagggagagaataaccttgaaaatttctttcagttttcagtcctcattctcatatttgatatgaagataaacagaggaactttgagcctctttgcattctttctttttacaatcttgtgttctctgaattttttcttcactgtcttctatagtccttagcagtccttgaatatacaggttatcctcccaggatttataagctaattaatcaatgacaagtgcagccatctctttgcttagggacagatttctgttgcgtattaggaaatgtgtcccagaaggcatttatctgtctttacttgccattcatattgaggagtgagaatgagaaaaccaataaatgttttttcctcttctgtttcgtcatcctttgtatggtttctcatgtttcactgcctcttgttttagtagcacctcagaatgcctgccagtctgtttttgagacagtttattggctgtgatactaagaaacatacaacttatgtttcttaacttttttcctgctgtatttgcctttccaaattaataccacaaatgacaactatttaaaaagtgggaacttgtcaagagagctgaggaaaaaataatgtaatccagacttctgtgatataatgttaatgaaatattttggtatgctgaaacctcaatttaatgttgtcttggtaagtgaaactgtcttgtaatgagtatctttaagtcacaaaaactttggaaatgtttccaaagataataaaagttccataacaccaaacttcatcttgggacaaaatgtatatataattccaaatacttaatactctttcttccaaggatgaatctcacttcagttatgacctcaaagttctttttgccctttgataaaggtaaatgctaatcttgggaatcttcctatatataacagggtgatttgtcacaacatggacagtcttaagaccagaaattagataccaaattctattactcttgtaacagcttttttaatcacaagaaatttttctatgatttttgaattgttttagatttattgtttgcctgggatttttttttatcctggctgcaaaaagaaaaaggtcagatttccatttaaaaggagtttgtaagtttccaaacaacagaagttatttctttatccatttttctcctacccgatttgtactttctcatcacttgtttgccatccagttaatgtacatccagttttgttttctcacctctgttgagaaacgtgactgagcgattagtccaattttatgctattatctaacgcatcacacatatgtaattgaaacaaaatgctgttgcatatagacttgtctgagtaggtgcttcagtattttctcacaaagagttggtataagcctctttcctccagaaacaaagatcactaggctcatctatgtaatttgtaaaactaagtgaaaaaaagtgtaagcctacacttgaaggtgagaaagtcagtctcctcttcccatagttaatggacaggtgatttccaagggattgccagctagggcactagacatctggattcggggtggacaagagttgactgctggctgcatcatggaactgccaggccacctgactgtgatgcatgcctgatcagccttcctgtacccacatccaggtcctccttcttcaccagacctagacgctgccaccctgtgtctagggtagtgggctggaggtgaggctgagaggaagaaggaagaattcgtctatgggaggtgctacaaattgtgtgccagaactccaagcttctgttgcatgcatactccattggccccttggactttacttacaaagcacaaactcaatttcaagattaccacagaggagaatattaagcccatttgccactgcactggttgcaagcccacaaagccatccctaaagataaccactatttctgttgtgaaccacatatttcaagtacagtattatttgcctaatgtttcaaatagttatttatgaacatttctgcccactagattataatctatggagcagtgtgataaaatgagtgatatctttcttggaatttctgttatatttttgtagctgctgcactgcaaataataggcttattaattggacaagcacagaaaacaaaaatatgtgactcaaggaatattacttaaaccagattttctagtttatttaaatcaagaatggtatacttacatgtaccatttgcaaatatctgcttgaatgttaagttgcttttcaggtttgacggcacagaaagagtgtaaggaagctgattattgtcatctgagagtggtcctgtgctaattgagtgcttttcaaccctcactgcaggttgcagtcacaatcattttggaattattttataaacattatgcatgggcccctcactcagagattctgatttaattgacaagtagatgagggcctggtcactaatgcttttcaaaagctcataggagaaaggtgtatgaggggaggggttgaagcgtgtgtcagtttgggtagtcagctggagtgtctatgcatggcctttccatggggcttggccttctcagagcctggcagttgggttttgagagagtctcccaagagcaaatattgcaagagacccaggtagaagctgtgaggcttcctgtgacctagccttagaaattccaaaacattccttctgtcacattctatttgtcaagcaagtcactaaggccaagccagatacatcaagagagaaattaagttccacttcttgttggtggagtgtcgggatcatattagagaaaagagtgtgggatgtaaaatattgttgcagttagctttgaaaaatacaatctgccatgaagtgttatagccctttaaagtcattttaggcagaactacaatattaaggggaaaaaagtcaaggaaatagctcaagatggggtttgttctcattatgtttgaattcactagctaggcttttaagagttaccagcttgtgatttctaactctgattgtaaaaagtctattcatttttaaatttttttgtgatggtaaagttacattgctgagttataaaaaatgaaagcaatgctaaattaaatagcaaaatctctttatgctactatattttccttcccagctctacttcaataaaggtaatatataaaatctaggatttggaagaatagtcaatttaactccctaactttatgtttgtgtattcaaaaatatggaacactgaaaagcctaaattttatcaaatcttaccttggcttgacctcttggtaattactgcatcaattagggtattcattaattctttgttgaacttgattcgttacagccaccaggtttatttagcaacaggtattcacccacacttgcctggcttcatgtctttcctgggcatggtattgttctggaactttacagaggaagacacatttaggttcagtctttagaatcgcagtggtattgttttgatgctacaaatgtttattcaaagttagagaacagtaacataaagttttctcattcagcatatgtataatatctattgagcaacctaaacttatttaggcaacctaaaatgagtgtacagtacatataatatgcagatattttatgtgactctaaggagtattcatctttggtgagagcacactcagcagtattaaatgagggatacagaagcatctgtgccttcattttatcatacagaaatttacacttatctcatattttctttccaagaactatgagctataattagtagtggaatccttggcatagatcactaggccagtcttgaagtataagttggcacattcatttcagtggcagagattcagccataaggaagaatcatgaaattatgtgtacttgaaagcagtcagagttactgatgcagtgtagaggtgttaatctcttactattctgaacatttttttttctaagaggttctcctcatacattgccacatgatcttaatatttttatttgcctttttaaaaagaaataatcatcagtactcctcagtttcccttcatcttgacatctctttgacttttataaatgcaaggatgaacaccttcctactccccacttttcagtgtgctcctaagtgaaggaccacctccttcaatactactcagtactcacagaaaagtaggtccttagacctactctacaactatagaatcagtaaaatgctgacaaatctgcatttcaacaagtttcccaggtgattctcgcaagaaattttgagactcgctgccctagtgtcttgctaccttacatgcagtcttaggaccagtagaggggacatcctttgggagcttattagaaacgcagaatctcaggccccatctcacacctactggatcagaacctgtattttaacaaaatgccccagtgattggtatgcacttaatgtatgagacatgctgatgtggagagaaagttaagtccagattcctaagcatgtcaaatgtggctcaacatgtttacttcctgtgtgtccagctcctccttctgcccccacatgggggacattctacctgaaccattcaccctatgaagataagccttttaaaattgcagatatgctaccaattttgagctacaaaatagaaatttcctatggctcaacataaatgtgtgcagttccttttattaagggttactatttcatggttccttttatttatttattttttatttatttatttttttgagacagagtctcgctctgtcgcccaggctggagtgcagtggtgtgatctcggctcactgcaagctccgactcccgggttcatgccattctcctgcctcagcctcccgagtagctgggactacaggcgcccgccaccacgcccggctaattttttgtatttttagtagagacggggtttcatcgtgttagccaggatggtctcaatctcctgactttatgatccgcctgcctcggcctcccaaagtgctgagactacaggtgtgagccaccgtgcccggccatatttcacattttcctattttaactgtattctctgactcaacaaatctactactaatgatggaagcttttattatgatttcccttataataataccaaaacagaataaaaatatattttctaaattttaatataaataaaagtgatatataagcacacttgcatcatgcaaattttatgttcctacattgcagctaattatggtcttagttaacaaaattatgtctttaagggaaatgtccatgtttctgaggtttgaagcctatggtatattctttttatgaaatggcagctcttcttaagatgatgataggcatccctacatttactaattttgtaactttattgtgttgctgcctctactgataaaggagagggttggcaggtcacccctgattttattccagaagaaataggaaactagagaacagctttacatctcaagtttttctgctgcgatataactatgacaaagaccacagcttggataggtttcagtttggctagagaatgcatacttcacatatgctctttgactttggcaatgttatctctcaggattttccttttggatggcaggttttttttcagatgaatatattcttcatgaaaatgagatcttaataaatctttaactccaatactgcaaaatcacacatatactatatttatgaaaaaaaactgtgagaagttttcactgtataccaaatactaacagataaatttatccaaattgcctggccagagaatatctgaacaattcagattatccacttcaataaataaaaacttttattattttttctgcttatgaaagtaatgtttgtttcttatacacactataaatccatcagtgatataggggaaagttcaagctcatagtaataatcattgtaaatattttatcatatattctttcagatttatttttctgcaaatactgtgttatatatgttatgatctatataaagcatgaacaactagtactaatgcactggagggaatctacatatttccagaatagagctacaaagcagttttgatcaatggtcatgctatatattggccgtaacatgctcctgaagggaagggaatgtactgtttttctctttgtgttttgcatgcatataactgttataagtgttttactaatatatactatgagcagtaaaatattagaaatcaatgtagtattaaatgaaatgcttaccccagtgtttcatttaattctgttatctttgtctgaaacattaagaagttttaatgtttatcctttttcatgaacaaatgatttgtatactttttgaaaaattattagttatttttcttactgatttgagaagaaaagttctaaattgagaacactaatgctctagtgtcccttcaaaaatattctttctaaggaaagaagtagaaactaatgtttactttgtagtgggctttattaagcaagaaactatcacttagtctttttcactcttatattttgaatttaattctttttaccttgagaatagcttaatttattcatgtttgggtgtttttcaatatttatgagtttatattctggttgtttaattttttcaatattttgagttaccacaagtaaaaacctccaatcttcatttcctcttccaagatatgtgtgacttacagaaaatctattaaactgactaatgaatacagccatacacacacacacacacacacacacacacacacacacacacacacacatacacacacacacacaccaagttcagggtcaaggcttaaatatcacaattgatcaaacttaatgaggataaggcatttgagacacttgaatggaggatgctattcatagttccaatgcttatatgataattatgaaagggagacccaaatgccctttatctgtgaaattctttaaagaaggggaaaatcaagttattattctagtatgatattgttctttaagatgagtcttaaaatggactgttcatattaattatcctggaaaacttttgaaatgctattcatcagtagctttggactagatttaaagcttggatcaaggtcaaggataaaattactttgcctagcaagattattacctttgtgactggaatttgacagatgctaagtatttttacttgagattctttgtgtttttatttccttctgtttaagaaacaaaaatggaaactattttaccccctttctaggactatatgctttatattctgaagtgtcagaggcaaagttcatctgtctttacatgtaccttttacgtcttagtagctcaatttatgagaatatgaatgaatgcaataatagtcatgtcccttgtaatctttgtgtaatttggagattaaagaccactgcaacacaggatgtttcactgatgtcttgatatctaccatgaagaaggtgtgtggctttttaaacataataaaaagagaggacaaaacttctctattgagaagttttaaatttagacttataaaagcttaaatttaaaaattttaaactttaaatttgaagttataaatttaggagacaccaaaagataggcttcattgacatcacctctgctgacatcacctcagcagaaagaataaaggaagaaggaaccaggtgaagtaccaagactaggggcagtctgacacctaaagctctgacagaagaggaaagttcagcaagggccacacaactacaaatgcatttttatccctacttgttgagtttaaggatgacttttcattaagcactgagataggagaaaaatcagaagattattctgtcatagaaaccaacagaaaaaaatatttcaataaagagaagatggccaacagtattggctgctgctgactatgagggcttggtaaaagtaggttcagtggagtggagggaactgaaacctgattacaggagagtgaatgggaggcaatataatgcaaatgcaaggatagaacactcttttgataggtgttattgagaaggtggaacagagaagggcagtggtcaagaaggaagaatgagaggactagaaataggttttctaaaaaagagacctttgaacatgttttgatgctaatggaaaaattccagcttaaaagaaaaaataaaaaacaatgatgatagatggagaggagatgatttcagcagtaatgttcccaagaggtgtgtttgggtagaaaacatgatgagcccagctaaagggctcagactttcatccaagcaggggcaaggtgtgtcttccacagaaggaaggcaaataatgtgggcacagatgcagaatacctagcaggtttaataatgagaaaatggaaatgttcctgctcttttgcatctattttttcctcatgaactatgagacactgagaatgacaaggatggttgaggaggtgggtgtgttggaaggtagaacagagaagtactaaaatgattaatcctacctatcttttaggggtgtagtttaaaggaaatctctcaggttatcaccaatgaaccatacttaacagataaggaaatatggaataatagcaaactataagagtgcccaatgctaatgataaagagtaagcaatactgtatagtagttttattctctcaagtctgactgatgcatttccattgcttcttagcagaagtaactatttttaaacattgaaaattatggacactatttattgtggctttctttgaagagaaatctctaaaataagtgagaagattttcagtattagtctttgagtgagtttattgaaaccaataaaatattccttttttgtgggaaggtgtttcaatttgcctttttcctccccataaataaggagtgatcaccccattcagaatgaatgtaaggtagcttgtaaaatatctatgtttggggcaataaaactcacctagaatgatcttgtgcctctgcttcctcaactcattttcttctttcagctgtgcagaacgttaattgtgtgaaggccacaaggaggggacacagcttgcccttagaagtacttttgaggacagattttatcatgcttgataaaaatgcctattctacaacatagtctatgatcatgaaaagagatccttctgatcttatagtttcttccgtgtgggtgtcgcatgttcctggataactctaagaaagtaaggtcaactctggctggaaataatgctctgttgtgttttcattgttcttgtttgctcatctactaattgacagcaataagctaaacctgggttttgaataattagaggaaaaaagttataggccaaaaatttataccacctagaaatatgtgtacatatttattatgcgtttccttttctccttggtgttggtcatctaagaatgaccttttactataaagtacgatttccttcttaacattataagcatttataaagtctgtgtattttcattttaactttcttaaattacagacaaatagcttgaggatttaaaaattacattatttagtgcaacacaaaaaatgaggaatcaggtattgttgaaatttgaaatcaaagaaatacagatttcaaatgacttagtactttttatttaagtttaaaatatttttgagagcttatttatgatttacaagttgagagtaatggaaataagcaagtttaactttgcagaaatctaaaatctgtatcccctgaagaacaaacatctaaaatgttgaaacagtacctaggtacacagaataaagtgaatataatcataaattttaaagacttgtagactggagccaatttgtaaaacatttctgagtcatcagtgatctcattaaaatgcagactcacacacggtgttataataatatgcattttagcatcaacttcgtatgcctccatctctgttattctcatctacaagacagtttaaaatataaaattatatattttttacttaattatgtcttagtattagaatgttttgttatttgttaatacatatcctcatcatacgtatacatatcatgtgcatgctctttggagatataatagttgataaatctaagaaatataaatatgtacagtacctattattaatgtatacctgccagtgtatatttatgatacatgatatttttctttgctcttttagaatgattgatttttgtctctatgtagcttttatggttagattgagtgatgattttctctctcagaggtatcagtggaaacatttctaactgcctgaggcagtcatatgccacagctggcaccatatttaaactacttttccacgtaagtgcataatttggtcacctggtgataagcagcaaaaagctacaaaaggagattttccaaaaaaaacaaaaagttttatttttagtgggctaattctgcacttttgtcaattaggcctttcaaggtagataaaaacatttgtttgcaaattaaataagtcagcaaatttcagcaagactcagcaaaactctgaatgccattttctaaagatgcagtcatatacttgttaggcgtagacaatcagatactctctatgacatttagtggctccccagatattgaaaaccttttaagtcaaagaaaaagcaacactattggctaaaggaaagtcaagacaataacaaatgaaatgaaaatattaaaaacattacgtaaataattattcttttttttttgagatggagtctcggctttgttgcacaggctggagtgtagtggcacgatcttggctcactgcagcctcttcctacagggttcaaatgattctcctgcctcagcctcccaagaagctgggattacaggtgcccgccaccacgcctggctaatgtttgtattttttagtaaagatgggatttcatcatgttggccaggctggtttcaaactcctaacctcaggttatctgcctgccttggccccccaaagtgctaagattataggcatgagccactgcacccggccaaaacatgacataaataattgttcaaaaagatatattctggagaaaaaagaagatgggacagataatttaaattggtaaatctttttattttatattcaaatttatatttttcattatttatgtattcatttttatttcaatgtccagttctgatttacttgttccttaaggataaatttcttaatgaaatgacaggtatatttgctctgagttactacgatatcaatagtttaaacacagaatgatttagtaaaaaaccagacatccatttatagtaacactttggaattaccttaaaaatctatttttaatgttttatatttttaaaattactgcctatttcttaagaatgtcatcaaaacatgttctattccaacgacaaaaaatatgaaagtatttatagtgacactttgccaaaccactgtctaatctgattaattcccttgctttcccaatattgtttttgctaggatacagaaagcctactttcatacctctgctaacctttgtgatactattaactcttaacctgttttggagcctgttctttaggttccctactttctgcttattaatttttgcttccaaaataaaaggatactctcctgtaatgaatatttgtatccttgaaaaaacacgtatgcacaattcaaggcatcagcagataaacgtgtttgtccccatggaagccagtggaatgatttgttgcccctcttcccgtctgtccccacaaattatgctatgttggaagctgctacttttgcttgtgcagcttgaccctatgtctctctacagagaattgaactgtcagcctttgaaataacagaataatttaggtgatgaggttttattttttttttcttcctcgaggaccatactgaaaaacatactactttatatagagataaaccctgtattctgtaacaatggtaagaacagtgcctctttcaaaatggcatttatgagataagtgaattgttcatgtaataaatttgagatagaagtttctctcagaaatattaattgcaacaagataattaagctttccggggatcagaagattgagagaaataggataattttggattctaggtagatagtgaaaaattacttgtaaaaaagaattatgattatttttattgggataagaaaataagatgctggactggaggtcactgaatagcattatttttaggaaatgttaattcataccctgagttttggaaaagacccagaagtggtagtcaatttgctacacatgtcctccaaatgttcccagatgcccagtggggggtataatctacaaatatggggtgaccaggctagctctcagctggtggttgatatagttcattcagctgggccagctgtttatcaggctaaaaataaaaagaagagtgcatttaaagagacaaaggactcagtaagagctaataagaattcaaggtaatgtcgacttttcaaatatttaggggaaggccgacacagcccagttaatgccaagtttcaatagcacattcaatccaggcacaggttaagcattttgggctctctgcttgcttcaggggaagtggtacaaggctttagacattcaggtttcatggagcctgaagccaatacaatgcaaaagactttagtaaaagtaatacaaaattatgaatacataattagtttcagggccttggatggggctcagaagtgaggaggactgaactgtaagtttcagaagcctcctggtaaatttgcctctgaaagcagaaatggtacccctgtcagtttcaagggcaggccttccagaaggagtaagagctgtagcaatcaggtaaggtgtggactaaagatagaacagtggcagcaaggactaaatgttagagtcacctgggagacttttaaataaaacatttctatgctccagatttctagagattaatacccaaattgtctgggatggtgccaggttattgacattatttagctcttgtccctcctgtaattctaaaatgcagccaacgtttaaagctactgatagttaataataattgtggtgaagataattttggagctaccatatagggaacatctcataccaagtgtgagatggcactgtatcaaacactttataggaattatcttcttaatactcatgacctgcagagatatgtgtatctccccatcttaacaaggaggattctgagctccagggaagtgccttagctcatacagcaagtgcaggaacctggatctaaactctagccaggcctggctcattttatacccacatatttctacctccttaggtagtagcatctttgagagggccacagaaaaagcacaagccctcacagaaagaaccagacagctgattgtctaccactagggcaatttgtaaggattgtctgccaaagaagtcctgggaagtccaggaacctccacacatacctgcagagacagaggtcactgttaccatatctggatgtcaaaaaggtcttttggaaaccaaggttttatcctttttttgttcttcccctcatctcctcacccccaacaccaagggttaaattcaacatcagtagctgtggcacaagtcctcctaacaccttttgtcctcattcaccccgtcacttttgctgctcacaaagtgctccttgctccctgggtagatactactacccctgtctgtaggtttcttttttttcctccattaatgctttccttgccccctgcccccgcttcttcctatgcatcatctgtagcctactgaagtgtgtttttatatacctgtgtatacccggatatacacattgggaaatgcttcccaattcctggcttaaactcttgtgctccattactcatttaccaaatagaagtgtcttcagctgcacttaatttcaaattccttggtcatgtttcggtacctccctttctcctgataagtgggaaatttcatagcctgggaactgaatgggtccatactagcccaggtacaatttgagaagcttaatatcataatgcacttaaaataacctgcagcaatcgaacaccaatctgtacctttataggaagtttatgcaccatggtttaccccatctagctggaagttggcttcaaaatcagccaggctccccattggcccataaaattagtggtgtccatgcaaggttcctaacttgtctggacatgggataattcccacggtagctgtgacttggtgatttgctctggttcccttctccccgaataaataggcaggtgaaatgcagaggaaggagcatgggaggtagagccaaagtctggcattcaaatccagctccattgctttctagttatgagaccttgtataagttagtcactctgtcatctcctgtataaaattgaaatgaaatgcctacctgatataatttttatgtgtggtaacatgaaaaactcttttgaaatgtgattggcacgtggggatgcctaatatatttttatatatggtttttaaataaagatgcttccctttctcaagaatgtgtctatcattataattctttcacagacacccccttttctggaaaagccttttaaaaatttttcataaccctggttatactcattttgtgtgattccaataagctgttagaaaaagcagagcatgttgtttaaggtgtagagattccagatattactaagttttctctccctgcctgctgatttcaggttcagagtcaaccctaatacataaattaagagaaatcattagaaaatatctcgaaccctcccttcttgttagtgtaacatgtgttcagtcagtactaatttatgcatgacattaaatttctttcctctgtactgaaaatgtgctcttttattgctttcaggcaattgattaaattcagaaacacttatattctatcctgtatagagaatagaaataaaaatatgtgatacttttgtatcatatatatatatatatatattctaggaaaagatgaaagggaaagtaatgtatattttacatatcaacgcattcatagatcagcaaattgttattgagtgcatactctgtgccaggaaccattctgggtattagggacatagcaaaaactaaaccagacagaaattgtggacctcatctaacataagttttacaattaatagagtgaaacatgaaaatagatttttcccttattttcagttcacacatatcatgaccagttagcttgtatttgttttttttgctgttgttttataacatgcttttatgtagtttatctaattaaatcctcgtagcaaatttaaaataggttaggtagattatgcttaaccaattctgtattagaggaaaggcaagcatggggtagcctaagtttgctgggagtacccagcaaagccagtggtaacgtttaccatggatttcagatcctccaatatttggtgacttccactttccacttcttctataatcctcatgttaatattcattcccctcttcatgatttaacactatatacaattcccaggaggaaaatgtggtagaaatctatttttccttgctttgccacactgaactacaaaaggtgcaattatattcatcctaatttatccatgtaagtataagcattctagaggaggaataaaaacaaagttagttgtattaataaagcattattatacatctggcagtagcttacatcttatatgtatatatttttaaattttgttctggctttttagtgacctaaggacaagaatgttgtattaaccacataggcagtttgagtttagtctcaacctagacttttattttctgctgttagttttactactagcataatactcaactgtttgacttttcctcatatataacttcagtgatctatttcatcatggttaacgttaaataagtatctgtaggtatacagatgtttcctcaaggagagaatgatgatgatggtgatgattataatctttttgaaatatatattgcattaaagcatttttcctaataatccttttacgaactatctcatagatgcatttcagcagagaatctctggactgatggagagacacttttatctgtagaacaatagtgacttctgttattaggagcaattgctaagcagctaaaacagatgcttttgtaccaattgtgcataactaaatgctgatcacataatacagtgttcttgtagccaagcaacagtaaataaaatggtccctatcttttctctctaagaaacattctttaagagggaaaggaaaaaataaagtcaatttgaggaagccagaaacaagcattccaactggcaactgagggaaaaaatttaaatgttagaatatgcacacatatatttctacctggctagaccatttttaggttgtctatttaagtggcctaagagacagtaactattctataaaatgtgtggagtggggcagaaaggttaaggaccctccgaccctgattttctccctctttgagcattggcattcaacatgaaggaaggaacaagtcaagccacagagaggtgaatgcactggaggaaagcttcaggaagggttgtatgtatacaatgtataggttagtttccatcttttaaaaagcttataaaaatgatataagaaaatgataatacatttttaaaaagaaaaattttaaacacaatctcaccatactaatgttttttaatgtattttttaacctagtgacctcgctagccccaggcacatgtagtgtattgttcatctctggcaggtttttattaagttctttaaattatcttggtcatttaataaacattactgttttaaatttcaggatctctatgacaacactaaaattttatagtaactgcctttttaccactgttcaatatccccagtgactatcaaaatgcctgacatgtagtaggtgcttaataggttcattgaatgaattaatgaacgctatagcctcttgttcaaactattcgctttccaagattctcttcctttccccttccttccctcccaaactgattttttttaaactgagatataatttatatgcgataaaatttaccattttgaaagtatacaattcaattatttttagtatagttccaaaatggtgcaaacatcaccaccatctagttctaggatatttttatcccctccaaaaaaattccatagccatttgcaatttttccccactctcacctccctccaactccaggcaaccactaatctatagatttatggatttacttagtttggatatttcatataaacggaatcatacaatatgtgtccttcttttgcctggcttcttcacttagcatagtgtttctagggtttacctccattgttgcatgtgtcagaatttcattctttttcatggctgaataacattacatcgtgtgagtataccacattttgtttatccattcatcagttggtagacattttatttgatcaccagttgatgatcatttgggctgtttctaatttatggctattatgaataacactgccatgaacgtttgtgtacaaatttttttgtgagcatttgtttctaattttcttgggtagatgcctagttgtaaaaatgctaggtcatgtgattactctgcttaactgcctgaggagcagacaaactgctttctgcagtggccacattatttacagtcccatcagcaatgtatgaatgttcccaaatctctacttcatcaacacttattgtccacttaaaaaaattgtatccattatagtggatgtgaggtgatatctattgtacttttgatttacattttctgaatgactaataatgttgtgtatctttttatgtacctatgggtcagttgcatactttatttggagaaatgtctattcaaattctgtgctcattttaaaaattaggttttttgtctttttaatcataagttgtaaatattctttatatattttggacactggacccttatcagatatatgacttgcaaatattttctcccattctataggttgtcttttcactttctttatagtatccctcaatgcacagaaggtttaaattttggatatgttcagtttatcttttttttttttttgctttggtgtcttgtgtttttggtgtcaggtctaagaaaccattgcatagtccaagttcacagagatttacatttatattttcttccaagagctttatagtttttactcttatatttaaatctttaatccattttgagttaagttttgcataaggtaggggttcaaattattttgcaagtttaggtccaggcaaccatagtaatgtgaatatcacaataaagctaatcatgctaattttttggtttctcagtacatataaaagttattttatttcgtccactgaagtcttgaacccctcaaagtcgttgatgagggttgtaatcaaccttttccagattcttattaatgttgatattttgaccttttctcatgaatcacgaatgttcttaatggcatctggaatgtgaatactttccagaaggtcttaaagttactttgcccagattcctcggaaggatcattatcactggcagcataataagtcttaaaagtcaaaatttctcctcgatccatcgactgcagaatggatggtgtgttagcaggcaagaaaatgacattaatatccttgtacattttatttttggagctcatgggtgaccaggtgaattgttaataaggagtaatattttgaaagaaatcttttttttttctgagtagtatgttgccatagtgggcttaaaatattcagtaaacccaattgtaaacagattgctgtcaacaaggctttgttgtttcatttctagaacataggcgtagatttagcataattcttaagggctctaggatttgtggaatggcaaatgagcactggctccaacttaaaagtcaccagctttattagcccctcctgagaaactcagtctgttgtttgaagctttgaatccaggcattgacttctcttctctagctatgagagtcctaaatggcatctttttctaaaagaaggctgttttatctatattgaaaaatctcgtttagtgtagcaaccttcagcaaaatcttagctatatcttctggataacttgctgcagcttctatgtcagcatttgctgcttcacctgacacttttatgttatggaaacatcttctttctttaaacctcatgaaccaacctctactggcttccaccttttctcctgcaatttttttcacctttctcagccttcgtagaattgaagggagttagagccttgctctggattgggctttggcttgaaggaatgttatgggtggtttgatcttatatccaaatcactaaaatgttcttcatatcagcaataaggttgtttcattttcttatcatttgcatgttcaccagagcagcactttaaatttccttcaaaaacttttcctttgcattcttaacttagccgtttggcataagaggcttagcttttagtctgtctttgcttttgacttgccttcctcattaaacttaatcatttctagcttttgatttaaggtgagagacatgaggctcttcctttcacttaaatgtttaatcctacattcacttaaatgtaggattattagttggcccaatttcaatattgctgggtctcaggggatatggaggcctgaggaaaggaaaagaaaaaggggaacaacaagtcaatagagtgattggaacacacataccacatttgttgatgaaattcaccaccttatatgggcatagtttgtgttgctccaaaacaattacaatagtaacattaaagatcactgatcacagatcactgtaacagatataataataatgaaaaagtttgaaatattatgagaattaacaaaatgtgacacaatgtgagcacatgtagttgaaaaactaacacccatagacttgcttgacgcagggttgccatgaatcttcaatcttcaatttgtaaaaaatacagtatctgtgaagcacaataaagcaaaatgcaataaagcaaggtatgactgtatatccggtggttccagtatttgttgaaataaactatgtttttctactgcattcatggcttttctccctgaatctgccaaatagaatttcctcaagtatggctctttatgatttacagcattaatgtggatgaacaatttgttttttattttcatggttacatatttcttttaaaaaatatctttcacattttatgcctggtttcctatttatgataaaaacaattatgcaagtaaaactaatgttgttttaaagaaaaaatattaggaaaaccataatataggaggtacttagactggcaaatataatgacagtgaggtagggataagaaaactgtggaaaatgctgtttggtaggttgcaatcaactaatctttagattagatattaggagttaatacattttcttccatcctccctccctccctccctttctttattccttctttctttccttccttctttccttcttttttccctaaggcactaagaaacctagaatattaatatataggaacagcttttgagttagtaaatctttttaatgatttaaattatctattaactctcttttaattaataaaagctaccagtttgtgagtgtttaaatgccaaacaattatctaggcacttcctcaaaaatttctgcatttaattcatactcaattaactttcctgaagtcccacggccagagaaaagtacaaccgattgtgaacccagattgatttcacctctcagccaacacaatctccttcataccaggctaccttttacctcttcatccacatgaattaaagcttgaatgtagaggaatagctctactaatcatagctcaggccatgtgagtgctagaggtctgggatgaaaatagctggtggggttctcagtcccttctcaacactgttgagaaagctttttgacctgcagtttcccttcctccttaaccattttctcccctcacttttttcttctgttttctcttctggaagataattatgaatgaacattttattgttttgtgaatatttgtagttacttatcatttaccaagatccatatttgaaatagagctatagcaaataaagattacatattcattgttttattagtgattataaaaaatacataccctcaggttctgacatttcaccatagtttcataaaatcgtacatctttcttgctttctctctcctttcctctccttccctccctctccctccctccctccctcccttattccttcttttcttcttttccccctaagatactaagaaacctagaatattaatctataggaaggaacagcttctaagttagttctcattttcctaagaggtaatgagatgaacattggcttttgagtttaaatcctgaaacattcccactaattattaaatttttctgagcatttttttcatataatataaggtatagagtttgctaaacagtgttgtttcgaaaattaaatgggatatatttatagtccctagtgttacaggcattataaatgtggctgtacccaacaaatgttgccattattaattttgctgcatatcatattatttttcatcattgtcattattaaaccaaatattttgttaaaaactagaataatttagattccatgcatgttgagaaacatgggtggtctggtgattgttaactggctcccagtgcagattgttaagactttttgatgaatggaaaccctctaactattgttgagaatgtacaaagatgggaagtgtgcttgtggccatgaaaacatgctgtgttttccttttcatatcaaatgtgatcttaattaagtctgttggcaacactgatttatattttaataaccagagatatattagctaaaataagagtaaagagttaagattcttaactaatctgtttcttaaagtgcctggctgggttttgcacattttctttggattcagtaatatacactatgcaagatttacaatgatattggtatagaaggatttccaaacaccttgcaaatcattatcttctgagtatagacagagaaggtgtagatattgttttgtcactataacctggcttgctatgtacctttatgatgatgtaaaatatactagtgcagttttcaaacattttgatctgttacatagtaaatattgcattttatattgctagctagcacacacacattcttagctggaaaaaagcgccaaattttacctttgctatgtgcaatgtcctcctatattttctgatctgtcttattctatttcattttattaacttatgccattagtttgattttataacccagtaatgggttacaacctgaagtttgataaatattttgtttcaagaagtaaccacttcactttggctctctaccaaagtttcagattaaggaattttatgaaatacctaggaaaatcttaagaagattatgacattcttcctttccttttttttttttttttttttttgagatggagtttcactcttgttgcccaggctggagtgcaatggcacgatctcagctcaccgcaacctccgcctcccgggttcaagcaattctcctgcctcagcctcctgagcagctgggattacaggcatgcgccatcacgcctggctaattttgtacttttagtagagatggggtttctccatgttggtcaggctggtgtcaaattcccaacctcaggtgatccacccgcctcggcctcccaaagtgctgggattacaggcatgagcatctgcacccggcctagtattttccatttttatgccagatcattctgtttggtaatatggctcctctctccctttcacattggttaaagacattttatttactttatttaaaataagagtacaaaagcatcctggaattgtatttattccctttaagtacaataagagataattccactgaatgtatattacgctctttcatttttttcctccagtttctactattttctacatttcataaggtttgcattgcgtatgaacttcttaatgagtgatttgtattgggtgtcatgttttaaatgtaaaaagagtaaattatcacaatgaaaacgaaggatgtcgaatgaaagagcagacggacagagcttgattgatgttcggaagttatttttgctgtgaactcctgtcagcctagaaatcataaaacagaaagaaggcttggttcagctcacatgcccttaggggatgtatggaaaagaatttaaaattctgatagagtaacttcaaaaatgtaacagctgaaataatttatttcactacagagccaccaactgaacttttacgttgaaatgattctttttgaagtttcacatggtagcaggaaggcacagtggtctctgcaccttggttgaaaatgcccaggctgctcagttatgccttcctgccggaaccaaactgtggccgctgctctggttcttctggcactttctcactgatcacttcctgaataatgggagaaaacaactgaaagtccatgatttcacaaaaagggtgaaggagaaaaaagttggggataatatgggtgtttttctttttttattttaaaatgcttccaaatattaatttggggcattgtgtgaaggcaatggaaaaaatattgggactacttagtccttgagtattttaatccataatgactactaccacatttgactagctagattgtgatatttgagctggctggatcttagagtcatctcagaagaagaaatagaaaagaaaatgaggcagtgccactctagttggtgatacatgacatttctttctgttctcttttatttttatcaagttatacctgggcagcctgatgtgtttgctttttctaggtgacattgaaatgatatccaccaaggaaaaagaaaatctgtcatccctgtacagtgtttctcaacctgactccatctgtgatagttgtatgtttaatcgtagttaactaaaaatatgcagaataatgatgatgaggctaatacaccttaaaatgaatttccactgtattaaaacaacaacatgcattttataaacatttgtatctacctatgtatggtttatgtattagagtgtataacctaccatatatccaacctatcaaatacattcacacactggaattctagattccttacaaatcattccacatatctacagtggtctgtaactcaccagttgaaaaccagtactctaaaatgttaaagatcactatgccaatcagatgagaaaaagaagcaccaggaaattcctgaataaattgtttaaatggtcaaaactataaaataaaaagagtgtgaatttaaaaaaatgtattatctaatttgtctgtattggtatctataccttgagacaaaatttaacattttcctggtatctacagatttttttttttcaaaggagatccttctatcttgctttggtgtaaagaaacaacagaaaatatgctgttgctataaataatatttataattttaataatttcctatgctaattacctaactgtgctctattattaaaaattgctaaggtagatgattgcacatgtaaaaaaagacacaatgacaaccacaaaaacaaggcttcacatatattttcagcaaaggtgaaagaactagaattatacattttcaatttgttactgaaaattaattttatatatatattttaatatataggtatttctgttcttatgaaaaatagtttcatgatcagatacagaatttgaaacatggaaaattctgctttgaggtaggggttaatattgaatcattttatggttcatagttaactaccatttattgaatgctgaaaagatatagttaactgaaaagcattctttagttaacaagcttttacaattgagggtaatttttgtctcctgccaaagaacaacgagattgaattctatgctaatgaaactgtttttcagtggagcatacagtgattttcataatcctagtcctggctgggatgttgggaaagtggcacatagccagaataattaaaatgggatttaaggccatattttggaaggctttcatttttcaaaatggtatgtttgtgactgaagttacttctgaagtctcaaaaatttcagacctgaaagtaaacttggtgtcaaggaaagtcttgacctttaatttaaattgcaaccaactttgctccttctagctttctgatcttgagcaatttgcctaacttctctgagattcaacttccttaattgtaaaataatgtaatatttatcttgcaaggttgttaagaaggtccttataatctctcaatcacctgtcacgatgtactcaataaaccatagttgctattattatcattagtattatcaccagtataatcaaatagttattatttctatgtgatttagcagatgatcttttatactcaaagtaaactcctttctaatggagccgtcaggttaaatatggccaatacaagctaaatgaatggggctttgaatacatctatttgatgaacccatgattatgaaatggaaatgctaaatctgcctcaatttctctggtgataggacagatgagattcttgagggacccagattgtcacgtgtataagttatttgctcacctttatgaacagtcctttttcaaatgaatattgctcctttggtaattgtatactagattgtaaaatgtctttacatccctctgaataattcttccttaaaatggtcagacacagtattgatttttcctggggtattcctttgccttgacccagctcacaatgcactatccattggacaaaataaagcatttcctttatatgaagaaaagagaagggtaggtagagacaaaggaaagtctgtctggaaaaatctttgtactttgatgggctttgtatggaaaaaaagaaatcaaagcttagggcagagaacttggacgtggtaggtgtaggtctctccacaagatggcactcattctccctcttcttttttcaattgccaaaaataaattttgtcactttttattttttactcagtcacagaacaaatatgttgttagtttgtgtatcaaatatacctggtttcacatattttttaagtgttcgatcatgtttctgactcttagtagtaatgagtgtattttacctcctgtaagtctctgtcggtgagtacactgttttgggaggaaacactcacccctactcccagtcacaaatctaacaaaacttaaattaatcttctaaaaattttctgttaaaatctccaaacaaaactgaagattaactgaaaagaaccagaatgtctccattgttgtttttatcattattttaaaatttaagtggacatgcctttcaattttagggaaaatctctatgatacttccaatacttccattttgatgtaagaagcaagtttacctccaaagggccttgggtcttcttacccttgttagtgatacgagatgtcacaactctcttctagtcactggaagttaatgtcaattggagtctttataatcatttaatttttcttaatacagaaaaaattgatctatcaaatgatttttaagttcatatgcaaaagtaatgtatgttacttattaaaacattaaagaaaaaatgttaggctactgtgagttcactaaaaacaggaatttgataaatggtaagtaaatacataaatttaattgataattttgcacttatatttttatatcacattatattttctagttacttttctttccaaatacttagaaggtaaagaatgtatgtggacaaaattatagcctacttgatttgttaatgtgatgataaagatctatttaaaaattctggttataccatggtttccagggtctagattttcttttagcccacttcagagtcagactttagaatatttatcatttctgtaaaacagattcctgaaagttaaggtctttcataccttcatcataacagttattattatggaatctttgcctcacttttcagaatgctaacagtgttggacgctaatattacagaatgcttgccaccctatcgtgaaagtcaccctttgaaagcaggaggaaaaaagaaaaatctagagaaggccctaagaagacaaaagaattattgtagtaagaaaactaagacttatcagaatattcataggaaagcaaggctacggcttgaatgatttgataaaaataaccactactgccataataacttgttatgggttacatgctacaccaagcaattcagaattattagatcctttacattcctaacattcctaatgaaacaaaaaacattatcccctttgttaacacacaggatagctgagaatcagaaaggctaagtggcttggatttggaggcaggatttaaacccaggtgtgtcttgttccaaagcctgtgccttgaaccattatatacccctgcttccctgacttgtaaagacattgaatattggaatttggttactggcttctaagataagcaatatctttacatgaatgtagattggttattgcatcttttccaattttaaaggaattgagaagacacattttcaacaaactcaagagattttgatttgatgaagggaagaagtttttgattctcaggctgtggaaatagtgaaaagaaacaaacaaaaaggattatgtggactctaaaaggggtgtcttcaagaaacaagtagtcaaaactacctttttaaattatgtgggtcaatcccccaaacgaacataaggagctgcacacaggtatagcctccttttagacatttttattatgatttaaacacctttatgtgaaacatatttcatacatattgaactcagtcaacatcacttcacattcacttcgtatctctgtctgtatatccctagacctttaaggagtttttcttacttgttgtaacttttctcattaactgtttttgtgcattctcatcaaactaggcacctaacctactttcatttgttatagctacgtagaagtttcttctgttgttgtgtcttagtttacctggatatttctgtgctgttgggtatttacatttttcctgcttttttctctattatgagtaaatttttttaaggggggagtgggtacatgttggttctctttgaaataaaatccctaaagtgaaattattatataaaataatactaatagcttttcaactcttgttaaatatttccagattgccttttagaaagaacaaacaactttttaatgacttcagtaatagagaaatcatagatcccaaactcaaattccgaataaatgggcttttcctagttttccaaactggcaaaataagtgagtgtaactgactaggtgtttgacaacagatggtagtgggagcaacaacaacctggagggccaggcaccagagaaagggggcagcagcctctgcaaagtgaagggggcagcagcctctgcaaagtgctgcctgactgttgctttggttatgtcagtgtgtgtattggtcaggattctccagagaaacagaatcagtaagttattacaaaaggagatttattatgaggcattggcttatgtgattatggaggctgagaagttccataatgtaatcactggaacctggacacccaggaatgccagtggtacaatttagtcccatcccaaaggcctgagaaccaggggaggtgatagtgtaattcccagtcccagggttgatgatgagatgttacatttcaaccaggcaggaagcaaaaaggggtgacttcctccttcctctaccttctgtgctgttgaggctctcagtggattggatgatgccacctgctttaggaagggcaatccactttactgagtccaccaattcaaatgctaatctcatcctgaagcaccctcacagacacacccagaaattgtttaagctgagagatttgtcaaattcacacataaaattagttatcacaagtccacctttcatcaactaggcacccatacagatcttcttaaaccatacctaatctttgaaatatgacaacaaggctatattctgtctaacatgacacaactatcctgaatacaactgaaaattcgattcctagatgagaaagtaaagtacttgaatggtgtttactctttgtttgatatcctatgacttaaagactattatagaaaattaagagtactaaaatactataatataaattcaataaatcatattttagttgatgggggaacaagagaggaaagaaaacatttttacttcctttcctctcgtatatctcttatatatctggcatacaaatgcattcatggcaaaataaggaggaaatactcatgacaattacattcctggcttctgttactggtcactggtatttataacgaccgttttccaaactattctgtattccctttgccttcagaaagtaccctcgtgcggtaaacccaaatcttcattcctagagggtctgagccattactagtcctgcttgaatgagattgctgtgtttttccattggctttaattataaggcatagtaatactaagaaaggccctagaggatctcctgtattccagacatactcttccttatctccattgtggattaatagtccaatttcctttttatagtcaggatcaatcccccttgtcaactctcttctttgtctgttaattcaaaggcaggaagagtacagagtggccaggcagcagtcttaacttccagttcagtggaatcattgctgggtctcctcatggaagcattcttcccttgggaactaagacctctaggcctaacagagaatagtcacaaaaacaggaagcaaaaatagatgtgtgtgtatatacatccatatgtatatatgtactatatatatgtatgtatataacagtatattttaatgatgtatttattgcatggtctcatgttgctttttttttttttttacatgttacagtttggatgctttagttttccatatctgtacttatccatcttgtctctgttcagatcctaatcactccatttctttagtatcaggaatttatctcctctccaccgctggagaagacctgttctttattctctagtttttaataaaacgttttactctcactcagctggaatacagtacaatttggggtatgagaaatgactctaaggtaattttttccatactgctatcacattggcccaacactatttattaaatataatttatttctatattgttggggattcatataatcatttaaattgatttttaccaatctcagttgtatttcatcagtctggctttatgggctatgaatttttcttaatatgtaattattgctttgtgagtttaatctctgatataataaatcatacagagatatatcaaatttctttattatttagacaaggtgatctcttcatgtcctctaatattctcttttgcccctctccctaaaaaactgtcatattctaaagccaactaatatgggaaggagaatgaaatgatattagttgagaatgaatgacagactacttaggataacatgtatgccaagtgagttgaatcagctgatgtagtagtatgactgacagtttttgttgaatattttatgaatctattaaattaagaaatgaaatggatggtctctaaatatccttataatgtggacattctctgagtttttattctaacataactctaataatttggacaacctcaatatctgacagcatatttcccttgtgatataaagtcagtctcagacatggtctcctctagggaaccttccctaaatgccactacaactgtccatgcccaaatctgaagcttctcctggctccttctctttttctccttgacactgtgcttatattactactacaaaggccccaaaacacagcaaagaataatttgttaaatgagttaagtccatttgagacctgtaaagtgactttcactgttaacaatagtccccctctgtgggtagaagcaagaatgagtttccaaacttgggaggtttgaggttctggcatcacaggaatactcccagattgctttcaggaggcaacttcatccttgccatggctcagatgtttgattggagtgaaagttaaaatgagaactgacctacctgataatcatagtgacaaaatgaacatatatggggttattttaattattatttcagtccaagatggtcagcagaaactgtacatgtatgacacatttagaaacttagaatattttcagtctttatccagaaaaccatagaggatattctaaagtttaaagcttaaagctgctgcatcttcacactgcaatttattgttcactgctgatgataaactggttattcctgtcacaagagtgtgctaggctgagactctgggaattgtatttatctagacaatgataatataacatagtaagtagaaatgaaattttcccatctagcatgttttctgattacatcttaaagaaaatcattttggtaaatatatctgaaatgaaggtggggatattttacagctgtaaactatacctacatagcagggatgtagtccattaattctcaatgctcgaggtgaggctgacaattcataagtggtaaatccagagagttatgaagatattaaatctcacatctggtgagaaaatgtgttatttcactgggttgattgacggacactttcccattacagtgcaatttgggaaatcgcactgttaattgctagggttttagcaaagctctgtagttcaattccaattactttagttttgaaaaacagaacagctggatggtaaaattgcccggagctgtcaccaagggagggcacaagccagcaacccaacctctaccattcctgatttggattttctacagagctattagtgagtgaaattgaaggcttctggcaccggaggtctccctgccatgtgccttcttctggctggaagcacgtttgtttgcttaccgctcaggtgattgccaccgtaatcatcaggcacgctcccattattactcatttgcttccctcttcacaggggagagatgagaaaagcaagtctcatcacatcttgatctcctcaccacagggggatcgcttccttgctttagagccaagtggagtttacactttctcctcagagatttcttttgctgtcaaattgacctttgagtccttcgttatctatgggggcgaattacatgtttccacacacacagtctctttgtctctggctaaatctagaaagaacaactccagttgtggtttggaaattacctagcatcagcagctaaatgtaatcaaactggatgattcagtacatcccaccactaactcccacatcgacctcagttcactgtgtttgaatcaggtgagtgtcaaatgttttctttggttaaggtaacgtggaccatatccagagcctcctggctccgccttgcttggtatagctgtgaatatgtaaggggctttcttcagtagcttcaggatttaagagcataatgaaatgggggtgtcacacttctgataaaatctcagtgagcacacagttgaagaaggatttcaagaagaaatatttgtgagaagaaaaaaagcttagttatgcacatgggaaatttaaagaaaacaatatcttgcctttctagaatttctttttaatattcattatttattttttatattgtaaattcagactaataatttttggtgtccctcaaagtcaatactcttgaaatatgtggtcaacacattttgacagggacggctgtggtgggggaagggaaggcatacatagactggcttcaagaacaagtacctttcttccccagcaatgtagctcccaccccagacttgcacaataatcatctaaaaaatacctgtcctaactactgttactcttagaatgcttttttgggagtcttactcccccttcttctctgagaggcttatcaataaggtgactatatgcttatgtggtctgcgccttgtcctaatacaattattaataatataccttgtattagtccattctcattctgctaataaagacataccaagactgggtaatttataaaggaaagaagtttaattgactcacagttcagcgtggctggagaggcctcaggaaacttaaaatcatggcagaaggggaagcaaacatgtccttcttcatatggtggcaggagaaagaagtgctgagcaaagggggaaaaaagcctcttataaaaccatcagatcttgtgagaactcactatcacaagaacagcataggggtaattgccattatgattcagttacctcccactgggtccttcccatgacacatggggattatgggaactacaattcaagatgagatttgggtggggatagagacaaactgtatcacccctataactttcaaaagaatacctaggtcagatgataaattgtatagtagttctgtttatcgatgtatgtcttaatcatatacaatatttaggtttagaggaaacctgttaagtaacatttcctcaatctccccagatttaccgttctgttcttaacctttgtaaattgatgccccagtaagtggtcccatccttcaatcaagccatacttaaaatccctgagttatagaaaagtatgtctgaggggaaagttaaaacaaattgtatgcaaaaaaaaaaaaaaaaaaaaaaaaaactcttggaaaattaagaggctttatttaccttcaaaaagcaggacataatggtttaaaagtaaatactcattgttttcgtttgtcattatttgtgacttgatattttggatcaatggcaaatctcttctgaaatatttgaaatgccactttttaaagctgtttttatatctcttctcttttcttacatttaacgagctcatcgcttttactcctctcttgtaggtcctcttttccgtcttctcattcctgtggatctgtcctgtagcctttccacgctatcctcaggctcatctgttttctgaagatgggaaaagccctttggacaaggtaggtatgcctgatgataagcagaggtagcattttcaatgtggaacatttttagcaaacctgaatactgccagtgtgttaataatgtgtctttatcaatggaaactctttttttttctacttcattatatacctctaaagccatttatcatgggaatttattagttttgtttaagtgtatgtaccggtatttttcttcagtgaaattcatttctatatacttctaatgagagggaccatttgtttagattatagtccatactcgatcctgctcttctttttgaaagtctttgaaattctattttgttctctccctttccagacctgctattgcacagaaaattggatttgtttttttaccttagtaacttagttattcataattctgtgattattcctcatgtgtgatttctgtctccttggctatatttaaagtttactggagacagaagccatgtcttcatataccttttagatctcttacagaactgagattcttgttaagtacgtgaagaaaattgcattggttagcttaacaggttcttgaccaaagatgtcagcactgtggttgtctgtaattcttgtatacagaagctgttttagccaggggtcttagatttcaggcatgagacaccacttttagtttgcttaagcaaaagtgagaatgctgctggaatctgttgggaagttatggctgtgttttagaaaattgaaggaacaaagaaaaccctagtctcagaaacagcagtacccagggtggcctagggttccaagtaatcattattaatggacaagaatccttagtctttgtgttgtttggaattcaaagtctagatataagcttgggtcttatgctgtcattttttggacaggtgttgtctaggttggtgttgtcttcatgtcttggacccatgagtggacaaagaccttaaaaagccctagctctgaagccgttcctttctatatgctacttcagacaacgcatatctaaaggtgcaatgatagcactaccagcccactgagtgtctttcatttcatttcattgctggattttttttttctttttccccaagcagacatgcatgtattctctcccactctgccatgcattttatttatatctcaccctagggcacttctccatttagagattctattgtaagctgttatcatctgtagcattgactagatttctatgcaggttaaaggaaggaatgataatgcaaagttgctagctctaacagaatgttattaaccagggaaaaatacatttaaaaaaatttcaacttttcttttagatccaaggggtatatatgcaggtatattacatgggtatattctgtgatgctgaggtttggggtacaaatgatcccatcatccaggtagtgagcatagtacccaagaggtagtttttcagcccttgcccccttctctaccttctccctccagtactccccagtgtctgtttttctcatctttatgtctatgtgtactcaatgcttgattcccatttgtaaatgagaacatgtagtatttgtttttctgtccctgtattaattagcttaggataatggcctccagctgcatccatgttgctgcaaaagacgtaattttgtctttttaaaggctttatagtattcctagtgtatatgtaccacatggcataaatacatttatggatgacttgaaacttgtagttatatcatggttcaaggcaatgtactcttctgtgattcctgctaaatttttaaattgaaatttctcccttttttatattacctcttctcagacagatcaaccttctccttcctaaaaattaacagtttccccacagtacaaatagagtataaatagccaaaggcagcctcttgatgaacaatcaaaagatgtgatagaagctgaagtcattacatcttgtacaataatgttgtttctttctttggacttaaaagatattgtgctaggtataataaaaatagcttttgttattttgtgtcatcatattgtaatggatttcactgacattttacttattaatttttaacattaatattttattacaaaaatgtcatcttgtcacgcgtgaacaatttaaaataagttctgctttttaaagtataattgaattacattatgccataacgcctccttttttttttttttttttggttacaacttgtctgatatttttaaaagaaaatctataggaaaaaagctaatataaatgttttctctgtggtataattagaatattttgaagtacttttatatttattatttaatttgtggtcataaatgtgctatgaaaaagacaggtggtttaggatggcagctttgagtcacgaggtatcagtcaacctggaaattgaaatcaaccatgtggataatcaggcaatcatacaatgaagccccaataaaaactcttaatgttgagacttgggtaagctttcttggctggcaatactctgtcagctgtcacacttcaatgccaggaaagtaatacatcctgactttgtggggagagaaacatggcaactccagatttggtacttccccagactctgccctttgcccttcatcccttggctgatattgaactgtatcctttccctgtaataaactgtaaccatacgtataatagtttctatgagttctatgagtccttctagcaaattatttatcataagaatggctttgggaatccccaaacttgcacttggtgttaaaagtgagggaggccttacaaaccaactttgcagttgcctaaactcccaagaagttgacttaaatgctcacaataaggtactaaaattattgatttctcctattccctctgtcagttattttgtgaaagagactaattggattcagtttttgtctatccatgacagacttcatccctgaatttaacacccccgaatttaacattttccatatttattgaagtaaatgtatttgtttaaagaaaccagctaatgaggacagtaacacctaaaaatattttatttctttttgaaaactaggttttgttagcaagtttaaaataactaaagagaaagagaagagaggaaaggaaaggaaaaggaaaaggaatggaaaggaaaaaattatcacatatagttaaagttcaggccatacaaaaattttatctgtgaaaaagtaaatcccctgccttcctcctattatagaatcttttgttgctcaaaacaagacttgtatccctccttttaattcttacatttatgtatttattaatgttaaacaatttctttcagattgattgaggccctaaaggttatagtttgtgtgtgaaatcacaagccacacattaataatttatcagtatttttttctatctccttatcagcaattagcaggccccactcattttttttttctaatctctacatacactatatttttattatcctttttcttgcctgccagccaccacttctttagttttattgatttggtgcctcttttaaaaatatttgccccttcccacaatataagttcaactactggttggttactgggtgcctagtgtgtgtgagacaccatttactattttgaggatcatttattggaaaaacctaggtcttagttaatgagtctctagatttgatatgtatatgtgtatatatgaatgtgtgtgtgtatgagtgtgcatatgcgtgttccagccttcagaaatgatctttacttttgtagaacatcccaacattctgtgatgtaatctttaattaatgataagggggaaattagacacatatctctaaaactcactatgaaagtctgaaataggtatagtagaataaattagatggaataaactgcattatattatacttagagaacagtacactctaagtaagtatcaagatgtcaatgataagagcatactctcacagcaattaaaatacagaacatctaaagaaagctgaccattagcataaacccttttgaaaattctgaagtctttcattttcattggtaaatcttggattttcagaaaatctaaagacagtagcttggctgggcactgtggctcatgcctgtaatcccagcactttgagaggccaaggcaggtggatcacttgaggtcaggagttcgagaccagcctggccaacatggtgaaaccctgtctctactaaaaatacaaaaattagcagggcatagtggcgcatgcctgtaatcccagctactaagggggctgagacaggaggattgcttgaacctgggaggcagaggttgcagtgagccaagatcgtgccactgtactctggcctgggcaacagagtgagactctgtctcaaaaaaaaaaaaaaaaagggacagtagcttgatgaataaattgcttaaattaactaatttgagacagatcatgaatttaattagcaaaaatctatatttgttaagttcttgtaccagtactcttatcccatttaaccaatatagaaaggaattataatgctatcataataatataaagagaagcatagaattgtatgatttttgtttgattaataatatatatcttgtcatagaatttcccctctttaatttataaggaaaagaagatatgttactagagatttcttaagtcctaattacaacaatagctgacgtgttttgagtgctacatgtatgtcaggaaaagcattttatgtgttttgatgatgtcattattcaccaaaacactatgaaaaaggttatattattatccccattttactatgacagcaaagtcagtcccaggttggcttaaatatcatgtttgagaggaaaatatagctaatgagtaagggagcagtgtttgattccagtctgactccaaatcttcactattaaaagctttagggctggaataaattgaatgatcatctcagcaaatattgttatgtttcagctaaagatactgagaaccagcaaattaaatggcagctagtttatggcaaaataggaaccagggtgcaggtatctggacctcatgttagtgcatttagcgcattttaattgtattcccttttcttttttacccactattagttcaggacaatcccagcctcaaaactttcaaactggagacatgaaaagcatcatataaaccataccttgtctatcttcaaatacaaagcctttcagaaagaaagggatccatggctctaaatatttagattttcgaccagtttattagggattatgaaaacttatttttaatgtggttgctaattcatctcaaactctaagcaagttactagttgacataattaaatgcttaccctaaaatggatggaaaagattcacacctgaagttgtttaaatatggacaactataactgcagtttgcattcacaatgacagtgaattatacgtgatttctgcagaagataacagtgggcaaacaagctttaacaaagactgttttttctccttttctggttatttttaatggccatattcaaacctaagaaggtgtataaactgccagttttctcaggatttcaggatcccatttattctaaaaaattttcaatgaaagttttatttgtggcgaaaagaagtggaatctgggtgtggggtacagcagccttccaaaagcaaaagtgctttgaagtaataaccttttctttgtttaatttaaaaataatgttttacatatttaattatttaataaaataacaattaaaattgtcactccagaagtatgtaccatactttagcttgcagttcaggtatttctgtcacgtagactattgtagtctctgtttaacttgagtgaatgtaaacgccagtttaacaagcacaggtagagaatatgtgaattttgagaagcatgggattaaacaaacaggtttcttgctgcagaacttatcaggagtttggcgtattagtatagactgagagtcaaaaagagggggagacctgagcatttccaaaatatgtttgaccatataacctttttcacatggatcgcttaccagcatcttatggcgtgagtagtccaaagaacacattttgagaaagtctgttctgattcattgttatctctatgttttattatgtaaatacgtttttcttatttttttcatttaaaaattaagtactataaatattctatagtgatatcaaaagagatttatgttttggccatttctttcaaagcctgtcattaaactttgtttgtatgtgaataaagcttttgcacaattttctcagtgtttgaaaataatgtcactaggtcactagtctagaaatatctcctggattctgatgcctgccaactctgggactccatactttctagtcatgtaacctttcttagtctcgattgcttatttaattttattttagaaagataacacctgtcctatccaattcacagtgttttgagtattaaataattacatttactgtataaactaggaaatatgagagcaatgtgaggtattatcaatattattaccaatattatttttactatataacatctcatttccatttaattctctaaaaagtgttggataggcttggtggagacttactaacattgatgaaaacaatttgaagtaaggattgattgattctttgaattaaatgtgagttttttctaataggttcttctaccaacctttgaaaatagatctgtctatatttttatataggttatgtagctttaatttgtttcttcttatttgctgtcagctgtcatagctaccattcccatgggaggctttctttgtcttataatttatttttaagtgagaagacaaaactgttttagttaaatttttttttcaagttttctgtaagtggcatttatgagcaatttcagatttattctgttataatggcattttaaaaagattatccttaggcattatgatggctttagaataaatctagctaaaaattttatctttgctattaaaaagaccgcttctaaatgtctttaaacatagtccatctttcagagacccttttgtttgaagataagtttgtcccgtgagtatattgaacaacagtaatgcatggcatttattcagcattttgtattttcaaagcaatttgcaatcatcaattcatttaaccacccaacaatcccagcactgagaagcaaatgtgacctgaccaccacctgagctggtattagcaccccaaattgccttctatgctcacattattgagacttgctttggttaaaaaccatccttgagacaaaagaaaagctaaatataagctccttccttctgcttctttgtcatttattttctcacaagtggaataatctattgccatttcagtgggagctgtctgagtccccattactccttagaggtggttttcatttaaagataatgacaagctgttatggtaagatccttttagagaacttcatgtgctcaccctttaaggtcgaatttagatgttatttcataactgaaatgttccataaaacttcttttttggtcttcctaggatttaatttctttctcctgtgctcacacagaattttatatatacttctgttatagctcttgccaaaattttggtgtagctctaagtctagaatgggagcattactatggcctgtaaccatgtcttctttatccttctatctattgttgttcattagcacactgtctggaatatgtgggaactcaagaatcttttaatcccatgttagaactcaactgctccaggtggctttcacccagccacccaccttatgctctgactgatgtgcggagtagaaaatgggaactgaattagatgagtccaggaaagtcttcctggatgtatgaatgatttggctaatttctcagactgatgaggtgttattttggtaaagaacataggaaacagtgtgtgaaagctctgaagcaggaaacagcataacgtactggactatgaatagtcctagtaagagtggccatcacatgcaagcatccccttcattgccgtcattgccatcatcatcttacaattaccacttaatgagcattttcaaggaacccactgctgtcattggtgtcttatagactttttcacacataaaaatcaccatagacatacagtgcaggaattatcctcataattttttcaggtaaagaaaggttcagagagactaagaaactttttcaagttaatgcagctagtaagcaacgtagccagcccttgaaccttaagacacagggattgtatttttgtggattgcgtagtgccacttgcataccatctcgagactgcttgctccttggaatacctgctgattgtatcatttctcttttctcctttgtctatgaacctgcaagtggtgagcagcccagaggctacattcagtggaacttttcagttctgtgattctgttcagaatccacacgtcctctaaaaggcctcctatagaaggagtccccattaactgtaaatggagctctgatcacaggaggaatgaggacaggagctgagaccattattctctattctaagatgtctaaagcagaccataacagcttttatgttttcattccttgctttgaggcctacaccttgaaggctacctttcttctcaggttcccaaaatggtttttattctcagaattataaaaggcaatgctattagtgcacactcatgctgtttaaggaagcaaaaacttttcaaatcttgagtacaattacttatggagtgtttaatttaaaacaagacagattgagctttattgcttgaggttaaggatgtgatatattccttacagggctttggaccatgtagtggctcattgcagagtcaactagaaccatttgagaattgcctgacacaatatagaataacttacaatttatatcaaagaaatcaataaaatttgcaaagctttatggctctttgaagacttaggtattacctaaatttaggtgttacctaaaatttcagcaaataatggtttactgtattgaagggttccattccatcttccatcccaaacacactatattataaaataatgcaaggaacatttaattaatttgagaataatatagaagtgtgtaatgtggatgtgggtatatatgtatctgtatttccatgtcattttgggatatggaatgtgcattttaggatttagaaaacatgttctgtgtaacatttctttgctcttttttcttttatgtatatattataggttttaagagcagttttagagtcacagaaaaattgagcagaaggtacagagatttatcttaaatcccctgccactatgcatgtatagctttgtccattatctacatcctccaccagagtggtacattttttacaattaaagcacctacactgatacaccattatcacccaaagtctatagtttacataaggtttcactcttggtgttgtacattcagtgggttgaacaagtgaatagtgacaggtatctaccattgtagtattacatagagtactttcactgccctaaaaatcctctgtactctgcctattcatttctcactacccagaatccttggaaaccactaatatgtttactgtcctcatagttttgcctttctcaaaatgtcatgtagttggaattatagtacgctccctaatacatgtagtacgtatttagtgctaaaaagaaattgctatcaagtcatgaaaagacatacagaaaatttaaatgcatattgctaagtgaaagaagccaatccaaaaaggtaccttctatatggttctaactacagtcataccacataatgacattttggtcaatgatgggttacatataccacagtggtctcataatattataataccctcttttttactgtaccttttctatggttagatacacatattcttaccattgtgttacagttgccgatagtattcagtactgtcacatgaggaacaggtttgtagcctagcagcaataagctataccatatagcccagatatatagtaggttatatgatctaggtttctgtaagtacacttgtattagttcgttctcatgctgcaataaagaaatgcctgagactgggtaatttataaaggaaagaggtttaatcgatttatggttcctttggctggggagaccccaggaatcttacaattatggcagaaggggaagcaaacacgtccttcttcacgtcagcaggagagagaagtgccaagcaaagggagaaaagcaccttacaaaaccatcacatctcatgacaactcactcactatcacgagaacaacatagaagtaactgctcccatgattcaattacctcccaccaggtccccttcatgacacctggggattatgggaactaaaatacaagatgaaatttgggggggtgcacagccaaaccatagcaacactgtataattttgcacagtgacacaatcaccccacaatgcatttctcagaatgtattccatcattaagcaatgcttggctatatataactttcatttattttaatttccatcagttacttagatggccttgagtaaatgttgaccctttgacaattgagcatattaatgtatatatcaattgtgcctgattcaacttacgtggagttttttttttttttttttttttttttataaatatatcattaaaggttatgtgttttcttgatcttgccctgtaaatacttttttagattgtaaatgtctgggctaggatatgaacaatggcaaggcacaaaactttggaaacactaagactcatgaagtctttaacaagtgatttcactcttagtcttacaaaattttctaagctgacattataattgatggtatgtaaaaacaccataggacaaaaataatacagagcattgaatttgtagccttgtcacattagtggctagaaaactatccattgatattaaaatgtgttatttagtaccataagatttgtgacattaacttggaaattgtcaatatcattaggttaacaaaggctaccttgaattaaggcaaaaaatatggtggagttacaaaaatatgaactggccatttatgaaattgaggaaataataacaggttataaatgttctgctgggtaaaaataatataaatgaatgtcttaaatatagtggcaagtgaagggttaggcgtagaagttttttttttttttaatacctcaggaaaactttcacagaatatttgactttcagaagtaatttaacaaaaacaataataataaattacaaagcagaaaatatgtgagatgtatttgtcataatgattaggtttttgaaaacctctgaatagccaacttagtctttgaattatttgatgtctaatgagaaagaataggatcaggagatagaggtaaggagtaaaccgctgaatgcacttatataaatattttatgaaggtgaaaataaaacaattaaggcagcacacaatatacatcacattgttacaattttgtaggccttaaaattagtaaaaatatttactatatttaagaatttccatttaccaatcccttgcccattgtgtaaatttaacgtattcattcactgtcttaaaacaatactcttaaatgtgctctgctttgtgttagttacggctcttttagccaccagctcaacatttaatgagttctgactgaatcactcagagttgttgaccctttgtcccaggctttttccaaagccctttgtctgtgctcttgacacaagtctcacacgttgctttttcccaagcgtaacattgtatgtatgcctctgaggctagcaggtctattctctatgtctatgtgtgtgtgtggatgtgtctatctttccctttctctctttctgtctctctctctctctctctctctgtgtgtgtgtgtgtgtgtgtattttttccttcaagacttcatggggagagtgtgagagatgcagacctcttatttgttctctgtctttcatcatttttagaaatgagagtcaatagctcttgtttcaattatctccaactgtaaagactaggcatttaagcatatttgaaccatttctcatcgttactaaccaagtatttcatagtgaattcacatataccatatttgactttagaataaagaactccgggttggcaagatttcgtacaccacatgtgtactaataacaataaacctaatttattatttatactctgaaccccttaaaatggtagttttagaaaattttccgttgtactagatgcaatatgctatatttttcaaacattatagagtaatccttatagcaaggaaccagtggtttaaaaacgctttttaagagtttgtggctgatgccaaaacttaggggtcaatacctgaagtttcttcagtcgcttgagttccctaattctgcctttcttgcttttcctcttcctactgccttccctttcagtactttcacttgttaccagaggataaagcagatatggagcctcatggcaaatgcgtgactaccagatctatgactcatctgtggggacaatattcctaaaaaagagtctagaattgatgcacagagagcagagagtacctggcttcagctaaaatggtgacaacatgtattgtagaagggtctagttatgtgctgagcttttgcgctcacagctctagaaagctggaggatggtgagggctttttcagacttgggaaggaatgtatgtgcatgagtagcacctttgttttcatgtaatttggagtaaggtacacctgctggtcttaaattgttagaggttaagactccaggaacaggcaattcaccagtgatttaaattcaaagtgataagatggcccttccctgagtattttccacattttgaattgccatagtatcaatatgctaaaataattaaattggaggctattagatggaggtgtctttaacaacctaggttcctactttaggaaacagaaacctaactcttaatttaaaagaaaatgaaaattaagttcatgtaatcacagggacccaagtagacattagttatattgtcttgaactttctactgggataatccaaatagggcaactgatcaaactttaaccaagcaaatgattttttttgccttgcttcagtattcaccctataaaagccttcccctaggactcctttggtggagcaccaaacccaattcatgaattgctgtctgttcaaataaatttttaaattttaatgtgtcagtttatcttttaacagatgcatgcacattttatatcataacatctacctacatgcaacttttctgtttcatatttagggtgagaaatggctgagagtcaggcttctagagtctagtctcaccagaatattaattagctcaccacaattaattaattgtggtttaaggaaaggtactacagactcattcgtcatgacctttgagagaatttactgcttaaaaggtctttaattccatgcattcctggtccttagatatatctatatattataatcttcatgaggccatggcttctatatctgacatgtctagaagagttctgcttataatttaagcactcaagaaattaaattcattctaaggaaataaagtataaaggaatacacttctgccataaattaaggactatcttttattatttccttgttctcagtgatttactattagtgtgtggaatggggttaactctgaagctgtttactgtgagaccagccttctttagacttcaaattgaaagattatcataactggatattttgagctttgtgagctgtatgtctagacagataaagtacagagaatagtagtagaattgtaatgaatttgtgtaatttcctactaggcaataaagaacctacccccatcaaagaaagcattcctagaattaagacaattagttatagctcataatttatctagtatgatttaccactcacctaagaatgaccccactttattttacttaattggagacgatgtaaatgaagaatcattgtctggtaagatgtcaagtagaactggttaggggttttcatttatagagagaataaatgccacctgttttggtgggagttgtttttcatttttttttttttttaagcatgagttcctgaacttcgtcagttgaaaccataactcccacagttacagttaagtgtgtgagaatattattaaaggtacattttcagtagaggaagtctccagaatgtgttactactaatcttcttgtgaagattgtggtattaatcttcttgtgccattagtggtattcacacgataaaatgttaatgtttttcttctaatttaagtgcatttctgaacatacctcaaagccaagccatgctgggttgaaataaggaatgtgattggatttgattttaatagaacataacattgatggaactgagattgacctcattatgattctcgattccataagagatctttgctttaggcattaaagagcatatggtaataagtttttttatgctttgctgttaaagatttagtgggaagattatctggaatactttttatcaaatatcttatttaaataagaggaattctttaaagcattagcattaaaaattcacagagcctacaaaattaaagatagaaaaatctattaggttatcttccgtctcccagaaaaggattacttcagaggaaagaagctatgaaaatgaaaataaaaactgaaacaattatatcaatattacagatgagtgaagaaaggatgtattggattgtttagagaaatcaaacgaaataattttttaacctttaagaaatcttttacctatttttatatattaagtttatatgtctaaagcctttacagttaaatcatgttatttttgttgtttctaaacctaagtaattttgaaacctttttattacaaataagcagctaatattcaaatctgaatattcgcaaaacaaattatgtgcttgcagtactttaacatgttttgccttttggttttgaattctcaatacaaaattctgtttaatcacatttatgtgatattttcattttgttatataatatgcacacagattaaaataattttaaagatgtgtgtgttagaaagcaattatcagtgtatttacagattttttctgatatttttcttttcaagaatcaatgagctacttttgaatgtgaaatagacggactaggaaacaaactttacatttgtcagcatatgatatcactgatactttcaatttgaatgatctttttttgatgattcagtaccttttagaaaaatgttcagtgttttagatacctaaccctgaccctgttcttctccagcaagacatatgtggctttgtttcttgtggcgggaggagatcttatctagccacagtgtggctgggatggtctgctcctggggatgaggtatgactggtccaatctggatacttgagtggaatgctgccacccgcagtcagaatctatagccccaacaaagtgtcaccagtattgacgttttatgttctctagctgttatacaccccttcttcaatttcaagattgatcctacagattgaggtagaattgatgctaagggtcgagtagttttaaccctggagagagaaaagatgagggggatgggtaaaatagatggctctgaaagttattttaaaaatgatattaattttcatacctgaaaggtattaacttattatgtgccagtaaatgtgcaggtcctaataaattataaccaaccaagcaagaaagccctatagaatttgtcctatttgttgccccaaagttgtcctcactccctactgtctgccagttacactggcctcctttctgtttttcatcttcatagaccccttctgaaacaggcccattgcactttcttgtctctctctctagaaggcttttgctcggaagttttttttaatccttcattgtctcaacacaaatatttcctcctcagtggtctatgtctttcattttagttctgttgtattttgctgctgtatccctagtgcctagaatactgcctgctatatataataatatatatatattgatcaaatgaaagataaagtgatatcatttagtcttcataataacatgaggtatattttgttattaacagttcataatgggaaaacggagtcttatggagggagatttagtgacttttctaaatttaacctactagggtgaggcagatatagaattcaaattctggtctatatatggaagttcatctttaaacactgaactatactgtctatactgctttggtagtgtgaattttgtcatctgtttcaagtagcttggttcacatgccaataaactcatattattgtttgttttcactatgtgctgcacagcataaacatattatgcttataatttgaagtagatccctttccctacattttatgtgagagcagaaccacatttgcacattcttcttaaagcctcctaaaagggattgttgaattgtgtcttttaaaagtaatgctgaaatcaatgtcatatccacacttaaacaaggaaataattctcataaataatacaaagaaatggaaacatttttgagtagtaaaaactttcttctgctctcaaaaatgtaaaatttcttacgatatttggatttcatgctcaactccaaatgggaattgccatcatgatgttataatccatttcactcaatgaaaagtttaggtagaagaatataagattactaaggaataactggagactttactgataagttattataagttaatttgtttttggacagagttccaggttttctttgtgaccatagttgtacacacttcttgttttctagaccactggcacatctgcacaacaggtgatatgtaatttcatcaaataggttttatcactttccttataatgagatatattttttgtgcctctccttgatatacttactctgaagcatttctggctgaatacctcttttgttattttatggatgagaggagaaaaaatacaagattttttccatcaatttttccaacttatacgtgttttgcttcaacaatttatgcagtgagaggtggaaaacctgagcagttgctagggtgtgcgctttctgtagatcgatccacacaggacagaatagagtgcattctgaagaggtaggaattagaaagtgatgccaaatcagcaaaacaaaacgaagcaaaaagcctgaagcaaattaatcatgacaaaacctgcacaaaatctggagagcaagttgctgtaccttgaaccttcaataaacaaattcactttgaattttagtaggataaaagatttaaatgcaaactgattcaagatgtaaaacaaagtcactcaaataggcaagacagactagcctacataaggagatgttgagtttgagaaaaattaatagtaacatttgaatactttaagtattttacagtttagagacaatttactaaaacattattattgtaagatcagaatagtaacatatttttctttagaatacaactttttctgcctttatttaaataaatatgattctactaaaatggaatattcatgtttggtaagatcataatattttagacttaattcttaacccaggaactttaacaattttctatgcaaaactcttatggcaatgaacaagataaattctattgtaaaacaactaattcttgttttttacaatcatgtatttcagcttgttagaatattttctattatcagaaccggctttgttagtatcatgcactggtaaccatctatattgatcacatggtaaacaacattagaagtggttatctgtttgtctttacatatcttggtggaaataccaactgctaaattatgaatggcatactctagaatttaaaagcatgtcgttttgatatcttctcaaagctagtaacaggttattgtaattggaaagtctcttttgaatgagacatagatgcagaacaacactagctcattataattacatgcaaagggaaaaaggtaacatgaggtagtctttgctgagattcatattttatgtagttgggcggataggtcttaatgatatatgcaaactctaagaaagtatctttggtatttttaaagacttaggcagaaaactggatttgggaagcattgttggaggtttcattgcttctttcattaagtggctgggacaatgaagagagaaagtttgggaaataaatgtttggctacagagatggcattcattaatgacatgaagaatttttagccttgctgaagacacaagtggtctctaggtacagaaaaaacaaaacaaaaaggcaagaagacagacttttgtcactcacaataactctgtaatagttatatatatatataactattgtgtgtgtatatatatatataactattgtgtatatatatatatatacatacacacacacaatggggctgcatcagaaggtaaaatttcttagtttgggggaatattgatatcagtgaacaacttcttggtgagagaactgtaaagagagttcaaagtgtaagtgataataccagatgatttttaaatttccttataacttgagattttacaattttatttatttttctatacttcaaaaaatttgtacaaggttataaaatgtcctaggttataagatataaatataaatttttctcatttaaaaagaaattgtctctattctaatccaatacacagactgtaaaatgtatagaaatttaaaaatatatatatttaatatactgcatcttctccaggttgagattttttaaaacgactatttcatgtgaccccacattagagaattgtgatactgcaggttagctctattagtcaacacttatgggaaaaaaagtagaaagaaaaatctagaacaataagttggggatggagaggggactggatctccatgaagagaggaaagaccaataatgagggtatatttttagatcctgaaaaggcaactatgtgtgtcttagaccaatgtctggatttcatgatgccaaacaaattcttttatgacaattgtaatagtacttcaggttcaatccataattcatcaaacagtttaagccaatctattctgtatttaaccatgtgagactatatactgaaaatctgtagaaaatggaaattatatattataaagttttctgagatatattctataaaagtgaaggatttttgttacatgttatggcgctgggttatgaggttcctaaaatataagtaataggagtcatctgaatcactgtattctaatttaattataaacagttaaataaaaccccaagtaaaatctaaacatccataatttatattttaattttcatttttgaatcatttcagtgaaaaacaagttattacatgggacatattgcagtttgaaacctcacttcatgacgactgaaacaaaaacctctgacctaatatgagatggcatattttttattgcaatcaggatgtaataactaccagcatgaatacttagaactgttctcctccttctgttttcagcattgggtttatctacatttttaatgaattggatagcttattaggtcgtatgacatctgaggtcctttccagcctgagattctaatattctattttatgtgtcttttcttgagaatcattgtttttttctctagtaagatttactgtttcctgtgctaataattcaataatttagaaaatagttgtcaaaagattgagaaattatgtgaaatccttaaaattgggccagttactttgccaagcatagccaataatcttggaagtgcacattatcagttagttttgattacagctgaagatgttgggagaataaatgggactggaacaacatattcatcactactccaagggatcctattataaatatatctcctgaaacccaagtgactgttgcaaagaggggaaactctcttattcaatataagcagcaccagtagttagctggtaaatggacacattggtaacagtatagaatccaaaagtcattaatacatataaccttaagcatttattttaactgagtatatataaatatactttagataacctatcttttgattaatagtcaggactttttctttgataattggttttctcttggacatttttttgttgtatttttagtataaatgacatccattatgtgtttctcccatctctagtttcatgttcttggaaaataagtgagaatataaacatacttgcaaagttatctgtgaaaaatccttctaggtttttatgcttttttttaatacctaattcaacaaggctttttcaactttccaccatgagtctgattctcaaaactttcaactactcgtttttaatttaacactcaagtcttactgatttttataatatttaatcaaatttatatcattataattaaatgtacaaaggacagttgagtttgagagcaaacacaactgactaggcatacaacccaattgagtgaagaagctcatggtgaaaatgtagtcactagtgtgagtgttcaacatgctgtggacattagtcatatttaacaaaggaaatgctaagtaaagattagttcagtgtatcagataaatgtaggttagttaagagagccttcagtgttttaatttctttgattataaactccttgaatgaagtgactgtttcttatgcatcttcatatttcctgtttacctagcatagtacctagacataacatacataagcatttgttttttcatttgagttatagcattgacaacatgtaattgtcctaatgagatgctgtttcctctgaggatatgagtggtggtagtattttactattattttctctatgctcagcatgtaaataaagcaatgttaacatcctgtttgtatttcattttgattgccatttggtagcttgagttggagaaaaatttatgcacagcgtttaagaggaccaatttatactgaaagctttggaattatcttagagccaccgtgaagcccctacaaattgcaatttcagtcatagaaatgctagaaatcaaatgaatagagtaacatttggtatgtaataccaaaacatgtttgtattactctcttgaacacaagcagcaaaaagagttaaccattagtggactataagatttttactatatgtgtgctttctgtaaacttgtcattgcgttttatgaatgtggtacatgttcatagtttttaaagtcaaagagtaatacaagacttattatcatttttgaaaagctatcttcttacccaccactcccattcctctctccctatttcctagactgaacctaatttcaactctttcatagttgtttcttctcatatgtagtttcatagtttgtgccagtaatgaccacaaggcagttttctgatatttcagtttcaattatggtctaccatcttcctacaagaaatgatgagtgcttttccttacttcatgtcttcctccacaccttgttatatacgtttttcctctatcccatccttccaaatcttgtggcacatatttttattaaattcacattcaatagtttgtaactatataatcaccgatcaaagataaaccattcagtgtaccatgattaaatttcttttctgacttttctgtggagccaacaatttttttcatttgtttattttcctatgtaaacatcactaactcagtgcaaactttctgaacttatagattcatctcaacagggtcaaattcgtgaaggaatctagcagtcctattttctctttaaagacagctccttagggcctatcagacactactccagtgaagttggtttccctcacgtctgaatcacagttgttacttaagatttctcttggccgggcgcggtagctcacgcctataatcccagtgctttgggaggctgaggtgggcagatcacgaggtcaggagatcaagaccatcttggctaacatggtgaaaccctgtctctactaaaaatacaaaaaattagccaggcgtggtggtgggcacttgtagtcccagctacttgggaggctgaggcaggagaatggcgtgaacccgggaggtggagcttgcagcgagccaagatcgcgccactgcactccagcctgggcgacagagcgagactccgtctcaaaaaaaaaaaaaaaaaaaaaaaagatttctcttcatcatcacagtgggaattgcctctgcctctttcatattgttttatgaatctcatgtctgttacttgagaaagagtgattgaagggcaaattccttgaaatcttgactatctcaaaaactcttttttataccctcacatgtgattgatcatatagcttgttatagaattctaggttgaaaaaaaataaccccctgaaattttgaaagctataatactccattctattcttgtcttccttccagtttgagaagtctgataacatttggattctcagtctattgtatctggttattttctaagggttttacaattttttatttctacctggtgttctgaaatttcataatgttgtgtcttggtgtgggccttttttcatttatttgtgctatgtgtttggatgactcttttaatccagaagtgtatgcccttcagtactggaaaattgtagtctgatttcttgggtcatttctgaccctgctttctctcttttatctttctgaaaacttcactgatcaatgttgattctcctagattgattctctactatatgtgtatttttagtctcttattctccatccatttgtttaatttttttactctgagagatttattcaacctttatattggattatttttaaacaatcattttaaatgtctaaatgttctttcctgttttctaaaagattttgtattttctgatgaaattacataggtataatatctacagtatcttcttttatctctgaaagtacacatacacaaataccacctccccccaccacaaacacacttatttaggttttctatttttatcatttttttttcactgtttattttagtctttctctcatagtagaggcatttctcaaatgtaatccttgactgtccacttacatttgaaaatgaagtacacaaaaggctgatgggaagttgtgtgtgtgtgtgtgtgtgtgtgtgtgtgtgtgtgagagagagagagagagagagaagagagtcatctttgggtaaatgaacagggactagctatttttttttttcagggagtacatgcaaatgtcagtcagaatctgtaggttttttttcttgggccacttattttccccagaaaagaattctccattctcattcaatatggagagtatatttaacccctgtttttagtgtagtacttcatcctcacctttagctagggtccttaaacctttccagaaagcaaactttatgtagggagagtagttcagctgactgagtgagccaggggttctgatagtctgtattctcttatatggactttaaaacaaaaatactcctgctctgtcccacccttcatcctagacttcaggggtccctgaaaaataatttctaagcctggcagggatatggcatatgaatctggcttccatcctcctggtaaacccactttacttacctaagcagtgaagtttcttggttttgctaactcagtaactccacttccatctgctatcctctttcaaaagtttatcccttatcttctgatatttcatttccttttctctgtacactgctgtgtttgtactggatttccatattttcattttagtaagattttgggaaggaatggaataaagattaggaaattttcttctctcactagtaagagaaaactgctcaatatttttttaaatgcaaaatgtgctgtatagtcaactactattgttttatcagttctgacctttggttaacagtattttaactttggatgttactttctcaaacttcttaaaccattacaataatttatcatttacttttataacctgaaaaataatgtctgagctctcataaaatgaaaatagttaatttgcatgctattgcttttgaatgttgtacttcagattatgttcttaaatttgtcttatctattctataatgtgatgttttaatgcacatctgattccctatcatcttaacaagtatttgcatttactgctttgttttctttatttgatttaccctataaaatagtccctttagcacagattagaagtagtttattacttattgtctgagtcaatgagatttcatacatgtaaatattatattctagttatattgtctaaatactctgcatcacatacttgaatcattctaataacaataatgtcaattgaaatatattactttcttttgcagataaaaagtattaagggtatcttctttttaaataatgtatgaattataaatctatgcttataactttatgatgccttcaagtaggcaacattgtcagtggaagaactatagtgtacatttgtttttatgctgctaataaaattaaactgtgttaggttaagaatacatttttaaaatgatagttaaagttaaataggaagccactaagttgtgtttgtgttcaagtttaaacagaaagcaatatttacccagcattctttgaaacaaccattttggatgaaatttttattcaacctggcaaataaatgatgacattcatgttcttaagtagaataaaatgctggaaaaatgaacagctccaccttatgaccagttttgctatagtttttaaccagtcagattttggcttaagccaagcttaattgatgatttaattattgcttggtttaagcagaaagtttagtgtatattgtagaagatgtgtaaacaaagaattttcattacttttcctcaattgagctagctcaacacagaaattacttggggaatcttgaccttagtggcaaacagtaaacaactaaaggcagtgtggtaggctaaataatgcctccctaaatccatattcaaattccctgactgtgtgaagatgttaccttacatgacaaaggggactttgcagatgtcattaaaaaatctggagatgggaagattatcctggactatccaggtgggcccagtgagatgattatagatgtccttaaaagggttggcagagggagattagactacagaagaggagaaagtggtgtgatgttggaagcaaacagatttggagatgctgtgctgctggctttaaagctgaaggcagagtctatgagccaaggagtgcaaggaatgcaattctagaggctggaaaaggaaaggaaaaggattcttctctagagttccagagggagagtggcccttctaacagtttgtgtttagctcagtgaaactaatttcagatgtctgccttccagaaatgtaagggaataaatttgtttaagtgtaacttgttagagcagcaatagaatagtaatacagtcaatagaaaactattacagtatgagaaaactatccccaaatcacacaaaaaagtgcaagaccaaaaaatagaaaaacgaagccacaaagccatatttcccttcagccatagcctaaattcatgctcaaagaagattcttacagaatatttgcaaatatcctagttaccaccatttttgcagaaaggtttttgagggggttttccattaggtggaatatttagtgaagtggtttgtaagtaaaagttatcaaaggtaaccaagcttgaaaacttttgttataatccctcctggaatttttctttttataccttgttctctaggagaaataaagtgaattctataaacattgttattataaagcaagtttaggctaatttgtttcctgacttttgtagagatagctatggcacttacttttatcctacacctaatcatggagtaaaatgaaaagcaaatgtattacttttgtgaagtttattgggggagaggttgaattgaaaaatactttatgaagctaagacttcaaaaatttgctatttataaattgcatgtagtatgtgtatatcaaagtaaggacagtagttattagttcttttgaaatattacataaatttctgtatgaattatctctttgtatataacaaagcacctcaacccttactggcataaaatagcaactgtttatttgctcatgattctgcagtctgggctggggctcagccagcagattcttttgctggtcttgctgttgatcctgcctgagttcattcacataactgtagacatttgacagctcagctggggctgggtaataccaaatgacctcactgacaggcctggcagttgatgctggctgttggctgtggtgcccgagttctcccctgcattccctctcatttttcagtaggctggagtatgttttttcaattgataatgggagcattccacaaggacaaaacaaaagctgcatgtctcttaaggcttaccttgagaagtcacacaatggcaattctatagcattctctccatgaaagcaaattataaggccagtccattttcaatggacagagaaatacagtctacttctcaatgggcagcgtggtaaagtcacattgcaaaggacgtggatatgaggtgctgtggttcattaggagatcctattggattcacccaccccacatctctaatgcacgttatcccatgtttttttttgttttgtttttgtttttgtttttttgtttgttttttttttttttttgagatggagtctcggtctgttgcccaggctggggtgcggtggcatgatcttggctcactgcaacctccacctccctggctgaagcgattctcctgcctcagactcctgagtagctaggatcacaggcataccccaccacacccaactaatttttgtatttctagtagagatggggtttcacaatgttggccaggctagtctggaactcctgacctcaggtgatccacccgcctcggcctctggaagtgctgggattacaggcctgagccaccatgtccagcccattatcccctggttttatctttatccagacaacatgggtgtctctatttttaatttttaattttatggtgtttcgttttgttctgttttttgagatgaggtctcactctgtcacccaggttggagtgcagtggcacgatcttggctcactgcaacctccgcctctcgggctcaagtgatcctcccaccttagcctctgggagtagctgggaccacaggtgtgcacaaccatgcctggctatttatttatttgtttattggtagagatgaggtttcaccatgttgcccaggctgttctcaaactcctgtgctcaagcagtccacccacctcagcctccaaagtgctggggttacaggactgagccaccacgccccggcttatcggcttttgttttattttgttttaatcggtgatgagtaacggtggggaatagtatgccagtatgcatgggaggaaggattgtagaaatctggctggggaaatcacattacttaactatttgagggcgtgtgtagtggacatttatttcttcttgttactgtttttttcaccactttctttcaaatatgctgttttgaatatgcaaaatataaagtactgttctgtttgaatgtagaaagtactgtgagattgttcaaattatttgatagaaatatattgaaaactgtcatgatttgatctctgattccatgtttgtgaagggaaagtggttagctctacagttgggtgaaattggatgatacaactactaagacatttccttacggcagtgattctcaacctggctgcaccttagatcacttggagagcttataaaagtgtcgatgcttaagtcctatcccagcacaattacatcacagtttataagtgtctgtattttaaaaaaaaactttacggaagagtctaatacatagccaggatttaggaccactcagtgctttaacggttagagatttggaggaatggtttgaaataataaggtttgtgcatatgatatagtaaggttgggtttgtacaggggcctccagccagagctgatatactgacaatgcctcaatgtggaaaaactgtttaccttcttgtttgattggataggagaaaaatgtcctaattttctgatggggctcctaatttttaaacatacttgtagagagcaaaatagcaccagtggcaacacattattttgaaccaagtaactaatactccaatggagggatagctagatataaaataatgctataagaattgtcatgtatcaaatgcatttttatattatctatttaaaagaaaaatatttataactagagctttgtaattttcactttctttcaccagtggggttatttttaactcacttatagctggagttgaaaggatattttttagaagtcagtgagacttttcaaaggaacaagaggctatggtatcctctaatactcattcttaaatatattattctcaggaaatggaaaaacacatctgattgtatgcaaaccatttgtccagttgcactgttttatataggagacaaaactgttaatgactggagttgggggatttaccaggctctagagtaatctgggatggatagaaatgtagcttctatattgatgctactgcaatgtggcttgttatagaaaagctcctttctcactgatattttccaaagtgaacaagtgtttgaatcagagcttctcacaaaagacagaaataatggaactcttcatttgttgacccgcaaaagtggctaattaaaaacagtgtcttgatttctccacactgtcatcccaaatcaagacctgactgtgagtggggagagtaatctgattctgtacctgaagtgaaatattaatgtcccagactgggtgaagccatctagtagataatatttctttcttttttaaaaaagtaattactggtagagtaaagaatatactcaggcatacaaaaatttaagatgacatgaaatctttggagttacagttataagagttgatttattctagagaatccagaaaaatggttcaataaaaccatctctgcgtggtgagactgtgcatttcaacccaagcctttaagagggaagaatcggtattgagattaaaaaaaaaaaaaatccatctaaggaaaacgctctacgtaaaggctcaggatttaaaaaataaaattaaataaaattacccttgctttgatcctgaggctaaatctaaagtaatctgcaacaacaggccttttttgtttaaggattcctgtcctttgaggtgaggtatgtgctgtgtttaataaagattatgtgactgattacttttcacgtactgacagctccctgtggtgtcttttatgtggatgggggagattatattaaagctctgtctttctgcgtagtggccacctgctcttaaaaaaggttgtagcaaacttccttggaaataatgttaggagtccaaagcatgatacagaaactgatgggactgatctgcatctagactgagcagtacagtgaatagcaatgaagacaggaggattgagccccaggcaagccactatatctgctcagttgttatatttatcaaggattacactaaaacctaattctgattatgagcaaagtgctgtatcctgaagtaaagatggtgagtaaacaagaacaagggataaccttctttttctgtgatgtgtatgcatttgatgagctttatgaatgtatttccctaattgatttcaaggaagaattttctagggttaatgtatgaaaagcaatttttacatgaagccttagtgtaaagtaaagtcaatgattagtagagatcctcaaagcaattgtactacatagaaatcaatataaatactgtattaaagcatttatttcacttgtgaatctgcatgtgtgtggctggaaataactgcagtattacaataagctaggctgaagtttgcatttaaaatagcaaaaaggcaaatgtcttctatgtcactgtcaactatagttataaattgagatctgataaaacatcaaaaaactttgtaagctttaaaatatttctgtagggtaatatgacatcccatggtctgtgtaaaagttagcatgctctttctcttgatattttccccttaactttctccttcaattggagtacttggttttcagtcctccagtcattactctgtctctgcatgctgtccttgtgctgtcctgactatattttttggttttaaaatctaggatcttcaagtctatttacttcaaatttaccatggttaaaattgagctaatttcctaccttctttaaatctctttatgatttctccttacctctgagtaaatggtgtcataaccaccacgttcagggggctggaaacccatgagtcctcgtgcattcttcctcaacatccaatcctcaaattctattggtgttcattgttttttgttgttgttgttttttgtttgtttgtttgtttttatcttcactgccacaagtctgattttatactctcatttttcacatgaaaatggcaacagctttctaactagcctctgctgtctcaccacttaccgagaaaacatccaaattccctggcactcacgcatggcctttgacaacatggtccctgcaagtccgatctttcctcagttttctggatctctcaccaggtccccccttttacctgttctctggtgataatgaacttccaggagttcctggatcttccatacttcttacttgctcacccttctttctctttctctctttctctttggaatgccctgttttaattgcccacttggaaagttccttttcatctgttgtatcactagttccactcctctaccccacactatgcattaatgaaggtcccttggaaggtccctattatgtggcccatgccctttgagcaaatgctaccttgatgtaaaactttccacaaagaagttaatgttggtaaagtgccactcggaaattaaagcacagtgctttgaagagttaaatccaatgaccttgtaaagaactggaaattgttaacaatggtgctgtctgtcaaggctggcatactagagaggctccgtgtggacaccaagatctgagctcgtgaggtaggtgggagggggaggcatggtgattatggtaaataggggggcccagacaagatgagtctttctgtctcaggaaggaaaaaaagatcactgaagagtaaagctagggtacagaatggcaacaccaagtttaagtgttgatgcaagggttgatggcaatgagatgaagctgagcagggaaccaggtagaaatggaactgaacaggtgcagggaggcaatggagcaaagaggtttctgggccactctcaggatcagtcatgaaatgtccttagcttctcatttttgttggaggatatgtggaggcatagagcttggtcacattgagctgacgcaagtcactgattcctgcaacctctagtgatgcatttccaaactcaggttaaaatgaaggtcaagaactcctgttttgccatttctaaattattgggattaggctatgagcttatttcgaggtatttttcagttctgctatgctatgactctgattttgtttttatttggtaatcttatatggacaataattgcattttgcaaatttaaaagtatcatgccaacatggtttgtctgttacttagctttcatttttcttttaatgttggaaaattgtgatacaaatttatagatcctaaattaacaaattactcaagactttagaatttcttaaaatgttatggtatgctttttttttgaaagctctacattttataaaaccaaatttgtcatacgaagttttaggtatcaagaaagaattctgtggatttttgtgttgtcagggtatcttagattgtaattttatgtattttccttttggtacctcataaaaactagaagggctttcttgaactgcatactttgtcaatacaatttgatgatggagaaagacatttaagtccagaacgattggtgtaaagtacactgggtgagactgtatagttgaattttccagatgatcgaaaattgacagtaaagaaatatatacaaaatagattttgaaagaattgttgaatgtttacctgtcgctacatattatcttggatacagtacagataatccgaatggaaaattgcactgaaaatgtcttcccctgagttatatttgctggttcttacataaaatgttatttatacaacagattttattgtatcttctcttgctttactcctttatcaccttctagctaactgtcctgacttcagacctctgttagatctgccagatgtgctctcctggcccatgaaatcaagcgtgggtgagacctggtgcagaacgggaaggcgacccatacttggtttcagaggctgtgagaataactgcaatttagagggaataccatttatgtttatgcaggacttccagagaaaaaacaaaatttattatagacataaagaataagagatgaaattcatgattatattgcatttctgttccaatgggattaaaaaaaaaaaaacacgtattctaagtaagttgaaccaggttgacagctaatgatttgatgtctctgttaatgattttaaaacattgtacaaatccaaaactgtttactccttcaaggtatacctccttttctcccacttctccagctattgtggtccatttgcccttgctctgggctagttccttggtaactaacagaaatggatggacagagatgccatgacaggagtatggattttgctgggtcctcatttatgctggggcatctatcaactctttttccaacatatttttgtttcccacacagccccactcacagatgcttgcctatagggccaaaaatctctagttagcaatctgccagagtcctgcttttttgtgtaggagattggagttctttcaaataacccatctggtaagatgtagagaagtagagaaactgaggtaaataaaatgtatattgttaagtactttattgcatactttgtacctttgctgataattaatttatagactatatctgttgagctggtgttggttaaggttgtatttgcttgtttgtttgttctatactctttaaaaacttttgtgggtgggtagggagggtataatggtgttgatgtatgttgtcatcccttaggccagaggaaccatttcacaattactttttattttctcaacaagaattctgaaggcctgtatctttggcacagaaaattaagctataaaggcaagttctgccaagtatatattacatatctcctggccatggattttggtaggctgtgagaaaaatatgaaagtcatttccaaagatttattttgtatttccttaattgactttcatatttgtaatacattttctatttataaatggtatttctttgttccacttaaggtaccttaatttataaacacacaaaattaatcaaggacatttccccattttgttaggttctgagaagaataaaccaaattcttcgccaaggcttttccttttttggaaaatgcattggataaacatggttttctttgaattatctcaatgaaagagcttctccctggacattctaaagaagtgctgtctggtagatttttctgtgttgacagaaatgacctacaatctgcactaatttgacagacattagccacaaggcacttgaaaaatggccaatgaactaaatttttaaatttatatagcagcgtgtgatcagtggctactatattgtagagcatagttctagagtactttagttatttagataattttttatagattacaagtttaccaaattcatctttatcaattctcttatgaatttgctaggttttggttagtagcttaagtttatgtattttagagcagttttaatacatcaccatgtgttttgacttagtacttttaggctgctactaaaccaaacacaataccataaattggatagcttatataatttttttctcacaactctggaggctgggatttctaagaacaaggcaccagcagattcattgttcaatgagggcctgtttcatggttcctagataatatcttctcactttgtccttacgtgatagagagggcaagcaactccttcaggcctcttttatagtggcactaattccattcttgaggtgtctgtgcccgtgacttaatcacctcccaaaggcctcccctcctaatgccatcaacttggaggttaggatttcaatatacaaattttgggggcaacacaaacattcaaaccatagcattcttatacaataaactactcacaaaatagagagttaactaaaacaattctccaagttttaaacaatttatatggttgccactttattttctatgaaaacaaattaaatttctgctgaaagctaaaagctggccaattaccaagtgatcccacagttattgagtgttactacttggacagcattaaataaaccattctttaagttacagaaaagatttgaggtgattcctctcttcagccatcctacagtcttgatagaaaggcaaaactggcagttatgaaataattaaaaataaatcagtgctaaactctattatgtaaaataggagtatagatgagggagagatcagtgtggatcatagtagccaatctctgcactttaaagttaaaaggacccttagaaatcattcatttggagttttagaaatcatgaaattgtattttatcaggtttacacactcaagatttcacagccagctaatgacatgtccagtgcttgaataaaggtctcttaaccctcaatttcgtgatcactttttactagttagccttatacctcctcctggaggagtttgtccttaacaattcattaaaagatagcttggggtcagcaattatagaccgagttctattgcaaatatcagtttcatctagcagagtgttccccaaattttcgttgtttactcaacacattcataatgtttttttcatatccttctaccatttgtactattatttatcctttttttatttgaaattcattaaaaggaaaatgaaaggccagaattatttgtcataagtaaaagataactaggaagtaaacacctgaaaaataaaagctaagctataaattcccagccaggcactttgtctgcctaagccagaggcctgttctctttcttataaaggagattagtgagtaatggaaaaacattagatgccatagtcctacattactataaagagcaatcctttccttcacctccagtttcaaaattgtgagatttacaaggtccaactgtggaagctaatatctcctattgacctccctgtggctgttttgtgactgccttaggaagaaattagccatggacctgcagttctgcatgagctcatgtgcatgtctgcatgaatttgtgtgtctgtattggttggtggcgggggttagggaatggtggttactttttaaattatgcaataatggcgtatatttcctgattttctttcttcattaaaacaaagctcttttgaactggttgcttttgtcctttacaagggaaagtaattgtatagttaatcctatttgtttctaatgtaattaaatggaatttagatagattatctctccatatacaaacatgcaattcttatcatttataaagcaaaaaaataaaaacccttttattgtttttggtggagcagtcggggcacattagtaactctggcttatgtaagaatgacatgcatttttctcttaaagatgaagaatgctgtcaaaatatacttttaaaaattaagaaaagtaaatgattcctacaaatatcaagtgaggatatttcacagcttatttaacccattgatgagaaccctcagtatggtgactcagttttaaagagactttgaaaagcagatatttgtatagttagtttggaaaagtgtgatgaaatatgtttgctgagttagagaaaatgctcattaatgtcccacaggataataaaatcataacctttgaacatatattttcaaccagagaggaaatggtttgtatcactaccagacaaaaatatacaagttaaaagtacccagaacaactctgggtacttaccaatagtaaatggtaagtaaaacaatgatgtattttctggttcttgggaacccaggtaatttttccccttagggttttttggcaaagtctggtgacatttttggtcttggcacctggagggtgcgaccatcatccagcatacagtctaaggatgctgctaaacatcctataatataaaaatatcagttatttctgcctcctctcatacccccagaaaaaattatcccggccaaaatatcagtggttctcaagttgagagacactaccctagagacttaaatcacctttgtacaggcctgatagtgctccagtgtgacactgaaagggcttgctgccattcttttgtctgttctggataatttttcttactaatgccataagattttccatgcagtacgatgtttttgtattgtctgaatgtacccagaggaagcagacatagtgagctaggctagggctctgcttggttataacatttcttgttcctgtctcattctattgttgttttcttacatttgaatggaaaaaaaatctaaaaataaatggtgaagaaatgttaaaacatgcattatctgtcactgtgaccattttaatgaatgtcattccattttctacaggataacattattttcagttggctgtgtcctttcctgattgacactgtgattcttgaaaaataaaaattgatgcacaataatgtagtataggaaagaagtacatattagaaaagcatagactctccctgctcctgactaatttctttcagttagaaagttaaggaaaactgacatattctctctaagaaaatatggaattggaaacatcacacctcattcttttcaacccttcaataggttgaattgaaagtcagcaattaagagcagtcttttcttatacctccaatttagtgaaaaggtaaaaacagaaggaaaattcatatataacatactacgatattccaggaacaaccactataatttttgtgtatttgttcagacttttactaggaacagcctcattttcttttctatttaactgaatgttttttaatgtaacatatgcttcttggaataggcacaagcatactgagatgagggtgaagacttgcttctgtacccaagaaattcctatgtcagtacccagagttctaattgtagagaatatgcaatagtatatattaatttttcacttaatatcatactatcagaatttttttcatgttgccacattgttctcctaatcatttaatgctgggatttatatagatttaaaaacagctcaagtttcctgtaagaaatatgatgcaatttatagttgcatttctcatataagtaagcagtaggatcacactcatatacaggagtaaaattatcctccaaataatctgcacagggcctggtacttgctaggtgcttaaaaaatgttgattttcttttattcaagttctagcatttttatactggaaggaatcatgacattggcacattccttttttctctttttatcttttttaatagtaaaggaactgagaccttgttaattattattattattattattttttgagacggaatctcgttctgtcgcccaggctggagtgcagagaccttgttaatttaactggggcaatgtagaactctgtacttgaacttaaaatattaggttcaagtgctatctctgcctcttattgactgtatgataatagatgagccactttacttcttgaggcatttcagtatatattggagagagagttgcactaggtaaaatacgttgtttaagatttaaggaattttgttttttgcttcaagagctcatgctgataaaattgatataaatataatggtaatgtgaattagcacaaccactagggggaagaatatggagttcccccaaaaaactaaaaatagaactaccgtatgatccaacaatcccagttctcggtatatatatatatataaaaaagtatatcaaagagttatcttcttcccatatatattgcagcaccattcacaatagccaagacatggaattaacctaaatgtccatcaatggattgatggataaaggaaatatggtacatttacacaaaggagtattatttagccataaagatgaagtccttttatttatacagaacaggaagacagtatgtttagtgaaataaatcaggcacagaaagataaatattgtatattctcactcatgtgggagctaaaaaattttgaactcatggagatagtagagtggtggttacaagaggctaggaagggtagtagggaggaaaggtaaagtggggatagttaatgggtacaggtatacaattatgtagaatgaataaggtctagtattttgtagcacaatagggccactatagttaagcatatttattatatatttaaaaataactgaaagagtagaattggaatgttcctaacacacatacataataaatggttgtgatgaatactccaatttacttgattattgcacattatatgcctgtatcaaaacactacatgtatgccaaaaacatatacaactactatgtacccataatcattaattttttttaatttaaaaatctatgatctctttaaggacaaaagtcttccaaggcaaatattaatctactaaataagctcactgtatagagagcccagagtactgtaaaataatatgcattcatttggaaacaaaaactaatattataagagcacactatgtattaaggatgccttcaaacattttatgtgggtttttactttaatctttagttacactttcaggtagatgatatgcttctccgtttatttaaggaaacttcaaccgagtgaagttgccacatttttctaaataactcatctagtatatatttcattatgccaaagtctagaaaactgatgtgttcattcaaaaacattacttcaacctgtcagtagcagtcttttttttacctctttacagttttagaaaggccttttgggcatggttttgtgatccatgactatttaaaaatctcgtcagggaagtaggaaataattttcttcttatctcatatgaattgctcttgtagcaaagagactgtcaaaaatattctctccatcattcttcaggaaaatgttaagcattgagggcaagcaagcctcttaaactagagacccagaggtacagtagaaggtattccagagttgagatgagagttctatgctcctgtctttgcacatatactgacttgtgtgattcagctaatttccaggaagctcaactataaaagtgagggaggtgcaccagatgatctccaagatcttgtactctgtttgtactctactctctccttgtgtatcttccccacccactctgctgttctgtgcggggaagggagatctgtagctctgttgtattaaagtaaaaactttagaaaaatatagcagagtttaactgagcaaggtacagttcagtgtgggcaggcagcatttgtggataaaaaatggaggtgaagtacagaaacagcttgcttggttttgatttgcatttgtctcgcctcaccgtggtctgatcagttggccatctgtgattgactgaagcttggctactgggactgactgagatccagctagttattacaaaagtatactgctgtgttaggcttcaagttagtttcagtgctgttaggttgcattttattatgtgaagagtcaagtacagaggcattcacaggccaaatttagttgaagaatcttccccttttggtcagcctctcaattttgagagatttgaccaaaaccttggacatggattctactctctcttaccatcataaattgacttatttggtctcagtacggaatttccaagtgagttcaataattctttatgatcttgatgatctaatcaaagtgagactattcaaggattgctagatggctgcatacaaaaatttaatacttgagaggagaccacacatcatggggactattatataatgatcattaggataataataccaaaagacttaagtatactgcacaacagaagcccctacaaactgaactgatcaaaatcaagcacattgaagttcagctaatatagaaagttcagtagtatttgagtccaattgatcatagtcggtgttcaggatgtgatggtgattaaagaccacagtccactgtggaatggtctgatttaagaggaatacagttttgtcattaaccagttattttaagttatagtcacctggagacccactagaagatataaacattagaaaaccttggaaaagccaagcttgccactcaccacttaggatgtctacaaaccaactattagtggttcctataaacacattgtgtgttcttatctcttgagaaatttccttgattatttgatgtcagggttttaaaaaacagaggtttcagccaacttttaaattatgctttctgtagtagcaaaataaggggaaatatagatacagcattcagttttgttcaataccttacacaagcccccagcatgacaaaaaaggaaatctaaaactgcatgatgtttcattaagtgctttttgctgaacatgtatgtttttatccaccattcagagagtgacttctatcagtatgaacccctaggaggccttgttggccacaaagtccaagatttttttccagtttacagattagtttcaaattccgtactaccggtactccactactacccaagagtgagccctcagtaacctcattggagtctttcctcattggaaactagattatctttacaaacccaacaattgctccagttttttgctagaacataaaccttaactaaaaaaaaaaaaaaaattcatccacaaattgtggttccacagatttttctgcagagaaaaggaaaagattaggacagcagcaaatgaggaaaaaagaaaaagggtagtcctttcataatggcatagaaaagaagcctttgtctgtaatctttggaaagccattcatatctaggatgccatttgcttctgcagagaaacttccctggtcggctttccctaaaagtctccaatgagtgtgcagctctaagagtctggagggtcattttcagttgtaagatgtggacccaaggtttgagcccccaaagttttgctgcagtgagggcggtgaaaagaagttggtatgatccctttcaatggagttcaagggcagtctttctttgaggtcatttccagaagccccaatctctaggttctagatcttcaaagatttgattgttctcagttggtgtattataaaaagcttcctttacccggtgaaaatacacttttgcaaaatgcattaaagccttagagcatttagtcatatcagggtttaggagaccaagagatacatgaggtcccatcattaaggacagaggcctttcagtgactatttcatgagaggtcaacttatgttttcctctgagggtggatctgattgccatcaaggccaatattaatacctttagccaaggcaatctaatcaattcagttaactttgccagtttcagttttaagataccatttgttctttcaacctttctagaagactgagggtgaaagagatgatggtaattccattgtgttcataccaccttatttaattgctttataaattatccagtaaaatggatacctctactgctggagattttgccaggaatgccccataagggaaacacatttttgaatatccttttagctactcttatagtattggacttcctgcgttgacagttccaactagggaacataaactatttaaaaaaatacagggccgggtgcagtggctcacacctgtaatcccagcactttgggaggccgaggcaggcagatcacgaggtcaggagatcgagaccatgctggctaacacagtgaaaccccgtctctactaaaaatacaaaaaattagccgggcgtggtggcaggcgcctgtagtcccagctactcaggaggctgaggcaggagaatggtgtgaacccaagaggcagagcttgcagtgagccgagatcatgcctccagcctgggcgacagagtgagactccatctcaaaaaaaaaaaaaaaaaaaaaattcatatcccactgaagtagcaattaaatggaatctctataaatgttgaaatggcccattaggtagcagaaatgtgccccctgtggttttgattgtcttttcagaattatgagtttgacaaaccaaacattggttatgaattatttcagtaattttataacagtcaccacaccaatattttttcgtaatttgtatcattttgtctactccatgacgagttatagagggcagaacttttaacaatggaagctgtaaggactcagaaaagaccaggccgacatccagactttccataagtccatgctgaacattgaatttacatccttctaagtatcagttttgtttctccaattcaggtgcatagcactcttaagtaagttatcttaggtaatgttaaaataaaaatttagacaaaataaatttaataggtgtatttgagcaaagaacaatttatgaattgggtagtgctcagaatcaaaagagattcggagtactctgctacagccatgcgggtagtgagctttcttcacatggagggaaaacaagtaaaatatactagattagtttagagtagaaagacactagtcagaggttagacagtagttcctgattgataatgtctctagtttcattatagtctttacattgggctctggtttgcttataggaacctaaagcactggggctgtctcagtgtaatggtttctatattaggattttttttaaaaaagaaacaattcccccttttttcatcttctcatttatgagactgaccaaaatataggcataagcaccactccctgctgccatcgtggctgggttgtctttttctcagtgaggaacttgtaagtcatgacgtcaggcttgttaaagaaaggttccttttatttcatttttgtactctaattgcagtgagaccatctgatgtaccatcgatggctgtggacatgtgtttaagactcttgagagaatacagtgcacaaaggtgattgtaatgatgactgtcaggaggataatatcaagatgccaacatattctctttagttcctaatgaaccaaaccagctaaaataaaataagtcaaagaatcaaccagagagggattcaacttgttttagccatgtggcctgttaacttattgtaattgagtttctgcaatacaagaggtatttattcagatataacaggatatgttagttattgcactgacttctcctttttcagccaatagatggtccaatgcaatctgattatctaaaacaacttaagtaagataatttagagatttttcttgggcaaacatagccttagatgtagagtcagctatagtaacttatgtcaaagacaaatttctgatcatcatgttatttgcattcaccccaagccacagggaaagatacctaaaaaatgatgcccacctggtagggttgacatctgctgtaagtttctttttaatctatgatgtagttttagaggggtggatccgtgtttagcttctgattggttgtagtatgacaatgatactattaaaatacttagtgtgcattggcctttcattctctgtcaaggcatggggtggcccaagcatatggctgagagttaaataacctccacagataaagatgtaccacaggggtgcatataaggcttctccttgggtaattttatttgtggaggtattagttacaatggaggcactgatcatttctaaccaagagtctgatactgagttaccacatactggaagtctgcaaaaatacataggtgtatacaaattcttgcaaaagagtctattaaagtcctttttttgttgttgttttttaaccaggtagcctccatataatatagccaactaacttggacattggccatcctagtccatggttgggttagattaaaacaagtataagaataaatgggtctgctgaagtattttattaataataaaagtttgtacaccaaacttattggattttatatggagataatataatttaaaaataataaacattttctttctccttttcaaaaaaaaaaaaaagaataaatgggtctagaaattcagtcacaatgtgaactaaaggatctctaaaatcataggaggattttggcttagcatggcaaatccagcattttattaaatttcctccagaagctattgactgtgatattccaattatgacataattttgccacccacagatagaaaggaagaacaagaaataggagagaaaaaaataggggcttaataatagggagaggagattcttgatccatgatcttaggaaaatagtcttcattcaaggtaccatctacttctggggagagattttcatggtgagttttagtgaaacatcgtcagctggtgtacatttccaaaagtctgagttaagttgaaaaacatgaatttaagacttaaggccttgaagctttgttgcagtgtgagtggtgagaagaacataatatgctcccttccagtgaagctcaagggaagccttcccttggtatcatttccaaaagacccaatctctaggttgtaggtcatggaaaatctattgattgatcaatgggtcatggtaggctttcttttacctggtggaagtatactttgatatgtatcaaggccttgcaatactgaattataccagaggtttcaagatacttcaggtttaattgttaagggcataggtctttcacttactatttcataaggtgtcaacctgtgctttgattttcagtaggggtatatctaattgccattaaagctagtagtaatgctttttgccaaggaaatctaatagattctgttagccgattttagttttaggataccatttgtttattcaacctttgcagaagacttgggatgataaggataatgctagtgccattttgtacatcttaatttagttgtttaataatttgtccaataaaatgagtttctctatcactgaaaatctttccaggggcactccataagggaaatgcattctctagtaatttttttgcttcttttgtgtcattgaccttcctgcagggaaaggcctcaatctatcccaagaacaggcatacaattatatgaacatactgataactcattgagggtggcagctgaatgaagtgtacttggaggtgttccagtggtccagcaggtgattgtagtatagtgccagaaaccttaattgtttttccaggattatgaatctgacaaatcagacattggttataaactgtttttgcaacaatcacttcagcaatactttttcataatttgtaccattttgtctacactatggtgagttgtggagtatagagcctttaattgcagtgattttaaggactcagggaggaccaggcagttgtctgggccctcagtgagtccatatttagtactgcgtttgtattttttaggtgccaactttgcttttctaatttaggtgcaggacattgtttattaaatacattatcataggttatttgaatcaatcttatgaaattcatttaaatggcatatacaaacactttcagaaatagctaacttatcatggaaattcactagggcagtttctccatattcagggtcagttttatgagtgtgagcttcaattttaataatagtaacttgtgagggccacaaagcagcagaaagaagctcattcacttggggtcactttttttttattgaggtcctactagaagtgaggaatcttctttgtttccataatatgacaacattacggaccaccccaaaggtatgtctactatatgtataaatgttgactgttttgcccttagatgtttcacaggcctaaataaaaacatacaattctgctggttgggctgacttaaattggggaagagtttccttttctattagtttatattgagttgtcatagcacatactgcttggtattttccttctgaatttttggcttaagatccatcaaaaaaaagtattagaccagaactatataatggagcatcctataaatcagtgtgaggggtcaatagctatgatttcacatttacaccattgtggtcctcatcatcactagaaaaggatggtaaagtagcaggattaagtagtttgcagtattttagatggagactatgaagaggcagaagaataatttctcaagatgttagtctgcttgttgagaaatcttgagtttgaatgaaatttaatggtctttccacaacatgtggagcttgaaaataaagtttatgtcctaaaactagctctggtgaaacctctaccaatctgactgctgctgctactgcctttaatcaatagctgctgagtctaattgcaggctataataaatgatggatgggtctgtgttttcctccatgtttttagcaagaactcctaaagttggctgtcaggttcataaataagcaaggtgaaaggtttgatgtaatttgagagttctgagatgagaagttgttgtagggccagtttttattggctgaaggcctgctcatggttgttctcccaaggtaaagactctgggacaaagtattttgtaaattaataaaagggaggtgccaaacaaaaaaatttggacccaagacttacaatacctacaagtccaaagaaacgcttaattgtcttttagtcatggttcttaggaaactttcaagtgagagggagttccttctgcagtcagattatttcccaaataatgaacctttttttttctggaaaactgtagctttcccatagaagccttatgccctttgtaagctagttgttgtagtaagtaagttgaatctattcctggaccttctttagtaagagagcacagcagtagatcatctacttattcattaagagtagaattcctggctgggcacggtggctcatgcctgtaatcccagcatgatttgggaggccgaggtgggtggatcacgaggtcaggagatcgagatcaccctggctaacacagtgaaaccctgtctctactaaaagtacaaaacattagccgggcgtggtggcggccacctgtagtcccagctactcaggaggctgaggcaggagaatggcatgaacccaggaggaggagcttgcagtgagccaagatggtgccactgcactccagcctgggctacagagaaagactccgtctcaaaaagaaaaacaaaaaaacaacaacaagagtagaattcctagggaatttaagtttgccaaatcctgatgcaatatctgagaaaaataggatggcacttcagtaaacccctgtagcattacaatcaaaatacactgttgattttcccaagtaaagacacgtaagtactgactctatcaactggagtactaaagaaggctgagcaaagactcactactgtcaaacatttcgaatgtgtggttacattagacaaaaaaaatagagtttggaaccactggaaatcttggtattacaatcttatttactatatggaaatcttgaacaatttcatccattgagtttttaactggtaggagtggagtgttataagggctagtgcaagaaatcgtaagtctttatttaagtcctttatgatggtgagaactactaaatagctactggttttagtgggcattgaggcaatttaggtaggggcttacaataatctactaggatttttataagttcagcacctttaatttttcctgtttcagttgaagaagcccacaaatacttaggtacttcagaaaggtcagggtttatataggtttgagcttccatgttacctacatgttatgcctataggaaacagaaaaattcaggtttagaagagttaggaaatttgaagattctatctccttctgaagaaaattttatgtgactacttgatttcgagagcaagtcttgtcccagtagatgcattgaggcagtatcatgtagtaagaagatatgttcttctgaaaatggtccaagtgtcaattggacaggttcagacatagggacctattgcacttgatttcaaaccccaccacagaaacattctctttactttgagggattcattgatttatgaggatggggtttaaagtagataaattttctatcaataatgtacaatattcccccattaatcttaatcttagttttgttttgttcattcagaggtattatgcgaggcagtttaggggagaatttcttgaagccctatcagtgttggtgattattctgggagtcaaaccccagggggcttcctgaagtagagaaagtctcggcaaaaataaatgggtgtatcagatggctagtgtcagagtggacagtttctgttccagtggcatggctgtttacagtaaagacatctcaatccacaggtttcttaagtttgggacctcttgattttgatttacaatgcacacaaagaaatcctcttggttcctgtagttgttgtaactgtaaagacatgagcctatttgccttttgattattcccttattctagaatcttctcaaaatgttcggctagggtacaaaatgttcagctagggacactaattcaatcatatatatataatttcccatcctggtttatgttttctaattaagccactaaattcagggcaaagtccatttatgaacagagcaattaaggctatttcaatccttgtagaaaacatcccttgttgtatttcaagcctgaagagtatgtgtgtgtgtgtgtgtgtgtgtgtgtggtgtgtgtgtgtgtgtgtgtgtgaatgtgttttgtttggttggttggttttgagacagggtctcactctgtcacccagcctggagtacagtggctcgatctcagttcactgcaacctctgtctcctgggctcaagcagtcctcctgccttagcctcccaagtagataggactacaggtgcatgccactaggcccagctattttttgtagtttttgtagagatggggtttcaccagattgcccaggatagtcttgaacttttgggctcaagcaactcactggcttcggccttcccaagtgctgggattacaagtatgagccaccacacctggccccctggccccctggccccctggccccctggaatgttaaataaatattatttctaaacagactgtaatctgaaaccagttcaaacttgttcatcctgtttttttttttctataagattgtatgatggaccaatcaatctggaaaattcttaggaactgaatataaaagattttcagcaattatttccagctccttttggccctcctctcaaggagatattctaggggtctttaatattcttgagtttttccgattccacttctaccatctgtttgtgagtttcacagggtcccaatatcatatgaataaattgataaagatcagggattcctggatcatatgctccaataaggattctgactttttcagtaaatttctagaggttttcctctgggttagggaagtcttttgccatggctgtaagctcagttttagaacatggagtaaaggtggttacagaaggcaggcctgactgatcagaagatttcactttgtaaggcatttgtttgacttccttttggccattatcttcagggtaaaaaggtagttgagcaaaagggttagtggactcagaatatataggtaaggacaaagtgaatgaatagtcagggttaattcagtcaaggtacagtccttttatgtaatgttttcagtttgttgcttaagcttttcatttgccttagagaaggaagattttagaaaggcaatttttgattcatttaatctggtagacgtttctgcgtaccaattgaaaaatatatcacattgcttttgaggagttttggatcctttcttttttaatgtgccccacaagtgaccagttttacctaggttaagaccttcttggctgggcacagtggctcacacctataatcccagcatattgggaggtcaaggccagcagatcacttgaggccaggagtttgagactagcctggccaacatggcaaaaccccatctctactaaaaatacaaaaattatctgggcatggtagcacacacctgtaatcccagctacttgggaggctgaggcaggagaatatcttgaacctgggagacagaggttgcagtgagctgacatcacatcactgcactccagcctgtgcaacagaatgaagttctatctctaaacaacaacaaaaccaacaatgatggactggattaggaaaatgtggcacatatacaccatggaatactatgcagtcataaaaaatgatgagttcatgtcctttgtagggacatggatgaaattagaaatcatcattctcagtaaactatcgcaagaacaaaaaaccaaacaccgtatattctcactcataggtgggaattgaacaatgagaacacatggacacaggaaggggaacatcacactctggggactgttgtggggtggggtagggggtagggatagcattgggagatatacctaatactagatgacgggttagtgggtgcagtgcaccagcttgtcacatgtatgcatatgtaactaacctgcacattgtgcacatgtaccctaaaacttaaagtataataataataataataaaaaccttcttattgtggctactctgatactctaattctaaattatctttgataagcttaatccatttttctaaaaatatacaaattatgggtctataattcttatacataatatttgttggagtcccagaaagtagagtatcagactcctttgattcagaaaaacctgttatcaaaaaataccttttcaaggcctttaactgaatttcatccagttaatcattgaatccaatctgattctggaccctgtccattctaagaattggtcagatgaagtccagagagttcaaaacacaatcagtgtaactcagtctaccactgccttcagttacaaacaagagagcagtgagcacggtggattcccagggcacctcacctggtcacttagtcttactagggatcatcagagatctcctttgaatctcacttatacatcaaaactgataaaagaaaaactttagacaaaatgaatataatagagtttatttgagcaaaggataattcatgaattatatagtactcagaataaaaagattttcagagtgcttcactgcagcagcatgggcaaggagctttatgttgagggaagacaaataaaatgtgcttgattggcttagagtggcaagatcctagtcagagattggatagcagtttctgattggtaaagtttctagtttcattttactatttatactgggctctggtttgcttccataggaacctaaagcaccgggactgtctcagtctaatggcctctctgttaggattttttaaataggatttcaatttgtatcagtcttatggagttcattctaattgtatatattaacaatttcagtactggctgacttagcatgaaaatctgccaaagcatttccttggtttcaatgaattcttgttctgcttgacatttggttagcagttttataaaattagtttcttcattaggttctaggaattcttacccagtacaatggtatgatcagatttttagaaatttcatacaatttcgagaacacatactactcacacatctatacaaatataacgcaaagtttagtatcacttattagttgacaatgcttttcgtatagtttaatataccaagtaagcccaactagttaacacctctctttttataaggagagagacaaatctctttgagaagttccaagggcttattgggaaaatcccaaagttaatttgagatcaagaagagaatttaaaattttatttgaaggagtttgtcaaaaatatcaaagctttaaacatttgattaaaatagcattacaggttactatgaaataatagtcatttatttaaccagtgataattaaatatttcaaaggcaatcacaggaagtttcatagttataggataaaccttaagtttttaatagagacaacactaagcacaggaaatcatcttgataaaccccagaatctttgttttctaggccaattacttaaaagataaagaaaaaattctcacaatttcctattaagagcagatcagtactccaaaaacttgttttagcacaggagaccaaattctaattttgcatcagtgtcctttttatattaatgctcaatttttagaaaactcatcaatagtttctttctactattatagccagcttgatcacacataaaattcctttcaaaagattacactttcagaaaatttctgcagccttcttatatcccttcatactttttttctataattttgttatttagttatttgttatttgttctatactttttctctttctcattttagaacaaccagtgaatctaatttaggacaaaaaaatactcttgttttctcttaacaaaaacacatcttccaaacctcatagcctcacttaccaaaaacatatctcactttcctcacatgtagagttgtttcccttatattgtttctaattttaatgaccatacctgttgattagaatttgtaactcttagtaatgttaatttatagtgaaaacccaggaagtaaagcaattttgaattttcatatatgaacattttatgaatatacattttataatttctaaaaatatgtgcttcctcctagaacaatttttcatgtttgctaacagactgaaatatatttaacttttctatatcataaaaaaacaagatgctgaaaattatatacttaaaacttgttcagcaattactgtttcagtattttaacttacttcgaaatgactcagacatttcacaaatatccattacttaatttaacataatatacttcaaaatttcaaatttctgaaaaagattttttaaaccatgattggtttattgaaaaactttgaccaggtgcggtggctcatgcctgtaatcccagcactttgggagaccgaggtgggtggatcacctgaggtcaggagttcaagaccagcctggccaacatggtgaaacaccatctctaccgaaagtacaaaatgtagctgggtgtggtggcacatgcctataatcccagctacttgggtagactgaggcaggagaatcatgtgaacccaggaggcggtggttgcagtgagccgaggtcatatgactgcacttcagcctgggcaacagaatgagactctgtctcaaaaaaaaaaaaaaaaaaactttgatgccacattcacgtaatgtacttgttcttaacaattatgcttacattgctcattaaacaaagctagcctttgaaggatttagtaaaatatcaccccaaaatttatatattggtttacatatttttggtatattgattactttctagtgctgaaagcacttgaaaacagcaaaatgcataggctttctgagtgccctccatttgcctaaagagatcctacaaaaggaactaaattgctattaattgtccaaagattaacttttatcacagaagaggaggttagaggtccaccacagccaaacagaccttatcacaaaccatcatctattcttctaagggcccattcatcttttcaaaaatcatttaatctgaggatatctttttgcttcacccctgaccatcgtatccattctagcagcagagttgaggcaaggaacagtcctgtcccagcacatatgctaacttgtgtggtttagctaatttccaagaaggacatctccaaaagtgagggaggttcatcagataatctccaagatctaatactctgttttcttctctctccccaggcatcctttttttcccttttgctgttctgtgtgtgtgggatctacagctctgttgtgttaaagtagaaactttagacaaattaaatctaacagtttaactgagcaaggaacaatccatgaagtacatagccctaagaatcagaagaggttcagaaagctccactccacaatgtggacagaaaatggaagttaaatacagaaacagcttgattggttgggatttgcatttgtctcacttggccgtggcctgattggttggccacctgtgattgactgaagcttggctactgtgattggctgagactcagctatttattttaaaagcatactgctgtgtagtgagctgagatcacgccactgcactccagcctgggtgacagagtgagactccattctcaaaaaaaaaaaaaaaaaaaaagtatactgctgcgttagacttccagttaatttctgtactaagttaggttgcagtttgttacgtgtgggctcaaatatgggtgtgtcttcagtccaaatttagtttaacacttggtaaggttttaagtaatcccttggtttttagcctcatatcgcacctcaatcatccacactctctgattctacaaggaccaaatctttttatgtttttgtcaggcaacttggcttttttctggcctttcccccttctatgtccattctgagttttgacttctacttctctttaacattttctctatctgttcaaaagaatttccgaaattgtaatgagagctgccattcagagccttcagagatgatcctttccctattccctctttctctctttttattttttgagacagagtttccctctgtcgcccaggctacaacctctgcctcctgggttcaagcgattctctcacttcagcctcccaagtagctgaggctacaggtgtgtgccaccatgcccagctaatttttgtatttttagtagagatggggtttcatcatgttggccaggctggtctcaaactcctgacctcaagtgatctgcctgccttggcctcccaaagttctgggattacctgcatgagccattcttttttttgtggtaagttttattatcattattataccattccaatgatttcagcactatttctggacacaaatgagataaatacatgcagggctacactatgttgtaaccttgggaaagtaagctgggggtggagattgttgataagtcagagtgaaagacagataatataaatagaatgttccaaaggaggtgcagatccggaggggctcataaattgctggaggaaggtcatcaaaagaggaagggagagttatgatgaaccaccatagaataaacatatagactttttgcactgtggaagtagatttgagaaggtaaagtcatttattaactcaacaaatatttactgagtgcctattatgtgtaaactctaccctggctgctgatgttctgatgaccaataggtacaacttctgtcttttgtctgctcatgacattgaagtaaagtcagagactactcaaacaaagaaacccaccaacaaacagatagaagtacaacacagtaagtgctgaagacaaggcagcagaagttagaaacagctaattgaccacattgaaagagaaaatcatgtaccacatattctggttaatatattgtagagtggatatcaactatttttaaacgaatcagggggttgaaaaatactcattggaatatggtttctatgatacatccaatctaagattaatatgagatacataattccaagaatcatgttttgggtatcccattattagaaatatgagatgcagagctttagaaaagagttagttatggttaggatttattccatgggaaagacagtaaacaagaggcatgaagtataattatgcaccaactgtaacagcttaaggcatggccagtgctctgtgttgggatgaactttaatgtaaaggtaccttataggggttgggggcccaggtgctctttgatttagaggaacacatatttctcaaagggtagactctcctgaaatattcacaaatagatcataactgcttatatctaggctttgaaataatggggttttgcctatctgtagacaggatgttctgggaggaagatagcagcattaacctcaggatttctctacctcttaccataccattattaacatacgcaatctcctttatcctgtaattggaaagagaccacagagcaccataaccatgtctcccatcctcttcaaattctttccagtggtcaggaggatgaagccatgaaatagaaaacatttacttccaggcactgcctttattcaattttaataagaaattgttaccaggcacgccatgctggtattaatttcaaattaaaacttagactatgtatgacctctttaaacagctattttccaattcgtttattttggctgtaattatgactgattgctcaattcttactggaatagctatgtgtagtttcattttagttgaagcttttacagtaataactggggaatattttctacataaatgtataagatacctgttttttaccttatagttaaaagatgacagacttgaacatctgatgtacttctccttactgcattgtaaaattaatttgtcttttcatgtggctacatctaggcagtttcaacaatttgaactttgttttatataagaaataaaggaaaataatcagccatgaagtagttaatttattgatattttatgtatgtgtgtgtgtctatacatacacagtcacatatataaacatgctcagaagtcagaataaaagtattccttgataagacattaaaatacaaagccatatcgaggtgtgcatcacatccccatttaaaaaaatcagacccctgcattttcttttgcacattgatactagaaaaagaacttcattgattgtttttattatgttaaaagtctcagcctttcttcttgacactgtattctatttaagcccatcctttgtcatcccaaagaaatccattttaaatattgttttggaagctagatttctgatgcattctacttctactagaccttatttttgtgtgtgtgatgtactgcacaaaattgtctattgatatgaagcaggcgttggaacgatttttcagctttgatcactagaatgaatcgatttttaacaaaccctcggtgtggcagcagttgctgatgttgtgtgtctaacaacttcattgaagggctgcatttgatttgctattgctaagtgctgtctttcaatgagcttgtctgtgaagacttcctcaactaactgaaggtcgtttatcaggttagaaaatgctgttaaatgttatttactgattaaaatataattataggcagtctccattacacagaatcatcaatttgccattagtgctacttggtgtaagctttaaaaatgctaatgaaactgaaaactagctttccagctgaacatgctgattacactaaaaaggtatttgttcactttgaatgtgcaaggttagtgacaaaatccactgtggtgttacttttttcttagtgcttactattttttgtgttcagccagtagactagattataaggcattgttgtcttcacagaagaaccatgcaatcaaaagtctccaaaactgtgagcattctaacaactggaaacatgaaattataacaccactgactatttatgtcccatatgtgagctacaccatggggcaatatgctaaggtaaagaaataattgttgtcactggattcccgaaaatagcaatataattgcttgatctgcaatgagattgtcagtccttcctcttttaatccttatttgatttctacagccacttaacaagccaaactgtgtaaaatgtcaataaagacaaagtctttatttttttaagaattctcattaatattactgaaagcttattcatcaaactattttactccattatcataatctgttaggaagtaggaagtaatgcattaggagacttatgtgtataagtagtgtgagtgtatatatgtaatattaactctttgaagcatggagtttgtttttctaaaacaaagtttttagcctagtttttaggtatcttagcattgtccttttcttgttggattccactaagaatttaatgtcctttaaatatattgacagcatgacccaagaatattcatgatttcctcttcccttttaaaatataaactttaacttttttcactaatctagagattttcattttgacccaagactgacaattttaagaggatttttgacagctgtgactgtcaagaacagaacaggataaatgattaaactgggtaaatccaaaaaaccaactgcccatagcaaaaaatatatgtgtgtgtgtatatatatatatatatatatatatatacacacacacatatatatttatttctggtttttagaaataaatatgtcaaacgaatataattgtatttgtcctgagccccctttcctgagaggattgagttctaactgcttatcagccattgttcactgccatgcaaggatttagaagagagaggaaacaaacattctatagtttcataggcattgatccgtataaaaatttactctcccattaaaatagtttaaattactaaaaagaaactaagatcatagtgaactttgagttttattttacagtcaaattatgaatgggaatcagataatggcatttatttatttatttatttatttatttatttatttatttgagacagagtttcactcttgtctctcaggctagagtacagtggcgcgatctctgctcactgcaacctccgcctcccaggtacaagcgattctcctgcttcagcctccggagtagctgggattacaagcatgcgtcaccaagcccaactaattttgtatttttagtagagatggggtttctccatattgggcaggctggtcttgaactcccaagctcaggtgatcctcctgccttggcctcccaaagtgctgggattacaggcatgagccattgcacctggcctaatggcaatttcttttttcttttttttttcctttttttttttttttttttttgagacggaatctcgctcattgcccaggctggagtgcagtggctcgatctcggctcactgcaagctctgcctcctgggttcacgccattctcctgcctcagcctcccaagtagctgggactacaggcgcctgccactgtgcccagctaatgtttttttatttttatttttattttcgtatttttagtagagatggggtttcaccgtgttagccaggatggtctcgaattcctgacctcaagtgatccacccatctcggcctcccaaagtgctgagattacaggcatgagccaccatgcctagctggtagtctcttttttattcaccaaatcacagatgcttattgatttaccacttaccacttttatcacatcttagtctaaaattagacacttcctttaagttttttatttccctttattcttctttgggagaggaaaaatagtttgtcccaattgtcacatgtttgaagactatcttttcttgaataattttctcagaaaacacagaaaatttccatcactcctttaaaatggcaattatatcttactctctgaagacttgttagaataaaagattcctgacagctgattaggaaagtgacatatattttacttcctttcagatgaaaccttctaaaaatgtatttacttaccaggggcagtgacagcctgtctggcaaaaataattgatatcctttctggttattgtagaaggggaacaatgaaacaagaaagaccttgctcctatcttcagagatgaataaactggaagaaactcattgtcattaaattaaaattttcttttaggtacatctggccgttgacacattcttgtataatgttagtaactctgcctcatcaggcttggtgtagtattttcaaaacatgcatattctgcctttgagataaggtaaaaaatatctgaaatatctggaagtcaggaagtttatatattaccatatacccctgaaatatcatagaagttaaatatagtttgacttcaataatcagattaatatatacaagagtcttttgaaaggatgttcacttttgaataaaatttgagctggaatgctggttctagtattcataagctaaatgatcataaggaagttactccttttgaatttttacttttgacatatgtaaaatagataaggctatagtgcttccttttctgtagtcacgcataagaaattttataaatattattaattatgatggggtagccttaaatgtggtttcgatacttatctttacaaaacgcaagaataaaaacagcaacttctaagaaaggatctctctcttctgctttaagaaacaaattaaacctgcttgttactagtatattaatgatttatttttaaagggctacagccaaagatgttacaattgttcttttaagcaccattattttcagagaaatatttacattaatttttaaagatgttgctgtaaaccccccttttttcttagcactttaaccccatctagatcaaactattatctgcagatgtattgatgtatatgctttcttggcttttggactgccatcacaactcagcgtttctcatttataacttggtacagagaggttattcattaatctagaactataactaattcatggcaaacttgggaaccaggatctgagctactactctgccaaattccatatttttaagcattatagaatatccttatttttatagtaaaacattctactatacataaatcagtatgtggctgatgccacagaacacagtcatggggcatctgtagaagtcatgctttgttgacctaatggaatctctgtcttcagagaagtaaaaacttggttgtttctgtaggttataaagttccaagccattgcttgccacctgagagcattaattccattatattggttgtttccatagttaaggagtggcttgttagagtgctaactgtctatgtctcttccccaggccattaggtaataaattggatataatatataatttttaagttttttcaataatgaaagatattatgtaaaattctctgcactcaaatgatcttcagccatctcatataatctcattttctgacctgtgaaaactacaaaagctcccaggtttttagaagagactccattttgccactaggcttgtcacttctctccttttagaatgtttgactttgggaactcataaataggctttttttacttgcttagatgaatgttttattaaatttgaccttgagtcctttaacttctaaatagcagtctaatttttaatgactcttgagagatcaatagcttttctaaaattttatattgttatgctaataacttttccatgtgtattctttataatcttgatggttaatattataaatcataaatttattaaaacattaaatactgacattgatttttaagatccaatggattagaatttcatatttttcagcatattataacataaaatacattgctatattttgtcacttactttgcattattgtttgtctcattatgaaatttagtactgtttgtctcatttgtgaattgaggtaactgaagtgaggaggttgacctgaccaatgaaaggtcctataactagttagtgaaaaaacaaagcaaatatgtgttagaatgccatctccactgttaaatactgacagtaatacatagttcctattaacagggtaatttgtatctagtagatcaagttttattccttgacaattatgccctttattgtttcctgataacataaaaggttcatgctgctgatgaattttgcaaatagtatctgtccagtgtaccgaattttcagatttagaatctgccccatagcagttacaagcattctgtgctactacatgaaaaaagtgtgaatgagtatttcttgaacaataacagatttcagttgaaatgttagatgaatatacacaaaacaattccatttaatcacttagactagagcaaattctaaagcatccattatattcccagtcaaaattcgctacgttattttatttctcctttgggagaacaatgtaatttccatcattgcagattctcaaaataaattatagttgaaaaagccacagagtttccaaccaaactttcaccagcctattgcatcccccttgttttggtggagaatcaaagaagggaaactgtatttccagtggagaagccacaataaagcctttatgtagaagccaaagttaaaatgatgccaacaggcagatggaaaccaagtctgaatgaggaaattctgagccaggcatcttgctgtggctgtaatgtagcccggttgtgccctgatttctctgtccttattactgggattgcagttacttatgaattgaattcccacgtagttatcttgctgttattgtaaaatgccacatgatattttgtgctaagtcaataaatgcctcatgccaacactgtgtttattttgggtttgtaatctctgtgcttttaccctttttctgacattttccaagtctctctctgcaaatcagctggccatgaagcagagcttcctttcagcaattgacagtctgctgctgcagacctaaccaccaattcacaccccaggggactatccaccccaggaagagatttgctctcagtcctctgacacctcagttagtttaaaaattactcctagaatttagacttcttgcaggtaattcttagagaaacataaaaagaaattggttgtttgaagtgtaggtttaaaaataaagaaaagcaataaagcaggatcatttgaattggaaaaatataggagatttcaaagaggtcattggatacattttttaattcattgactttcaaacacttttgagcatgatccacaatatgaaatacagtttacagtgttacttattatatatccatatatacatgataattgaaaccagttttatcaaacaatacttacctagtattatataggattgtcaaagtataatattaaaaagttaaaatattcttataggtgatgcttatgcttcaacttgactggattaagggatgcctaggtagctggtgaaacattgtgtctgggtctgtctgtaagggtgcttctggaagagattagcatttgaatcagtagactactcactagattcaagaatatttgctctcaccagtgtaggcaggcattattcagccaatccattgagggaacaggtaaaacaaaaaggcagagaaagggtttattctctccctttctctctcttcttcagttggaagattcatcttctcctgcctttggacaccagagctcttagttctcaggcctttggactctgggacttacaccagtgcccccaccacttcccctgcactccttcattctcaagcctttagccttgaaggtgaattacactattggcttttctgattctccagcgtgtagacaacatattacgggatttctcaggctccataatctcatcagtcaattctcattataaatatcctcttctcatacctatatgtattctattagtcatatttctctagaaaaccctgactaatacatcatagaaaagtaaaatgagcacatccagaattttatttaacttactaataagacatccaataggattttaagattataagattatttgaagtgctagatgtttatgaacaatttaatgaaaagatattaagattactaggttagatagaaaactgattaatgtactaaaggacaattaaccataaaatttagtgttatctatttactggacagaaataatttgcatctatacttaataaaaatgtataatttaacatgcatttttactaaatcttggattctttattagtagtgagtcaaactaagttcatttccctgaataattcttggttgtaacaataatgggccatatgagccagtaatgcccatgggtgatatagaaagatatactgcccaactttttaacttctttcttccaaatttgactaattttttaaatagaatgtgttccaatattttctattacagtctgttgtattcgggtctatttcatttttcaaaatactggtacagctcactaaattatcttcataagccgtagtaggttatgacccaacttaaatgatactacaatataaaaatatcatgactgcaaatactgcctaagagaggcaagtttttttctccatgttaagaataaaaaattaacaagaaaaaagagaagggtggggagggagaaagaggagaagcaaggagagaagagagccccagcaatctatcttcagggatgtcagcattttttaaagtgataagactttttataaaagtcacatttcttttccctcacagagcacaaattttgtttacgttgcaactgaggctctttttctcctatttagaggggaatttagacaatttgtagagatttgcagctgtgagagaagatttttttagaactactatttcattatacaggttagcaaactgacttaaaagtaagatgacctgcttcaacacccagaaattccatagggaagtccctgcgtgtaactatgtatgaggagaacagtccctggactcaggaaggtgtgggcctcagttgtgagtgagtcaccagataggaaacttcaggcaaagccattatatttctggtctgaattaccacatctctaaaatgggacaaaagccattattaagattaaaagatgaactatacatgaatgtccttgtaaaactgaaaatgtagttttaattatttccgagatttttatccagtgcacgttttcccatccctggatatcctgtaatacataaaatatagatgatggactatttgcatatacttagagtcattgagatcatatgtacaaggtctaggcaagtctagttagttttataagtacattctctgttctacatacaggtccatatttaaatatacaaagatgtgatagctattattactaatagatcatcactgtaaaatgctctaaaatttccaagttaaaaagcaccattctgataaaatgtactattattatataaggctttcaacctgtggagcttctaattatgcttttcatgcataaaaaatgcaactggaaaaactgataaatggccaacagctacttccctgctgattacacaaaatttcattatggtagaacatttaagaatttaattctgagctctctcaggaatagtctgtaaaatgttttgcttaggtctctttttaagcacagaatctcagctgaaataaaaggtgtattgagcctttgccataagcaaagttaagtcattaagtcagaaaagatgagtttgaaaatgacaggtaaagacagaagcaataaatatcaccaaaacatgcccaaatgttttcttctctcatttttagagtgacaatagttattgaggtagaaatgaggtcgttttactgcaaagattactctcctgattcctaattaatattttttttaatttcccataaatattaggaaaaatattctagacatatttgtgccttttacaaagtgctttaggaagttgctgtaatgggcttctttagtattgtgtttttcagtgtcttctttcactccttccatcttctctgattctcctgtttacataaaagaaaagagaatatttaagtcctaatgtgtctatagtacttgaagcttcaacattgggcagatgccattttcctgttttttaactggaaaagcaggtcccagacagatagccttgggatctctatgggaatgtggaggctgcatctgagaaccagcaacagtggagcctaggctagtataccacagagtatttatccctagctttgaagcatgaatccaaaatgtttatatgccattagaatatcagaaatcttcatttggtttctccattgtgttacttgagtgtacaccattttctatgtcacttcctgttgctatgttctggacatcttattctcttcctttccaagaatgtaggagaaagatcagttacttgatttatacctgaaaaactgtcttcttttactcctactgagatattctgaccctttgctgctaacccattctcagtcacactcctgctttcctctctacctgatgttccagccacagaacacaccacacactttccttcctgtgtaaatgcaaagcatttggtgtagggaagatcacagggttagaatcagcttaacctgtgcttgagtcctgttgcttaccagctggataaccttcacaagtttaccatttcttgtagcctcagctttctgctctgtaagagagatgaaacctcacaggacttgtggaaatgagtgactactacctgcaagattcatgctgctcaagagccccctttgcagggcttttgagaaacgtgcttccctatgaccagtgctcctggattttacacatcctttcctgtctcttctcttctttttttctattaaattaatatcctgtagttggaaaattctattcagagtttgggagaaaaaaaaagatgaagaaggataaagtgaagtggtaggagactgaggaaatttaaacattcataatttttgtcctgcttcataaatacatagtagctgtatggttacttttacctataatgtcctctttacccgtcatttcctacaaccacaaatagcaccattctagtcccattgaaagcctaatctatattttatatctttattaaaattttgtttaccataactggaagtaacatctctgtccccaaacttcatggagttttcttttttaaaatttcactttatttcattttctaacattgacagataaaactgtatgtatttattatataaagcatgatgttttgaaatatatacacattgtagaatgactaaacctagctaactatgtattatgcacgtagttatcattttcgtgatgagaacactttacctctattctcttagaattttaaagaatatagtaccgtattaacaatagtcaccatgttgtgcaattaatcccttgaacttattcctcctgtctaactaaaattttgtatcctacaaccaacatctccccagcctgccacccacctcacccctccccctaacccttggtaaccatcattctactctctacatctacgaggtcaaattttttagattccacatatgagtgagatcatgaagtatttgtttttctgtgcttggtttatttcacttaacataatatcctccaggttcatccatgttgttgcaaatgacagaatttctgttttaaggccgaatagtattccactgtgtatatgtaccacattttccttattcattcattgatggacacttcagttgatttcctatcttggctattatgaatagtgctacaatgaacataagagtgcagatatctctttggcagactgatttcatttcatttggatatatacccagcaggaactgctggatcatatgataatatgataattgtatttttaattttttgagaaacttccatacaggtttccataatggtttcaaatacattttcaccaacaatatgtgagagtttcattttctccacattcttgtcaaaacttatcttttgtcttttgataatagtcattttaacaggtgtgaggtgataacttactgtggttttgatttctatttctctgatgattggcaatgttaagcatattttcatatacctcctggttatttgtatgtcttctttggagaaatgtctattcaggacccttgcccattttttaatgaagttacttgttttctttctgtagagttgtttgagttcctgatagattttagatattaaccacttattagttgtataatttgaaaaaaatgtattccattatttgggttgtctctttattaattgtttccttggctatacagaagcattttagtttgaggtaattatttttgtttgtttttacgtttgttgcctgtgcttttggggtcatatacaaaaagtcattgcccagaccaatgtcatagagttttctccctatattttcttcaagtagttttgtagtatcaggtcttactattacgtctttaatccattttgagtggatttttgtctctgctgtgagataagggcctaatttcattcttctgcatgtggatatccagtttccccaacactgtttattgaaaagactgtcctttccctactgtgtgttctcatgtcctttataaaaaatcagttgagtgtaaatgcatggatttatttctgggctcttcattctgttccatttgtctatgtgtcagtttgtatgccagtaccatgcagtttgggttactatagctttacagtgtattggaaaatcaggtagtgtgaagcctccaattttgttctttgttgctttagattgcgctatttggagtgttttgtagttccatagaaattttggaacatggagtttttagtttgtatgtatatatgtatgtttatgtcttgattacttttggcattttaggtcaggtccacatgtattaagtttcttgtttgtttgatatacagaaccgcccctttcctgagtgttttgcaacatgagaattagataagtgtttatattcaagtggttgaactcaggtttctaaatagaaatactagagttaactaattattacatatgtgcagcattctaccatcacagaatattgcaaaaggaaataattctgaaagattaattttttttctttggcccatgttgactcttttcttgccattaaggtagtctgttgtgccaatacttttgcaatgaaagaggtgattacttttcttagatgttttcctgcattcactgattggtagcaattccaacaactgatgacttgggcagaattcaaaccaggaactttatagggaaaactgtaataccatcattgaatttgtgagccctctcatcttgtagattggaaggtccaaaggaagcttttttttttttcccacacttcacatgcactgtgttaaattaggatggacgtcaaaaatctgaccttttcatggagttttagagatggaataaaaggaagctagtaactgatttcattccagctgtatttcccacagcttgtgggaatgttttatgaggagagttgtggatagtgttttatgtcatttgatgagaatgaatccatgataatctataatttaaagcaagataaatttccctattatggcaactcggtcttgtattaaaagctgacacttcaccacaggtcactgctttatttcttcaagacttttggtgaattgcccttgcaaaacaccaagagcacatctgtaagttttagtttcttaatgactgaaaggacaatgtgccctatatttaaggagaaaagagttatgctcggtaagaaaatggagagagatatatatatatatataatttttaaattaaactgtgattcaattatctagattagccaataaatgcctttgtattactataactgcttccgtttgcaaattacagttttgcaaacaaaactcacttgctactttttaaatactattaattttggacaaggaaattcatatatatgccccaagggggaaaaatagaaaatatgtcttcctttcaccgtctatctctgtcttagcttaaatttgtgattattctcctaagagaagactaagcatgaatgattttccttataacacaaaacattctgatttaattgtttttagtagttggttctgatttctgacttcagttgtattcttcctgacaaacctctatttcctgatccccttaactttctgtcctgtagcttgacaggaaaacattaaaagactgatgaaaaactgctgtatgcctctagcattctttattttaccttcacagttactcaaaacttatttgttgaatgaaagcttaattttcctttttatgcaagatttggtgtgtggcagaaggcagtagcctggaggtggcggcatacatagacattgaggggctggtgaaacagtgtcccagtcaccagggaggcacaggaagagaggcatgaaaactgctctgcccctgactgtatgggaaaccccaagagcatcatctcgctgtccatgaccactggatttgtaagatccaagggggcctgactcttcctttgttcttagtctcttatatctcatgcatctcatacgcctgacatggggacatagaagaatgctattaataacattgctattaatacaaacattctctaaatgcaaaatggaattaagtgattcctcttttaacctctgaaatactttaatatgatttaagaaatactttaatttgaaagatgaatctcttttgataaaagacatgttcatataaaaagaagacaggcgactggataattagtacataatcaaatagtaaagttgcctttctgtttatctttagtattcaatggtgttgcagtggctcatggtgtaaaataaaatatttgtcaatgcagacacagaaggacttttaaaatattcattttgggagcaaaagtaggatttgtaatcagtacagcacctttaaaatcattggatagatgcttgtatgtttagggagaaaagaaatgaggaacatgaacagatttcctgagagagttagagtgaagagtgattaagctcagaacataaaattaccatttatgattagttcagttcaattaattccatctatctatcctttaattcatttatttaatcaaccagcatttgggcactgtgcagtgccctgtggatacagggatcaaagacaccatcaaagaatttatagtcatgtggtgaagacagagatgtaattgaagtacctaaaggcagcatgattttcatgctagggaattacaggtgtctggggcacacaaggcaggcaagtggtgtagggtataggtcacaaattatttgatagccacacagaaaatgagagggggaggcattcaacagtgaccaaaacattgtccctactgaaatagaaaatgtttcctaccctcagggagcttgtagttcttaattctcttagttttagtgcatacgtctgtaagaaattttctttgaaggtatttttagctctgagaggcttcaggaaagtttctagtaataaacactgggtatttaatcctaggactcaattgctagtttgttcaaagattcctgatttgaactaccattcccttctgtgaagaatttcatcactatcatgatttttgctcaaagctgtattcaaaagtcatctagacataacaacaggaaaatccaactaactaatgttaaatttggtgactgtgatatgctcataaatttttccatattatctatgaaatgctgtaattctgtttgtcccaagaaaactcttgcattcctgtcttaattaaatctctcaagccaagcaggtttctgcagtatacaatccattcattcaggtgtgaaaggccggaacctatttacatatttacaaccccgatagctgtgcctgggataaagtaaatttatttctgagttgtctaggttctgcagatattgcaaatacaattgtatattcaagctttctcctaaaagactcattttagggcagttctgaaaaatactggaaatatgaaaatagattttaagctcttggggtgaagatcatgttttgattttggttctctttactgctctgaaagtgctgtgtgtgtgcctatagccctttataaatatgtaaataaaaataaaatatttagctgaactagagtaaagaagagagactcttatgtaatagaagaacatttatgtgaggaaaataacagaatttcagaaaatacagccattgggaaaagagtgttttggattatatacctctaggtttattttcttaacgctcattacaatgggaataatatttgcttgaagtcacagcaatggcctgaaatgaaagaggctaccagcccaccagtaattcaatacatggcaagtagagtaattatagtactgagccaccttatcagtcactaatagtggggaaatagcagatactagggaaggcaaaggaataaagaagcagaattcagagagggataaaacagacacatgatagagcttagcatattgaggagactgtcccatggacactgcctctcagaggaaaagtgatgcaagagagttccgggaatttctttaaaagtaaaaagtatgacagtattaaaagcaaatcatagagataaccatgctgatgaaaagaaagataaggaaaccataggagtccaccatctgtaaggtatagtctgtttttaatatctgaaatgcaaaaagcaattatctgttgaacaagggcagatctgcaaggacgagaggaagagaacagcagaagcctgcagggcagtcagaaggccaagacacaaaatgagttccaattagagcaggtcaccaaggagaaggagaaaaccttttaaaacacatttgaaacaagagcaaggcaaaaggaaatacaggctccccagttaataagaaagggaaacaaacaacgataaagagaagtcttaggttttatatgtatgtatttatttttagattataggcaagaaaaaaatctataagaaattgaatataacccacaaataaaggctcaacaatagttactgaaggaaagatcaagcaattaaaactttactcatctaagttcaatagagagattgcctgtagtgataaataagatggacgagaatattcttcagaagactctacttttctgtgatcctaactgtgactgagttgcagggggttggacaaaattccccaaaccagagacttcacaggctttttgggctgcctcaccctctatataaaattgctagaaatgaattcattgtatctaattttaaatataaaagatgttggaaataatattttaaaaacatatcttcatgcttagaaactggaccatttcttcccagctcaagcagtgatgtatagattagtaatgaacactggtttgtcagttgaaaattaggtgaaataactcaatttcttcttagaaaattcctaaacgttaagctacattcatgtctgtgtttacattttccttatattattttcaattagggtaatataaaaaataaggccagtaatattgttttatatctagaaatatatatgtataagggatagatggtcccatctatcctagtcccttcagaattaactcatttcagtcaacatttcttatgtgtctcatacggatatgtaaccagtttattgagcagtgggataggaatatgaaatggttttgtttctccttaaagcacattttgtgtctctgtagcctcttaattgtgagaagtagaaggaaatggtattaatagtgaggacctgagccacctgcttctaccacgtgctggttgcgtgacctcagaaaagttacttaaccttttgtgtatcattccacatctctaaaatgggaatgatagtacttactttaaagggctgttgtaaagttgcaataaattatttaaatcaattaaaacagtgcctagtatatagtaagcattcagtaagtattagctatagtgtgatctcagtcaatttctatatttttccagtccctgctcagtttttgaatacttgccccaatctcatttaaaactctcatcttgtctcttctcttcttcctagtttagttttgaccctagacttgagggaactgctttaaagaagaaagtgaggcctggtgcagtggctcatgcctataatcccagcactttgggggaccgaggccggtggatcacctgaggtcaggagttcgagaccaccctggccaacttggcgaagccccgtctttactaaaaattcaaaaattgtctgggcatggtggcacacacctgtaatcccagctactcaggaggctgaggcaggagaatcgcttgaacccaggaaccgagatcatgccacttcactccagcctgggcgacagagtgagactccatctcaaaaataaagtaatgaattagtttaattaaatgaagaagaaagtgagttctctttcaatcctctttgaagttgagattcttctggtactgagatagacatttagaacctgtgggaaaaaggcaagagtcctatgaggaggccagatttggggcttctgccacatagatatgatggacaccatagttagtagtaggagaagcaggaattatgtggtaggagcccctcccctggcttttcatgtattttggagattactgtgagaattcctcaaagcatagttccttgacatagattctggcttctgctagacaattttgaccctcacatttcccttaattcctgctaagtggtgaactctatggatgggattctctcaactgccagcccgcagtgttggggaggcactgacaagacagccaggatgctattttctggaagtctctcagctcccacagtattgccctataaaatggtagaaatgcaggctacttcactctagccttagccttctggttatacagattgggatgaccagtgtagcagtgctaacatgacacccttttaataagctctggccctcatcgttggcaggtctttctagaacacagaatacttgatgtctatttggcctcagcatttggggtttgtcatagattccaggacaacaggaaaagttgcccatcaacttgtcatacatattatggccaaggccttgtagcctttcagcttgagattctctcaatgttccattttcccatgttttgatcagtaagaacaatccttatttgggtattacatatctgatttatctcctctttctatctgtctgcctttcagtctcatatatggaactcatttttaattattgacatcttgggaattcccacagtgaacagatgttgcagaatgacttatgtggaaaatgtcaaagattacagtctattacagtttttccagccttcacatatggtttgactccattaaacattctttaatggtgaatgttttaaaaagaaaacaattttttttggttgatgggcaaaagagtaagattaagaagattccaatcactggctccccattcctgtactcctggcaccaggtctcctctcataatatttgagtactgtggatgaatgtggttgaatagaatataatgaaattgactcctcctgtatcactgctcagctctttgcatctaattttctatatttataggagaaatggaataaacagtaggtttggaccccaggtcataacattaatggcagaaatgtaatattacctatggcatttcaggaaacaggacatagactttttataaggcacatctccagactttggtggtgttgggtagagccaacttttcactgggtccttccccaagactgttatccttgaaacaggatgttttatcttgacttaatgactttattccaagagtcacgtggaggaaagaaggtctgatactgtgttatatgtttaatgatttagaactctaagaatatagccttagtttattccttcctttaaaaaaaaaaaaaaaaagcaaagggaaaatacccataaaggaaatttatctaatacagagtgagaactgctttaatttttgtatcatagccaccaagttttggtaatcaaatagaaaagtgtaagaagtcttttcagtaaggcactgccatttctctgggtgtacatcccttatcagctcattacaccaacttttcctttgatgttgtgtggtagtcccttcccaacttaagtctggtgtgagaaaattgggaaatagcactttaatcctggaggactgatttcattaaagattttattatatattggtgatccagccttgctgtcttaagtatggctctgagatgacattgatgaaatttctcctatcattagaagtcaggtctagcacagttgcaacacccagaggcacaggagtgctgggtcatgtcaagagaacacagattaagaattgaaattcttgggttccagcagttcagaaaaccactcagtctctctgggcttcagcccaaaatgtaattcagcagttcttttctgtagctattaattaaggtgggtctcagtccaagttggtcctgtattttgtcactgaggctcacaaataaaatccgttaatactttactaatagttaatagttatagaatatttattacgacctaggcattgtgctaaatgcttcattatctcaatgactctttgaggtaatattttacatatgaaaaaactgtatgctatagcaaataagtgtcctcctcaaagcctggaagtgtgtaaatgataggatcaggacttgaatccaaatctttccggattctgagtccacagttttaaccacatcgataatattgctgttgaatttgagctgtgttcttttattctttttttcaactagatcatttattagagagtgacatgataaagttgacaggtttttagatttatgttgccaaataatatttttgactgcatctctctgatactccagtaaatcttcatgttagatttgagtgctattcacatatatctctgatactccagtaaatcttcatgttagatttgaatcctattcacatatcagagtttcatgttctcgcctagaacaaattatcaaacttatagatgatatcaatagtttaacttatttagtttctattgttcttctgtgtgagctcagttctgttgctttagttctgttcctgctgccatttctattttctgctctagaggcctaagacttgatctgtttatctttgttcattgtagttcatttagttgccaaacttttattaagtgcctctgtcagttagtgttgtaaacctcaaggacaccttgttaacaagtgatttaagattactacctgaagtggtttttatctgttgttagtggggtaataccaaatggaattaaaattcagagaaactgccaacttatcttttaaggaaatggtttaaaccttttcttaacctggaataagtgtagttgatactactattaatagcaagtggtgctattgactgttactctaccctgtggcaagtggttaatgtggaatattctatcaaagttgctgttacactagcacttctccttttcctatggttccgcccttatttgtgatacaacagcagcttcattacaaaagaagaatcacataaaccaggaatggtttaaacaaatcagagaaaaaatgagggaagaaaaagagaagaattcttcttgtaagcagaacctcagctggctagagataactatatacttcttctctttctagccctccccaaattcttgagggaatcttaaaccttggggccatacagactaggtttgggctaatccagatctaatatctaggcacttggccttaggctattcctgccatcattttgcagcaggaaatttctggaattgattcagatttgggcatggggagggattattgtgtgcctaactaacaactgcatagaatgtgcacattatccttttcttatgtttgttagagcatatttacaaagtaagatgagagcaggtgccatcaaaaggcagggacactaagtgggaggtatgttcgggaaaagtggctaaagaattgtctttctggcagcatatcccagaactttgaatatattactgtgtaaagggaatatcttagagacaggttagtgagtgctatggtctaaatgtttgtgtcctccccagattcatatgttgaaatcctaatccccaaattgttagtattaagagatggggtcttttaggaggtggttgggtgattagggttctgccctcattaatggaattaatgccctagtaaaagaggtcctaggagctgccatgaccctcttacacagcaagaaggcaccatttatgaatcagaaaacaagctggttgcttgatctgggacttcccagcttccagaattgtgagaaataaatatctgttcttataagctacccagtttatggcattttgttatagtagcccaaatggactaagacagtgaatatgtgctttcataatatttgatcaccaacatcgtcttcagaaagcaacaatagaaatgagtattcctaggaatactctgtggaaaagaaatattattgtagaaatagatatttaagtggctcccacctacttcagcctggaatgtcatattccctctgtcagtataaattcttaacaaatagttttcatgtatttctggtggagcatgatttttacaaccattttataaaacaagttggcagtgcgtataatgtgtcatgaaagtcttcataccctttaacccagtaatctcaccttggaaaatatatcctaaagaaagaatctaaaatagagaacatgataattttttagtgtagcattttaaacaacatattatggtattagaaacaacttaaatgcccaaagaaaagtaagaaaattgtactatactaaatatgaattataatatagtctcttaaaatgatgatcataatgactgtgacaacatgaaattccttacaaaaagtcagttaaaaaaccagaatatataattacatacacacaatgcacttgtaaaagaagcaaaggaaaattttaccattaaaaatacataaaatgtgtatagtaattatgtttttaataggctgacagatttatgtctgggttttcttccctctattttctaatattttaaaactttctttctgcttctaagtttgacttctgaatgagctagattcttaattttactcaggatatgcaggttccatcttttcacccaatgcaggcagctttcctctgaggagtaaaagaattcctccaaaaggctaaagatggcctaggccttcactgttagaatggggaaatgttagtgtacactttcaattatttgtgaaatctacattcatggatcacagcactctgcttttggtgctctccatgagtcatcaggtaataaattgaaaaatgaagagaagctgacacaaacatttctgttttattttattcacatgagctctttttaaaaaaaatcaacgcagatgagctcttcgctgtctaaagttatttaacacagactttttaacatcttattgaaatgaaaggagaaaaatcaatgataaacatcctgtagatgggacgtttgatttcgatttgcaccaaattgttagttattaaatccattatgaagctctctgccgtttgcttgaatttctcattcttggctgctgaacaagtgcctctgagctttttgataattactgacaacttttttccatagtatatgacttgttatttaaagatgcaccagagaagaaattttcaaaatatatccacaataaatttgacatcagaaggtgtatttgttggtttgactgttgaaacagtaaaagaacaggaatgaatcattttatagtaacacaaggccctttctctctctctctcggcttgtgtccttcggaatatttccttatattatatatccttttcattcttccaaagaaaattgaggtacaagttactaatgtactttggttatacattttccctctgttcatatgaaactttcttcagcaatttggaagtgaccttggctgtattttgtaattctgaaatctccttggggaatatttaaaggtagaacaaattcaatggaacctacatgtagagaaatggggtatactgaggtatggtatagaatatgtttaactgcaaataaccaggagaagcttaaacaattagcagtttatttgtttcccattccaagtggttttgtgggaagtacacatgcagggctggcaaaatgactcaaaaatgcctccaggtgcccaggctcttttaattttcccactccaggatccatagaatgttcatttcatatcatacttttcatctatgatttcaaaatggtttatgcacctccacacatcacatctatatctactaaagatgaagcaggaaggaggatggcccaatgcctgtcttaggaaatgtccccagaaatcttataaagacttctgtttagattccataagttggcaccatttcacatggccactgctagctgcaaaaaaacctttcagggctctgtagagtaaaaaagcagacaggggtctgggcatggtggctcacgcctgtaatcccagcactttgggaggccaaggtgggcggatcacgaggtcaggagatctagaccatcctggctaacacggtgaaacccagtctctactaaaaatacaaaaacaaaattagctgggcatggtgacaggcgcctacagtctcagctacttgggaggctgaggcaggagaatggtgtgaacccgggaggcggagcttgcagtgagccaagatcctgccactgcactccagcctgggtgacagagcaagactccgtcaaaaaaaaaaaaaaaaaaaaaaaagcagacaggggatgggaatggttgtcaatagattctgtctccagtaattgcctcccaaacaaaattagatgtttcagtggtcagatacttaaaattctgaactttgttctcatccatcaagtgtgttgcccagttttcaacaaaattgtggcagggagaggaagaagccagagcaaaggaactgctaccagctccaacctgatgcattcatagttgataaaactaaaggataagaacgtaaaattaggagaataatcctgcagaagaattcaagacatagggtagcctgggttcatttaaaatagacataagaagtttcttatctttacactagggtacaataaaggagcataacagtggcctctgagttttcaagaagaaggaaattatgttcagtattttttctaataaagaggagatagcggaaagatttatcttctgttttcatagttaaaaatgtgatattatgtaaaaatgcaaactctgataggccatctggacaactttacactagagaagagtttctgagacttttagattttacaagactccacctttttttttttttaacaaggaaacaaatatgtgaatgtactggaaaaatttcatccgtgtttaccatcattttatatagaaggtcattttagtactcaaaagaattagccatacaattttaaaattaaaagtctttcagttgaggaaaagttaaactttatgaaaaaaaatcatattttttcatttttttttccattatggtgcaaatgcatgcaaaaacttggtcacagatcagcaccagcccagggatgaatgttgagagactgctgtgaaggattttgaatatctgggatttgcttttttttttttttttaatcttttccaagcatatatgccattcctatttgcttggtagctgttgtgtgttaccagcccactgtcagttacatacatgatgtgatttgttgtgtgtggtgtttctcctctgttgtctgcagtaattgtcttgtttttgggttaaggttgggatggcagacactatgcatatgctatcattgactccatcctatgccaatgtcaaactattcacagaatttttactgttaagactaaaaatgataccagatcctgtctcagcacaacgtttaggaaagccacatccaatccatcaaagctagcacataaaatccctctgttcttcttgagttagatattattcccagaaggccttcatgaaaatgtgcttgttatgtgaaaggggaaacttattgacatatcagttcagaataaccaggttgttacatggcaaagagaggagtaccaatggaataaaatagaagtcaattatcgtttaaagcccttcaaagagcaacctgaaggcaacttctgagtggaggtgagaatactatcaaacgcattggcattgagctcatgcagctccccagctcagatgctcccgatggtttctcatgcactcatcaaatttagtggagccttctcaatctggatttccaccaaatatactggacaaacttcagcaaatctgtcattgatcccagatgttgatgcatttccatctctgggctttgatgcttaagtgttctaggtaggtcattgcatatcagtacaactattaggagaatattgtgtaaatccatctcttaagcaccatctcttccatgagttccttccagaaatctttgcttttttcctccctcctaaataatgtcataaaatgacctttcctatgcttccgtaaggagcattctcaggattagaactaaccacagtgttaaatagaacaacctggaagtgttcaaactgtggtaggacagagtctaaaatatatatttattgtaatcataattttacttaaatccatttaagtaaaaaatatatatgtaaggacattaggaacatgaaaaatagttacccataatcccagaaaacaaacgcattgacattttgttgcatttctttcctgactctttttttttgggtgaggggagttctatatattgttatatatttatatttcactcacacaacaagtacttattgtgtgagtgctatatgctgtgtgctaggcacacttttctagacaaatacagaaacatgtttgttttcatgtaatgtgattttatattcatatacatgcatatgtgtgagatttcatagtttctgaaacatcattcaacattagtgtacgcaagtttatacaatattgatggattggatgtggctttcctgaatgttgtgctgagataggatctggtatcattttttggccttaacagtaaaaattcttgtgaatagtttgacattggcatatgatggagtcaatgatgcctatgtatagtgtctgctacctcaaacttaaactaaaagcaagctatttgtgttgttattaatttttcaattaatagatggtatgtatgtttcttacagcatttgattcatattgacatatttctttccaatacattagacacttttttttttttttttttttttctgagacagagtctccctctgttgcccaggctgcagtgcagtggcacaatctcggctaactgcaagctccgcctcccaggttcacgccattctcctgcctcagcctcccatgtagctgggactacaggtgcccgccaccacgcctggctaattttttgtatttttagtagatatggggtttcaccatattagccaggatggtctcgatctcctgacctcatgatccgcccaccttggcctctcaaagtgctgggattgcaggcatgagccaccaagcctggcctagatacatattttacctctattagcgatacctgacaaaaaaaagctggcttcattgtcccttaacttatattttaaattaactcacattttatagggtaaaaacatgctacacaatcatagtattaatttgcttttgtttgatttctaataaggatgatgtttttaaaatattgactagttggaaattgccaacttttatggatttaaattacccctttctagattgttcttagttattctcccattaataattgtgttctctttaacaaggatggcaatctgttatttttacatattttcaaacattacagttcattctttcattttatctatgtttttataacatgcaaaagcttaaaaaacaatttatgagcacagtgtcattgcttgtcctctttgtgatttttctcttctacagtaattataaaaactcttcttctcttcagagatttgatgaatatccaacttcagtttttcaatagtttgttttaaaaaaatatttaagtatagtccagccaaatctgttttggtaaatgatgtgaggtgaggctctaaatgggttttccctcaaattactaaatatttattaaaataaaatttattgaataattgatcatcccctgtgatttgtgttgtactatccaggatttaaattttacagagagtacactacactctctctcgtcaaaagaaccagtttgaaatctaaaaatcaaaatacttcttaaaaatgcaaaatattgtgatattcatgtctaattcagggtatacatggcagatattttgaaataactctccaagtagagaaaaacattaaaatcactattgtaccaatttcagaatatgctttcaatgtctcctttgtagacagaaactttagactgccgtacaaatgacagggtagcttcagttgtgcaagatagttttcagcaacattatggagtcatactataggcatgaattattagcacaaatatttattaaataactagaaggatgttaatagtaatattattggtaatagtgtaaaaataaactaagcttcataaagaggaaactctctctaaaaaccaagcattacataacaattattaaaactgattttagaatgtcaataacctgaaaatattcatagaatattattaagttaaaacataaagtagttcataaaagagaaggtacagtatgacctcatattggtaagacaaaaaatatatagtgttttatgctcaaatgttattttttctatgtaaatcagaggaaaaatatttgaaatatctctaacacatcattatgaagatcacctaattttcttcatgtggatatagtatatatctacataaacacaccaggattaagtagctgcctgcagtagttcttaccttgattctaatttctaactatacatggacaatttgcattaggggaaattactttgaagaggttggatcaacagcataaaaacaccagattttactttcttaggatactgggtttttgttcaaacagtaaagtgaaactcaaacacaaacctcctgtcttcctttgtctgtgccattaacaaaattttgtgataaactttcaggaagcactcagcatcctctcaaacacaccccaaaacactataccattcatttctaagctaagcagaagaaaggcaaaaagtgcatcccaataaaaaaaccttggggtaaatggttatgttgaagtatccatgcagaatctcttgttgggttttttgccttgttcttaatgtacttcatggccactgtctggagttacggatcaactgatggccacaggaacaaggcactcagtataatttgtttggcctttaaaaattctgccctcataaaaactgtatttagtgtgattctgctatttttgtcattttgtatttgctgaccactagagacattgatagtattctattatgccaggtaaaatatcctgctcttagagcaaaatattttaagatagtggtggattaacagtgcaaaagaaaaaatgacgagtaaggctctggagttctctagagatactaaattttcctatggaaagagccctcacgaatgtgacaaagagaatgtatattttatttgggggatgtaggaaatctttttgcccagaaagctagtttttacccactgactaatacaaaacatgactaaaaagtaatctgagaaatcccacaagccacatgtgacaatcagtttcatcacgttatagtcacatctcatattccctttatctcatgctgtgccaatctcagaaagggccactggaattggaaacaataattgaagctttgaattcaatgccaaacagtaatgttaatattccattttgttagcattatagataagggtgatggtggggggtgaggaaagcttatatttttgtgaagtgtatggaaaactagtatgaaaggaaggactgttatggtgaagatggaatggaaaaaaaaagaacagtgtttcattttaagtgttagatttacgcataagtgatattaaaagtatttaatatcccatacagcacagaaaatccacaaattcagagtaggtgccagagctgccagtgtcttcaaggttgtctgctactaggcattaacatgccaaaggtggactgggagaggtctgggaagtcctggacagcgggtgagagcagccctgaaggtgggtgctactcagggatctcaggacagagactattttccagtcagtataaaaatatatcaatattttaacaactggaatgcatagaagaagctaaagttatttcagagaatttatttggggagttgtgcccaggatttcagattcccaagtattgttcagagcttagaatccaaatgtttttaattttgagagagttcttccaggaatttcttgctgtccctttttttgtgagtcccaggatcctcggactgacctttcagctgactttggttgctcatgcttcccggcacaagtcctaagagaggcaatttccattggcctattgaaatgattaacaagatcattttcatgttgctcctggtagaaacagctgtcaagatagtgaccttgtcctaggactgctggcctcctctgaatccctcctctaaggctgatggcttgtgcccacagccacctatcagtgcttctctttaagttcctgagcagctctaatagccatgctgagccccaaaatctgggcctgacttggaggaaacaccacttaccataggcacctttttaaattgttcattaaaggtgtcaaaacacacatttgttccatggacagaaaactccacttgccctaggaagatacactcactgacaggccctggtgtgtgatgctccccgccctgcgtccatgtgttctcattgttccattcccacctatgagtgagaacatgcggtgtttggttttctgtccttgtgaaagtttgcttagaatgatggttaacataaaattcctttaactttgtcagaaggaagaagtaggagaattgatctccagcaggcttccttaaacccgctaatggcttcacctacatttgtattttaacacatctgcccttatctaatatttggattttcatcttagtgttttgtttgtttgtttgttttgtcacttttgggagcagagatcgtttgtttctgagcatcatttgttttctacagaacatatgcctgatttaaccgtaaataacctgctctataaagtaagtttccacttattttctctctctctccctctctctttctcattttagatagagttttctctaccttgcccagactgaacttgaactctggggctcaaggtgatcctccagctcctgaggggctggtgattacaggtgcatgccaccatgctcagctcttatttgtctcattttttcttgggaagtttaactttaagccaccctaaatacgtctccatgatttttacggtcgataaaattgtttccatttttaatcaaattgaaaaaatattttattttaaaatgttttcctcaccaagcttttttaaattatttatttcttttttttttaaattatactttaagttctagggtacacgtgcacaacgtgcaggtttgttacacaggtatacatgtgccatgttggtttgttgcactcatcaactggtcatttacattaggtatttctcctaatgctatcccttccccagccccccacaccccgacaggccccggtgtgtgatgttccccgccctgtgtccatgtgttctcattgttcaatgcccacctatgagtgagaacatacagtgtttggttttctgtccttgtgatagtttgcttagaatgatggttaacataaaattcctttaactttgtcagaaggaagaagtaggagaattgatctccaggtgaggtaattttataaactgatgattacacaaaaagagaaagaaaggcggcacaagtattacacaaaaaggtagagataatgataaattctgttaaaattaatgtagggaaatgcaaatcactctgagaaaaatcatagtagaaatatttctgatagatcgatgggatctctttttaattgcttttcagttctcctattacttgtcttcctaggctttaaaactttaaaaataagcaaagaataggaatcattttccaaaagctttcaaaaatctgacattgattcattgatatacaacccattagcctagaatttcatctcttcatctatcatttcaattatcccctgatttctctggggcatttgataaatgggagaccatttacatttggtgcattaatgaccttggtacattttgaaaatgtgtcccctgcccccattatatatgtatgttttttaaagctacctactaggtcttcaagcatgctaagggacagaatgacatccatgtaactccattacttggacatcattaaaaaataaaattctgaaaatgtggtgtttccatgatgatatgatgttattacatctataaaaataagtaactatttaagggttaaaagatacctatagaaaaagaagcagaaggatattgttccaaataaatgtggacattttggttttcttccacttttgagtctactgcccaaagcattttatattagagttcgttacaaaacaaggtgtttttgttttagtggtgatttttttaatctatttttttttaccatggtgagaaatttgtttttctaaaatcctttgttggcttgcccccaaatgtacaacaaccaaaagccacattatatataagatatatagtaaatatattgtttatataaaatataaagtatatataaactatatatttatatataatatattaaatattttatattatataatacttaatgttaaatgtttacatatgttatatattgtgtgtatgtttctttcagggaggggagggtggtgtggtagaggggcacaccagtaggctgtgctctaccattactctagcagcctcagatgaagcagagatgctccaaatgaagctgtcacccggttttcttgaatataatttggtcatcaagatatttgaattggaaacactctggaagaaataagtgtctactatgaaggagctattgggcatttctactgcctttgagctcccaaagtttaaattttgtgagcaatagttaacagtctagttctttaagaatactatctctctacagaatactatctaactagtgtgagaccctggctttcaattttttttatattatttgaaacacaccaattatcttcattgaaaagaaatttatatttcttcaatgaacttatatcaaatatgaagaatcatttatgcttttgtctcttttcctggttttttgtctttgatttcctggttaattttgtgatgttgcttgccacatctttgataaaataaaattctgtaaaataagaataaacatatttttgttaaaggtgctttgaaattattaaataagagatttgagttgaacactttagagaattggtaaatcaacaacatttctgagaaacaaaagctattgatatttttctttgaatgtaatatttaagttcgtatctcaatgcaagcgaataattttagggctaaaatagtagcttacaggtcagttaattcaccatcttcactcccttgtagaaactgagatatttgaggtaagactgtgggataatatttattactagacaaaagtttctttataactttgtcaaaatccagaaggtaatggttggatttgacttgaggagaactcctgagtttcagctctgtttcccagctcttcaaggttacagtctagtctgttttgacagatggctcctttatgtccagggcctctgagcggacatgtgcaaacctggaatgcactagaaaaggtcaagtgttcattgcgatatagccctcaattgttatcttttcggatgacaaggatatattctatttatctatatatcttctggcacctaacacaatgtttagcacatacaaggcacttcataatttttgatgagtgaataaatgagtgaaagaatggctgaatgaatgaacactttgtttacttagaggttactagagccatttacaaatcatatgggaaatactcaggatgcagatagtaaagaaaaaaaaaaagactcaatgccagtgagccacagaaattaaagtcaagagagaaaattggaaatcatgagatttatttatgtgggaaattttaatttctgttcaggtaactcagatttacttctttggcttttctcttttgggacaggcgtcaccggagcaccagccaaatgtcgaagttgggaactgggttctttattgttaggcgtagactggtacaagcattttctgccagaagtatcagttgaaatctgggcccaaggggccagcctaggaaaagagaaaaggtgaggttcagctaccagaaaggagctgaacaaggagccaaaagagagaatccaggtcaagaacacaaaactaagattttaagttctgttagacacagggatcacagtaaagcagactgttaacaagcaaggaggaggaaaaggtaaagagtcctgaacagttgcctcaaatttcaacctattattttgtctcaattttctgaactcaccgatgaggtatgtggaaagatcaagcagagttgacaaatgttttcagacttgctactccactgatgagcagccttgaatttccaattgcatgctggactttctcccgagtgtttctttggcactgcatatttaacatatctaaaatgaaaaataacttcccttgtattttattgtcagaaaaaatagtccaagattggaaatgggtgaaaaagattatagggtgtctatcctttcagtggagcgctaagcatttctgaaagcttagaagttaagttgttagaaaactgatagccatgcaaatgattcctcttttgtcccattgagacagaattgatttctcctctatggaaaagatgatccaaatcactgtattgccttttacatgatatgaatcagcttggcatatattaggaaattatttcaggattcctgattatctatgtgtgtgtgtgtgtgtgtgtgtgtgtgtgtgtgtgtgtgtgtgtgtgttttactggtttgttaataagttgaataaaatctttaacatattcaatttgcaggagagtcatgtttttaactttttgaaaattatattaacatccttattaactattaatgtttccaccatcctaaacgcttggtaccattgaactttctacttctctggatctccattatataatcagtttccaagttaaatgctcttcacttcaatccctttttcactgttaatgagtcagtttgagtccctgctattttgcactaaggctgatccaatgatccaatactctccaaagtgatcttccaaatctgtctcccacaccattacactccaaactgaaaagccaaatctttccatttaaacctaggtcattgggacttttttggctcaaaaatctcatttgacttcctattaactaacaaatccagtccccaaatgccagcttcttaatagagatcccagttaccttcctaggcctatattcacttggattagtgagctagaggtgccgtaacaaactaacacagatggagtgtcttaaacaacagaaatttatttccttatgatctggaggctagaagtccaagatcaaactgctgggaggattgatttcttccaagggcctctctccttggcccatagatggtcatctctgtcagtgtcttcataggttcctccctctctgtctgtctgtctgtgtcatattctccctttctcataaggataccagtgaaattgggttaggacccacccatatcatctaattttgttttaattatctctttaaaggccgtatttctaaatacagtcatgttctaaaatactggggttaggacttcaaaatgtgaattttggaggaaaaaatttagcccataaaactcctaaagaaagaaaataaaaatacatgtttgttgaatgcataccatgagtcaagcactgcattttatactttcacataagttaaaaaatgattgattcatttttcctgaattatcccaatccagattttacttgtaatatatcacctcagctaagattccttccttgttaagaatcctggtgtcctcctctgagaggacacatttttcccttttacactactttcacattcttcctggtttgatgattattttgtactttattttttccaacaatgcattattaattccttgaagtcaaggccattaatgactcttagaatgcctgtgaagtatatgacctgttgttcagaatataaatatttgttaaataaagaactcaaaggaagaagggaaaagtttataaaagaaagaagggagtatgaccaaggttttttggcaaggggtggatgaggcaagggaaagaatcatgaaagatgttcgagaagaaccaaaattataaggctattaagtcagaggttagtaatatatcacatttggaacctagaggttctaagactctagactttttatcttttaattgatggtgttcttagtaaattatattccatttaaatagcttcacaccataaagataaatgttttaattctgacatcaaattattttagtattggtcctcatttccattctatcaccttgttttgaagatctgctttcagttagatcctttgtctttcacaatcagctggggtgtggcttaggaggacaacttaaatgtgttctgcaatttgccgatttggtctggtttttgaagcatgaaaagatttgaaggccccagctaatgtgtattacacatgccacaccccctcaactatgtctcagatttgtgagggtgtgatctataactccatctactgttggagtgctgggaagggaagagcatggtccctttaaataatatggaaggctggaagggaagtgctggggagaggaggacgtggtccctggttagggctccaaccccatgggcctaggtgaagacaggcacttctgccttccaacccaaatgttgcattttcccagagcaccctgacccgccaagcccccctcctgtgcctataaaaacctgagaccctagcaaggcagacagaagctgctggactgtgagagggacacattggcggaagaagacaagcggctggacattgagaggatgttgaggggagcacatagacagaagagcacactgaccaaccaacacaggcactctgccaggccatcaaggtgctggaagaggcagagtttggccaggagagctggggctgccgagtggcccaactccaggtgaagatcccctcccttctggctccccatcaggctgagagctacttccactcaataaaactttgcactcattctccaagcctatgtgtgatccaattcttctggtaaaccaaggcaagaaactccgggatacagaatccctctgtccttgtgataaggaaggggttctaattgagctggttaacacaagctgcctatagatggccaactaaaagagcaccctgtaacacacgcccactggggcttcagctgcaaacattcactcctagacactgctgtggggtggaagccccatgacctgcccgtatgtatgcttccctagaggtttgagcagcctggcactgaagaagcaagccactcccccatcgcacgccctgccagggggacaagggaacctttcccatttcactgtcaccagactgtgatattttttgctgtgaaaattcccaagacaaatttgtttctgtggcacatttaccattgtaacatggagctatagatatgatggcttcagacatatcagccttagcactttattatttttttcaagtcttaggctgctgtgaaatttttagaagtttctgtttccctggattatttttaaaaacatcaaatcattcctttaatagagtatattattattcagatcttttctgaaggaaagtttcatctgatttctaaatttaacggtatgcccttatctcaaaatttcagtcaccatccacttaccatgtacttttttcgttattgaagcattccagatgcttcctttttgaaaaagaaaaaaggactaaatttaacggtatgtacagagactattgtgtgtgtgtcttgggaggagtataaatatgagctcccattaaagtaagatcttctaaattgagaattgtaagttgtttttatgcttccgttcgtgtggctctgtgctgtgtctgaggaacataggaatgaagaagacattgtgttggctcacaggacgtctatagtcacctgaggaaagatacaaataaccaagtatgagttaactagtggtttccaacaaggaacgactgtacccccaggagacatttgccagtcgagatggggatttacagcaggaagttagatatataaatataaagattagcagagcactgggctaaagatatatatatatatggtagtaataacacaatagttcttgaaatcaaaagactgataaaattatccagcaagagtgtgtgggtgatgaggacactagatgagggacacctgcaatcaaaaggatggacacaaaggaataccaaagataactgaataaaataataataatattgaacattttgtagaacccatactatttttaaaaagttctcctaagcacttatatgaatgctcataattagcctgttattgtcagcgtttttgtataatgattgaagcaggaatcaacagtatcaaatgcaacagagacatcattacaatgagtactaaaagtgtccatagatctggcaattaggaggtcattggaagccagagcccagtgggtagaaaagtaaaatgttgatgggcaagtagagaagtttaagccaaaaaagtttggattaaaaggaaaggaaaagaaaataaatgaccatgttataatgggaacaaactaaaaagaggtcatgtttttcatggtggaagacatggaagaatgtaagaggagcagccatcgtttatacacctcgaggaaaccgaagaagatgccttatcaactctgagaggactgggaagtttgacaaaccaggacaggcaaagagacataagaggtcatgcttgggcctcaactgaaattggacactacttgctctgtccgtcagtccaacaactcctttttgaaatctctctcctgataagttggacttatctgaactatgctttcaggaggacttttgcctgtctcatcttcctcacttatcaggacaacattctacaaaaccaaatcacagaaacagtaatactattatctgcctcctttactcctaaaacccagggaattcaatgaccagtgaaaaactgcacactgtgggacacacacaggctatcctgagacatgagggttccccaaatgagtgttacagaatttgctaattctttgtggttgttttagcagagcatgtaaatgcatattgaacacttttttccattaatgcaatgcttatatggaagaatatttttccttcgctgaacattttcctacttctgtatcttagtctgataaaaatatgttttccatattatttctagtctctatcatttattcaactacaaatactgaatatctactatatactaggtgctggtttgtcagatgcacacacgctgtgacactagaagagctcacagtctataggtaaaacagatagattaatagctatttaaaatggaaaagtataagtgatttaatagatatagtaaatgattgtgtaagctaatgcagtaagtaactataccctccctcccccataaaataagttttcttctcaaatactgactcactttcattttttcaaatggattgtcaagaatagaaacaccccattctctttgcttgatgaattttttttcctgtttctttctctcttttctctttggttctcaccctgccaattctctgcaggtgctccttttatattctgaaatcccagttaagggactttctcactgattataatgacataggtctgttttcacagctgtaattttaaagtttcttaataatgcaatgttttaaacattattctgaaatgctagaaggtttcagggtgctcaaaaagtaaacaggctcgtataaaaagaagggaacagttataataaaaaattcaacaatttgtatcagatcattggcacttcattgaaaatctcaagctcttgagacaacaaaattttcccccaaggggaactaattcactagacatgtgtatacattagaaccagatgaaggtgatgcagtgaaattggaaagacaattcctgggcttattagaagctggagaccaagtatttgtatgtctactgacttctttggccttggcaagaatcgttttcccaggagagcagatttggggaatttgcatttatgttcatgatcacctttgacatctgaaactctgaggacttgacaccgagtattactattattataaacagagctcccaagctgttaagctcaaactgctactttggtgttaacaagaatgggtgccacatggtgtgcatatgctgtttgtgaaagtaaatgatgctttaagagtgttttactctcaaaaggaagtctactaggcagatagcttgtattgaaactctgtatatgttctcatttgaccatcataaacaatgtttaaagagccaaggttgttacttgagaataaatcagggagctctggaacatttgggtggatatattcactacaaagcattagagacatttccccctatgtttatccttttaaaaatgtatgtatttcacttcaggtctcgatagatctttcagattgtatcttaatagagcttcctcagcacagaagtgatttatttctttcaatggaggatttacttgaatctactatttaggaatttagcataactgggtatagaattcctttaccttggatagactaaaaaactcccaagactgatttaaaacaatttaaatgttgaataatgctatttccctatgcgtttgctttgtgagttaaactgatgaagatttaatcttctttttcacagtttcttttgtctataaaactaaagatccatttttataaaagatttttctttactttgttttagaaagagatttgatatctgaatggtagtggtaatgaaattctctgtgggttaggctttgaggaagaaatactaacgtgaaattaatgaaatattaacaaataaattgagttcataatggtaaccatttccctatgttatatgtgataacatataacttatgtatacgtagttttgagctttgcatctgatcactcttagccaacaaatcttttctaaaaataaggcaactggggaaacctataataaataacttagcaaaatgaggcgatgaacttttcagctaccataagccttttctccccctttaagtaatgtattttatcaggactgaaattctaatgtatgataacctgaaatttgagtttaaaaatgaacacaactgaaatataataaggcatttttcatctcttttaatattttatatattctcattcttcatgagaaatggctgcagcacgcaagctgccaggttaatcttgcttaaatttggcaatcaacaagtaactttgtgcacaaactgttggagtaccatgcaaggcaagcaaaggagtttagatttgatgcaataatagagggagagctatcgacagagcaagagaataataagatgcaaatgccttttaaggacaattagtctggaaaccaagaaaaaaatgggcttggcggaatgaaaacatacagacaaagagacagcatttgtatcatgtgaagaatctggcatcaactcagaagccttctttttcacctggcgtgattcaaagtaaattacagtgaagaaaaggccattaggctcacaataaggagacttggtaacttgaagaatgtatttttaaaagtatggaaatagctgtcaacatgaggggactttgaaaaggaagttactggggatataaatagatgtaatgggtataaggaatgaagcctgaggcaggaaacagaaaaataatttttaaaaagttgccagaggaagaagcaacattatttccagtttttagaaaagacatgagcaattcactacaagagttatacacaatgaagatgagtatgtttcaataattaaattagtgactttggggaaaaattcaaattgctgagtagagatcctaaaaagtccattccctaaccagttaacttctaagcctagataattcactattaaatatttaggcatatcttatattttgggattcagcaaatggttcgatttcctatgataaattttgtaaatgtgtttactttcccaagtgacagatatttcacaagggccataagagaggtaaatggggagattctttggtttccctttttaaaggcaggaagcagccagttcttggtttgcataaagaaactggaagaaaagcacagagataaaatagaaatgttcactaatattttcatgagtcaagttttatagccacagctgtctccagcaggaatggaatttacagtgtcaatgggtattagaaagagatgggctggaggaagaagattggaaggatgggcacttagcatgtatgcagaagtgaactaatctgcctacatagcaggagctgaattttataccaaaactttctctgcaattataaaaggctttagatgtttagtttcaaagacatgcaggttgaccagcagtttaaagagttgtgagctactggataatgatctcaatccaactactttcctttgcccaaatagaattcttcaaccatcagcagtaattagttggcttttagcttttgggcaccagacaatggatcgtgatccatagtggctatcatgtgggagatgaggctgcaggtgaaaggtgaaaggaacttttcacttcccaagcttccaaaaagcaagtgtcttctcctatttttagcctgctatattaatactatatgtgtgtgtttatatgtgtaggtgtatgttctaagtcacatttctcttggttacttgctcctttttactgaagatcatttacatttggatctatcatatgccaattctagttaattatgtttatgaaagatcctggtcttagttaatgaaagattaagaacagtgtctattttttccttttattatggatctttactcttactgaaattttctgttttaaaagtcaaaataaaatttagcttataaacagtttagaaagtttatttttctagtcttttctagttatggaaaatgtaatatttgaaagacaagtatctataacaaatcaaattgatgtttaaacacaaaagatacatttgccaaattgcttctcctccctgatgctactttagggacatataaaacaagaaatggaaattaatttttatcatgtgcatgtcggtttccctttctctgaaattcactgatttctttcaaatttgaacactccagcttttatctcttctggtcttcagtgctagactcccccagcttttctccagttctattgttgtgacagtatcacaatttactttcttcattttgaggatttgtttgtgttgttattcctattttttgtgaaaggaaaataaatcttggggccccaaaatcactaagctaaagggaaagtcaagctgggaactgcttagggtaaacctgcctcctgatctattcagagtcacacctctgctaactgagataaatgcatagctaattgcctctttggagaggctaatcagaaactcaaaagaatgcaactatttgtctcttacctatgtatgacctggaagccccctccccacttttagttgttccaccttggcttggagttgtcctgcctttctggactgaactaatgttcatcttacatatgatgattaatgtctcatgtctccctaaaatgtataaaaccaaactgtgctctgaccaccgtgggcatatgtcagtcatcaggatctcctgatgctgagtcacgggcacacatcctcaaccttggcaaaataaagtttctaaattaactgagacctgtctcagatcctcagggttcacactgccctgtactttatgggaagcaagccagcaagtccccttagtagttgatcgtaaccttggcctgcaatatcatgatcagcaaatgatgcatcattaggtgtcttcgactgagagaggagcaattaccccatgacagcaggatcagagaaatcagactgatcaggataaagaacataacaaacagttgggagaacatgaaagaatatatacatacacagcataaaaaatgtaagtgcagttaaaatatcattacactaagaatctaaagaattactgggtttcagctctgccatttctgcttaccaattcagtgaccatgagcaaatgacaacttcactgagctacattttccattttgaaacatgtagaccctaaagtctgccaggattatggtaaagaaagcatgagtccttatgcaaagcatgtgttgaatactattcactcttaaaaccatattatgctggaactgtgaaagagaactaaagctggctgaaggagggccatagggaatctgattttgtttccttcctccctgtatagttcaggctttgcaaagtagtttggtttaaaatctaggtgctattttctagacagagtaacaatttctgtttactgcttttattggccaggccttgcctcccaatccagacacccagttctcattcgctctttaaataacagattatttcaggaaacaaagttatttttctctaccttggaggtggtcatggtggtgttcttgcccttgctcatcttctaagttaaatacagttacccagcccaacacatcctcctgatgacctcatgctgaacctacttttgagcattgttctctgggctagcaatcatctccagccttctcaaagtgtcaaggcagcgaaacttggggttcaagaaggttctcaagttattgaaagaatgttcttcacatgtaatgggttggttctgaaggtggcatagtaggttttgccccatttttctttcatgtatgccatatttctgcagctaaaggtgagagtattgaaaaacattaacataaaactgagagctttgatttttatcttcatgtttaaacatctaagggataacagtaaagtaagtatggattactatagaagactcttgtacatttcagttgccatttctgcacaataatttataccaactcttaaactacaaaacttgtttgttcctttattaatttatcagctagcaaaatatgtacttgctgtgacactagttaaattattcacagaggcacatgttctattaggccctttttttctggggcccattctggtgattttaagaagccaagataggtggcttgaagattttgacttttgcataaacattgtaagagctcattcattctcagtgctgttcctgaaacttcatcatttctccctttgtgaatattatttgatatctgatcgtctttgaaaaaacagttttctttgggccccttagctcaccagtgtcctctgaaacaacctggtttccttggcatctccccctcaccctaatttctctctacttgttgcctcgtatccagcaacctccaacttattgatttggcttgatttaattgggagcgccccatacccaggacaggttttcccagtggcagctgggagtatgaatctaataggcctggtttggttctgtgaccctctgtcgcccctttctggccatagcctgtcactgaagtttaccctctggacttgataatacagacagcagccgtagtacagaacagtttgcaaactatcagcctgtgtgccaaatcagcccaaagaatgctttgtttggttcgtataaattatgccaacatttaaaaattagcagacatattagtccattttatgttgctgtaaaggaatacctgaggctgggtaatttataaagaagaggtttattttggctcacagctctgcaggcgatacaagaagcgtggtgccagcgtgtgtttctggtgaaagcctcaggaagcttacaatcactgcagaaggccaaagggagcaagcatatcacatggtgagagaaggagcaagagagagaagggagggatcccagattcttttaaacaaccagctctcacatgaactgccagagcaagaactcactcattaccaacgagatgccaccaagccattcataatggatctaccctcatgacccagacaccacccactaggcccatatccaacattggaggtcacattgcaacatgagaattggagggtatacacatccaaattatatctagagatttcagggccaggtgtggtggctcacgcctgtaatcctagccctttgagaggctgagacaggaggattacttgaggccaggagttcaagtccagcctgggcaacatagcaagaacttatcttcacttaaaaaaaaagtcagatgtggtggtgcttctgtagtcccacctattcaggaggctgaggtgggggaactgcttgagctctggagatgaggctgcagtgagccatgattgtgccactgcactccaggctgggcaacagagcaaggtcctgtttttttaaaaaaaagagattttatataaaatttacagcttctcttaacatagcagaagatctgacaatcttaggccagctttcttcttgtggacaatcttactcttgcccaccactcatggtgtagactggtcatttgcatctagtgcctgcttcactcatttctgttgactgccttgtcccaacaggcatttggactcccaggtcaagtacaaaagtttattcaaatagatgtggtttatttgtgtgtcttggggaggaagaatgatatctaatttcttttatgaatatgctcacaaaaaggaattagaaatcagattgagattctttagtacatgaaggtgaaaattgggtatgttttcttcccatttacaatatatttgtaccaagattcactttttatcaaagagaaacttttctgcagtttaaattgtaggatgatggagttctgaatatcttaggtaacattattatatggatgaatatatttgcattctatcaggttgaatatagaaaaatcattatatacagatgttaaagaaactatacaaagtactaatgtataaggagtgtgtgtgtgtgtaaccgtctaatgattcatgttttttctcttttttattatacttaagtggagtttccagggcaaacacaggtatacagtcataatgataaattatgtagtttaattcagcttcaccaatgataactcagatgccattttcaaatgcattgtgagaacggttttttcacgtttgcttctaattccagcaaaaacacctaattatagaacaacagtagcaaaaaataaattttgctcagggaaaaaggttttatgagtaatcagtgcaaagcagaaatctcttgctgcgaataatgtgggccagctaaggtttctgtgaggttttttgctttggcgtggtttggctttgtactgcctgggtgacctcttcttctcatccatcacttcatcagaaaatcaaaagacagcaagctcctagccagactcttgttcaagataaactctatgacctcctaacaggttactagatcttttatgggagttcagctgaccacatgacttcttatatttgagaacttattcatgagccagcaaagctctggctaatgtcacagaacttgacagcactagtgctgttcatggcttcatctttagacatagctattctatcctgttccctttcagaaactcaaatgaagggccgcgtcttataatcaaacatttcagataaaacagcttatttttccctgagagcatatgtgtcttctattaatcctaatcaactagggacagactgaaaagaacactctaataaggtaatagtactgagtattttgctgtgacatcccacaaaaatgagttttctgtgggatttggggaggaggtaaaaaaatgaccaagaaaaaaaagaccttcaagaattaaatggcttagagataaagcatataaaataggaatgcttttattgcttttgtattttctgaggacaattctgccagtgaatccacaaaattgtataaatacaaatatatcacatttgcctgctgtgattaaatttctctgattacacaactatacttgatacacgggaccaatgcatcattttttttttccttttgtaatcattgttatatccacgcttataatcaacattcatcacagctaattagagtttctttgtctgttgtttctgagatctgacattcctagagttcaactacaaaattcatttttaaccatctctctgcttggggagttggaggaagacaaatgcaaattccagggctgtattattcacgaatggctttctgaaattttcatgtactatgatttttttaattgaatttaaatgattactcttggagccggagaccaagtcctgcttaaaattttgcaggacactcctatgatttgtaggtacattcctattggtaaaagaagctggcagtctttcttgttaaagattttgtagatttatatagatatcaaaggatatatatttttgttgcattagattgacattaatttctaaaaataaaatgctacagatttacatcacttaccagttcaaagcttttgttcactctcaaatgctgttttcttctagcaaatgtttttaattatgcacactttaaatgtgaaattacagtaataagaaagctagttaaactttagctagtctattacaaacaaatttaatctactttctagatgttaatttgagaccagagttttccaactcacagctctgttgtctcacctggaaattccatctcctttattaaaacaactgtaacctttaaagctttgatagaagaataaacctaactgaaaatgagtcactatggtatacatcctaccttctttattttgtgttgttctactttgttttcacaattttctttaatttgcatttttgttgctgctgtttatgtccatactgtggactgagtcattcccaaataaacaaaccaatattactgagtaaccatttcagttcctgctcttgataagttcacagtactctgaaggatgtaggtatgtgaacacataattaaaataaaactggaaaaggtctattagaaaagacataaagcaatggtaagtttgaagagaaaatgaaaaatcagagagtagtggtggggggctttatagaagaggtgatatttattctgagacttggagacattaatggtagttaaaggttatgaggtggcattctgtgtcaggcaaggttctaagcaattaaactgtagtaattattttaaacctcaagaaaatcctatgaagtgctatatattacgcccattttatagatgaggaaatggaggcatagaaaagttaggtaacttgaccaagctctctgtgccatattttattttccaaaaatggctgtaacaatctctctctctatttaaattcttctcaaaccttgccattaccacagtaaaaggggaggtctaggtcttctgcttgaattgtattggtttgggactggcatgaaacctacagaatgtgtcagaaatgacaagaagtcacttcaatggctagatcaggaaagaagatacaacatccaccttaatcactggaatactgctggagccccaagctgctatgcttggagcaagcccaaagtagcctaaatgagaagccaccaggggaagctagagattgagagagagagagagagagagagagagcgagaaagagtaagtgagtgagtctgggtagccctcaaaagctctaattcctcactgcccttccagctccagccactgattacaactgcatgagagttctggagccagtaagtactgcctagcccagcctgtcccaatgtcctgacccacagaaacagtaagataacaaaataatcattgttttcagtcaccacatattggggtgatttgttgcagagcaatatcaacagaaacagttacacagttaataagtgggaaagccaaaatttgaacccactctgactccagagctcctctcctactcctatgccagaaaacaagtcttaagaagatttatggatattccttcaggtttaagtaaaaaccttcatgttacatgaatgtgtgtaaaaatcacttcttgaaatcaatattcagaggcacagaaaatgtttttgcatagtgagctcttccttttatgattgaaaattaaatgaagtaagaataagagaatgtttaataggctcataaacatgtcagttgtcacaattgcaaaagctgactgtccagtgattgggtagatatatattgcatcatctgggtaatgacttcaaccatattaaaataatatggctgtttagatagggaggggaaacaataattttttttaatgaggggcaataatttctaaatatgtagcttggagtagggaagactaaagctactgtggagccagaaagcttggatttaatgattttgaattttaatattgcatttgcttggtttacagcaactcgttgaattgtatataccacactagccagtaagcttacttagcatgagaatgagggcttatcttttataataatagtgaggttgatccttggataacctgggtccagcatgaagatgttttataaatatttactaagtgaaggaatgactataatctcttagaccctaagttttcttatttataaaatgtaactcactagttgagtttgcttgtcataccttagaccaggaaagtttccaggacataaagagtcttgtacttcataaataaatgaatttaaaatgtatctccttgacatgttgaaggatagataaatgtcatgtttaaaacaaatattattcgcactaatgtgacatctgttcctaccattgtcttctaatgatgcatgaatgaaggaggatttgagaattcagctgaaagatagatttaggacatctccttttacttcaggctatagaggctcatgtgattttttttttaatgctcttgtgggatacaagtttctcaattatggctaccacaattggaaaagttatattccactattattaataataagacctactctacctccctgatgtgtgaagttcaaatgaaaccctaaatgtgaaaatatgaagcaaatatacaaattttgattatgtgaaacaatatataattggtaattgtaattattcattataactaatttgtgttattgataaggtaaggaaaatatagaccacaagagctaattgaatttatgtcatcagatttctgctagttgtgttgtaaatttgtgcctgtgactttttgcctttatggagaaaagctgagaattcactgcgactgtacattcttcaaacatgcaaccttccaccacatcacacagtggacccagcttttggagctacttaatgagaattatttataaagttcatgaggaatttgaattaaaggcaattttccttgaaaaatgatatggtttggctgtgttcccacccaaatttcatcttgaattcccaggtgttgtgggagggacccggtgagatgtaattgaacatgggggcaagtctttcccgtgctgctctcgtgatagtgaataagtctcacgagatctgatgactttataaagaggagttcccctacacaagctctctctctttgcccaccaccatccgtgtaagacgtcacttgctcctccttctgccatgattgtgaggcctccccagctacgtggaactctaagtccattaaacctttcttcctgtataaattgcccagtctcgggtatgtctttatcagcagcatgaaaacggactaatacagaaagcttccttgctatgaattagacaaaaagaaaacaaaaaaaggaagagagagaacaagtttcatatgtaactaacatttgggaaacaatgataacagtattaatgtcatacttattgagtccttactttaagactgttcattcaacatgtaataattcatttaatcttcacaacaacttatggagtaggtatgatttctattacactcattttacagatgaagaaactgaagaataaaaagaataagtgaattatccaagtaaatacagaatgtcagtttcagatgcagtccaaaccccatagccctgagcatgtcacaatagttagtatgtgattattaatttaactgaaaatttcagttaaaaatagcttaaaaaacaccccaaatattttaaatataacctaattattaacagataaagactacagtaagaaggtaaatcattttagagttaatttactgatttgttacaagtctagtgagagatgacatatgcttcaagtcaacataactttagttttagtgtttttatcaccttttgaaaagtactttaaaaataattttatctttagaaatgttggcttcattttgtggctacgttatcatataatagctcagttttcaatattctggtttcacttatttaaagtagccatagtttaatgtaagtttctttcctaccgaaatgtgacttgattttttccataacaccctttattaggtgaatttctgctgcaactcttttaaaagtccactagtagaaatatgaaagaaaaaatataaagcatttgtgtttagtacctgtgagtgcacttatgctgggtttcaaaatttacaaggtattttcataggtagtatcacagttgtatttcttaatatttctatgaagtatcatcatcctctttttcaaatgagtaagaggaggttcacaatagtgaagtgaattgcacagaatctcacagaagtggtagaactagaattcaaacctatatcttcagtgcctgaagttcaacattctgttgcctggtaactatgattgtccattcctcctttctttatctccactatcaatgatgaatagtataaggaggaagttggttgagccttaggagactcatgaaggtcaagatttttcttttttgaggctctcagtttgtccctagtgactaagaataaaacaacttactcaggtcttgaaatggaactgcatatacatcattttaagtaaaatcctaaaattaaaaccatttataacagttattccattagtattatctaaattcttcagaacagataatatatttattatacttcatgtataattttatattctaaacaatgagagcataaagaccaaaacattgtttaaatgcacttcccaattatttgtgggcatatatgaattttctagagatgttgattaatgccatagctcactttaacctacagagaattacattaagcctgagacctaaagagaaattgactggttgaaaagctaattgcaacaaaaagcttaggtcatcacttcatgaagtctattgatttgaaaatgactatgatacataagatgtgtttgcactttttggataattttcacaaagcaaatacacccaatctttttttaaaaaaataagcaaaaatatacatgctaaattgaatcaaatatatttggtttggagaaggatgtgaattaaattgaaactcttctccttttgcctcttcattttatgttgtgccacctctgttctgtttatttgacacatccctgaaagcagtataagctatcactaaaattgtataaccacagactaaatggatcacacaacttaaaatagaagtctgttttaggaaaatgatcaaatattaaggatcccaaatccacacatttttttaaaaataaaaattaataacttatttgtgtagctaatttaaacagaacttttatgtgtttgcagctctattgtgttttttgtcctacaagcagaaatgcaacactgctcttacaaacatcatatttaattgttgaagagactgcagtatgccattacagatggattgatagccttgatgatatcattgaacttttgtcgtgcctaacctggaagacttgctataagccagaaaatttttgtcattcattttgcttctgaaaggccagatttatttacaatcttgaatgacattggacacatgcacgtgaaacagcctgaaatctatcatgcagtgaatatcttataaaactgctacttaaaatactaagtattgacctggttttcagaaccatcttcaaagtcaacgactttcaatttgtttacttataaacactgattttcagtggatagtaacaactttgtattttcattctttttttttccttgagtaaccagaggccaccaaacatgcaccatgttttcctatttttttaaattaagtgagaaacaacagaatgagaaatgcatgtatatgtctgttatttattaatatcaatatgtaactgattagtgaaaatatactagtaatagagtttatctttgggtggattattcagtgaattttttaaaaatctcagcttatacttacatgcagcaaaattgcatagtaatagtgctgtcagtgaaaaagcaagattgtttttgagctttctgtgttttggagcaaaaatgtggcatatgttactatgaacttgtaattccatccatattaaaactgaatttatgttcagtacaaattaaataagaaagcaattgagcaccttctgtgaaccaggtttgaattttcaagcatgtgataacaatagctagtgtttagctaataattataatactaaaatctactgcttatagagtttatgctagaaacggtgctaagcattttaaaagaattatctaatttgattctcacaatagccttatgaagtagttattttgtttctccttactatagagatgacaaaattaagatttataaagttagggactaatatttcataaaggagtttactttgtgctcatttgtgctgtagtagatcaagacctaattaagccatattaaagccattccatttggaattgtcacctatccagggaagctgcctgcctgttaaatttagttttcttgaaagggtttaattttaaatttttatttttatagatttggttaatacaagtatagttttgttacatggatatattgcttagtggtgaagtctgaacttttagtgcacccattgcccaaatcatgaacattgtacctgacaggtaacttttccatccccataccactcctatccccactcccaccttttggagtctccagtttctatttttctactctgtatgttcatgtgtgctcagcatttagctcccacttataagtgagaacatgcagtatttgactttctgtttctgagttattttgctcaggataatagcctccattttcatccatgttgttgcaagggacatgatttcaatgtttagctcccacttattagtgagaacattgcagtatttgactttctgtttctgagttatttcactcaggatattagcctccattttcatccatgttgttgcaagggacatgatttcgttctttttttatgactgaatagtactttatggtatatatacaacattttctttatccagtcattcattagatggatactaaggttgattccatgtctttgctattgtgaatagtgctgcaacaaacatacaagtgcaggtgtctttttaatatagtggcttattttcctttgagtggcagaattgaagtcgttctacttttagttctttgagaaatcagtgttttccctagtcgttgtactaatttacattctcaccaacaatgtataggccttcccttttctctgcaccctaaccaacgtttgttgatttttgactttttaatagtagctattcttactgctataagatggcatctcattttggttttagtttgcatttctctgatgattaatgatgttgaacattttttcatatgtttgttggctgcttatatctctgtttttgaaaatagtctgttcatgttttttgcccactttttaatggggttatttgtttgtttgttttcttgttgagttgtttgagtctggatattagtccttttctggatgcatagtttgcaaatattttctcccattctgtaaactgtttactctgttgattatttcttttgctgtgcagaagctttttggtttaatgaagttcaatttgtctacttttgtttttgttgcatttacttttgaggatttagtcataaatcctttcccagtccaatgtccaaaagagtttttcctcagttttctggtatggacgtgtgacatcctttcttttcatcacactttcagtgtataagtgtgggttgagtattcaggggaatacatgatctcttctataacttccactaacggtattctataatgctgtcattataatttgaatgtgaagagttcttctgatcggaagccttcatgtgcattgctgttttgtcaggcatggagcaatcaactgatagattgatacaactttggctgtagaaattgactaaatagaatactgacgttccatatcatggagtagctttaagctctttagaaagcaactcaacaagcaacatcttgaagatcattcattttagaaaaccacactacatattttaaaattcaggtgaatacagattttgtaccaaaagtgataaaattgtgcaccatggcagaaagtctataaaaaggaaagatggtagtatgaaactttaggaaatgtttgttttatttgttgtgcaatttttcctgaaagtatgcttattgcaaagaagttggggaaacaggcaaatacagaacaacaaaacaaaaaccattcttagtcgtttttttttggcggaggggggctggggaatggagtcttgctctgtcacccaggctggagtgcagtggcatgatcttggcacactgtaacctccccctcctgggttcaagtgattctcctgcctcagcctcccaagtagctgggattataggcatacaccaccatgcccacctaatttttgtatttttagtaaaggtggggtttcatcatgttgcccaggctggtctctaactccttgtctcaagtgatccacccaccttggcatctcaaaagtgctgggattacaggcgtgagccaccgtgcctgaccagtcttttcaaatgaacatagtcactgttagcatatttgactatctcttttcattttttttccaaaaatatatattgatagataagcagatacatatggaatcaccatcgtaaatgtaaatataagtaataaacacatctttaatatgtcaagacattggcagaggtaaataaatattactttagaatgtgactaattgttaattatggtataatggttctttggatgtgtcataatctacttaaaattcgactgatatttagatagctcctatttttttctgtgatattaaaaatacataaatcattatgcacattgtgattatatccttaagatatgttcttgagactgggtgtggttgctcacgcctgtaatcctagcactttgggaggccaaggcgggcagatcatctgaggtcaggagttcgagaccagcctggccaacatggcaaaaccctgtctctgctaaaactacaaaaattcgctgggtgtggtggtggtcacctgtaatcccagttacttgggagcctgaggcagggagaatcacttgaactgggaggcggaggttgcagtgagctgagattgcatcattgcactactccagcctgggcgacagagcgaaactctgtctcaaaaataaataaataaattaattaattaaaataaataaataaatatatattttcttgaaagtagaattgctgcagagaaaagtatatgcatattctgatatttgtaaccacttgaatttcagaaactgttcctactttgtgctcctgttagcaaagtatggtatggcctttttgccacacctttactgcctttacagcagcactgattttcatctttataaatttcatagagaattaataggattaattttattttggttttacttttttacctaccaataagattcaacagcatttgacatcttttttacatttttatttctgactttttaaatcaatttatttccttttattagactcaatttctgtttgtgaatgtttaccttttccttatatacatatagttaatataaatcttacatatgtgtgtatagatatatatgtatagatatatatgatatgtacccttcaccttatgtgtgtcaatattgttttcttcatttcttatttatctttgagttttggtcactctgaataatagagtctaaagtttacatgggaagtttatcagcctttccatttatgctttttaaccatggtgttattctagctccaaaaatgtaaaaaatatttttaaagtatccatagctattttatattttactaaaattccatctaagcagaaaggatattttaagtcctttttaatgttatttttatttactaattattttgaccaacaaaaccactaattgtcttttatttcttaacatctgccaatgtctgtccgatcttacagtttgatttgataatggccaaatttaatttgatatttgacatttgttaataatgtgcataattgttaggtttaaggtaaatagacatatgtggaaagggacacttatacatgatattcattattttaatgtatctttattgataattttctctaatattatctcacagagatacagttgttcacattccttatgagtaaaaggctttgctttcaattctcccataccagatatgacagcctaaggaagaaattttcaaatattttcatcaatcaaactgaccactttattcaaacaaattctaaattgagagctatccaatatgtaaaacacattaaagcagtttttcacttactgaattggttatatgctagggtgggcctctgtctcacactacactctgtctctgtctaggcactccctgagacagctctttgaatccttaaggatatgaagcgcagtctttcagctcggaagagtaaaagtcagatccagtcaaataaatgagtcaggttgctcagtatgatggaataagttgtggaaaaaactggtggacatagtaaacatgtatttgatccaaaagtataaattagtttctgaagcccttttcaggactatgaaaacccgacattacttttgttttaaaatttctgtatttatttcaggtaaagccaggcagaagcaatttgactggactatattaacctagctgtccattaaagtaattttgccatagtatgttgttatattaggtcttatgttttagtaaaggtcaccattatttaaaaaaaaaataaattaggaaatatttcacattttttgaaaaacctcttttggagactttgtcattgttttatccaatgacccttatattcaaaactcatgtaagatattcctatggaatttaatgtccataaagtctgtccctcctgaaaaacaaatatttccttttcaacagtcatggaaaattatataacttcttgttttattctctttttaaaattacctatcagaaatctcagacctatttttttaaaataatgatggcacaagcaatattataacaacaaaaatgaagactttaaatgacataactctaccattgttctagatcaaattatttatttcttaaagcttttcagattttctccataagaataggtagcttttgtagttgcaactaaaacacagaaacaatttgtaatccatttcaggaaaacggtttctcatattgttgcataagtcattgcaattataattttaataactgcgttcaagtaatacgtttaacttacttggttatttccgtattggtgaacatttaaattgttaccaatgtttttgcttgatgtgtgtgtgtgtgtgtgtgtgtgtgtgtgtgtgttcttcactttccttttaatgacaatacttttttgaataacttcatatgatcttgtcagttcattatgaggcctgcatgatattatgtatggaaggtatctaacatagtttaattgctttggactatatctttggataaattcttaagagtggagatatggattcctgaaactgggcttattccaacacctgtccccttctttaacaaactaagtttaaaaaataatatctaaacttgtatgtaaacttatactccaatttcccttaggtaatcagcctttattgatctttctctctatgatattctgcagcacaaagcataggacttaattataaagccatatattctttgttaattactacacgtttattagtcatgaatgcctggcttcttgacagaatcaggtgtaagcaaaataaacaagcacataaagtttcagttaatggaattttctttggaatattgtaatggaaagtaaagaggatcaagaaatagtgtgactaggccttctctttctggctatgatgggataagtagtagcagaccaattatcttgctgacaacaactagaaatgttgtatgtaatattaaaaaaaccacacatctgaagatattagagaatattgtggcagccaggaaagccactgaggtgagctttcttatcaagggattgattcatgagtgacacagtgaaaaaggctgaaaaggtaggaagaaagtggctgctagtaggaagaaaaggtatgttgaacagtcagcagtcccagcaggctggggagacataaactgaaattcagaattaccagagaagccaaaatctgaaggatcaagatactggagaaaaggtgtaccagtgagaatccataagagacagaaaccacaaattgatttggtcagagaaaaaaatactatgaagaattatgaattagaactaaagataaagtactaaaaggggtaaacagaatgttgaagaatataggaatagcatatgtagaaagtggccaccatgtctaggactggaggagagtacccaagagtgaaacaaacttggaagcatcctgtcaattccctggccaggttgaaagtcaaatctcactggaaagggtatggctatggctcactggatggcaggaaagttttctgaaatgctgctgctcagggatgatgggcaggaacatgtccactggggtggcactgaaattcactgggaagctgcctactggaggactggtaaaacttgcttaatggtattcacttctaggttttttgtataccactggcaaaatagctgctcactggtgaagaagctacccattgacaagaaagtggccagctggcagccacaatgcacaagcctgaaaaacaaattatattgatactacagtgagagttttcttcctcttgcagttttcctccagagccctctgctaagaaggctcaacaagaagctggcaagggagaaatatttacagggtccagctcctgtatttatcataaagcaagacagagaagagtggaattataaaaacaagaaaagctgtgacaagatggaaatttttactggagaagtaggatttataaaagaatcaactgcaaatagttgaaatgaaaaaggaaataactttaatagcaaatgtaatagatgggattaatggcatattataaacaacttattatggaattgacaacctgaaaggtcagtaggctatctctactgaagcaaacaacaaaaaataataaaatataatagaaaatagcatgaagcaaatgatgtatagataataggtatcataagcctgtgtatggaagtactagaaagaaaggacaataaaaatgagacaaaagcaatatttgaatagatactggtgagacaatttctttaaactgaaggacatctaactacaaaatcaaaatgcactacaaattgcaaggaggaaaactacaaagaaaaacatcacggtacatcatagtaaaatatatgtagaaaaataacaaaagtaaaattttgacacagcataattgtacatatttatgaggcacaatgtgttttgatacatatatacattgtgtaatggtaaaatcatggtaactagcatatctatcaccttaaacatttatcatttcttaattatagaagcattcaaaatcctgtcgtatagccatttcaaatatacaatacatttattgttagctatagtcaccctactgtgcaataaagtactggaacttattcttccaatctaactgttatgttgtattcgttaaccaatcaaagggaaaatcttaaaagcacacagagaaaaacaatcagattactttcaaaaggaaatttaagtgatgatagaatgacactgctaataagctttttaaaaacctctagaattctattccactgaaaatattattgaaaacatcaggtgtaactataaatggagaagaggcagatctctacataagagttccaaataatttgtttagatactctgccctcaagagggagcatttctctccactttctgtgtgtgggctgtacataatgactttgctccaaagactatggaaagaggaaaaaaatagtgtaactttgttactctagaatggagaaacctgacaaatgctacatcagccagggatcgaggtcaacatcaatagtgctaagtcatgttgaggtaataaagacactttacctctataatcttcctccttataacccacaatccctgtttaaaataagaaaaacactacaaaaatccaaatggagagacattttataggatgcctgcccagtatttctcaaaaccatcaaagtcatcaaaactaaggaaagtctgagaaactgtcatagtcaagaagaacctaaggaccatgacaactaaatataaaattctgggagacatcctgggacaggaaaagaacattaggtcaaagctaaggaaattttatttaaatatgcactagataatacaatctatcaatattaggttattaattataactaatgtgctatactaataagatgtttaaaacagtgaaatatgggatgttggagtacatgtgaactctgtactctttaagatttttctgtaaatctaaaaaaagctaacatattttatttaaaaattaaggtaaaaaaatcaccttttttgatattgccatttcctgactaaatatgaaaaaaatgttgccagcagatccatatgaaaagaaatactaagagcaattttcaggccaaaggacattattctggaaagaagcacagaaatgaaggaagcaataaagaatgccagaaaaggtaactatgtgaataaacctaaattacttctgaatatataaaataataactatgatgtcttatggggtttaaatatccaaaaataaaatacataataacaataatataataggtaggaaaagctttaaaagagttaaactgtaaggttctagcattatatgggaagcggttaaagtactaatttatattagattttaataatagatgttttaatatctagaattaccactaaaagaataacaaaggaatatatgaccgacagtctaataaaaagggcaaatagaacaccgaaaataaattttgagaaaagtaagagttgagcataaaagtaatataaaatctatggggaatttagaaaaacaataaaatgataaatttaatccaaatatgttagcaattacattaaacgtcaatgatatgatactacagctaaaagtcaaagatgtttaaaatatattaaaataatgtatatacaggtatatttatatatagagagagaatttctcagatatatgaatacaaaaaaagggaaaaactaaagtttagaaaatgaaatgacatgcaaagtcatcaatgaaataaaagaggatacaaacaaatggaagaacattccatgctcatggataggaagaatcaatatcgtgaaaatggccatactgcccaaggtaatttatagattcagtgccatccccatcaagctaccaatgactttcttcacagaattggaaaaaactactttaaagttcatatggaaccaaaaaagagcccacatttccaagacaatcctaaaccaaaagaacaaagctggaggcatcacgctacctgacttcaaactatactacaaggctacaataaccaaaacagcctgaactggtaccaaaacagagatatagaccaatggaaccaaacagagccctcagaaataataccacacatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagactgaaatgttagacctaaaaccataaaaaccctagaagaaaacctaggcactaccattcaggacataggcatgggcaaggacttcatgtctaaaacaccaaaagcaatggcaacaaaagccaaaattgacaaatgggatctaattaaactaaagagcttctgcacagcagaagaaactaccatcagcgtgaacaggcaacctacagaatgggagaaaatttttgcaatctactcatctgacaaagggctaatacccagaatctacaatgaactcaaacaaatttacaagaaaaaaacaactccatcaaagagtgggcaaaggatatgagcagacacttctcaaaagaagacatttatgcagccaaaagaaacatgaaaaaatgctcatcatcactggccatcagagaaatgcaaatcaaaaccacaatgagataccatctcacatcagttagaatggcaatcattaaaaagtcaggaaacaacaggtgctagagaggatgtggagaaacaggaacacttttacactgttggtgggactgtaaactagttcaaccattgtggaagacagtgtggcaattcctcaaggatctagaactagaaatcccatttgacccagccatcccattactgggtatatacccaaaggattataaatcatgctgatataaaggcacgtgcatgcacacgtatgtttattgcgacactgttcacaatagcaaagacttggaaccaacccaaatgtccatcaatgatagactggattaagaaaatgtggcacatatacaccatggaatactatgcagccataaaaaaggatgaattcatgtcctttgtagggacacggatgatgctggaaaccatcattctcagcaaactattgcaagaacaaaaacccaaacaccacatgttctcactcataggtgggaactgaacaatgagaacacatggatgcaggaaggggacatcacacaccagggcctgttgtggggtgggggaaggggggagggaaagcattaggagatatacgtaatgtaaatgacgagttaatgggtgcagcacaccaacaaggcacatgtatacatatttaacaaatctgcacattgtgcacatgtaccctagaacctaaagtataataataaaactaaacaacaacaacaaaaaactaaccaaaagaaaactgatacagctataacatcaaaaattcaactttaatgaaaaaagcatagctagatttaaagaggaacattttataataacaaagtgttaatctactaggaagatgtggggatcctaagtttgtatgcccctcataatagagcttcaaattatatgaaacaaaaattgcagtcagaaaagggcacatgtaaaattaaataaagcaatttcactatgcttgtcttgctaactgatagaacaagcatatgaaaaaattattaaatatatagagatatgaaaatcatgattaacaaatcaaataaatttacatatttgtacatatttgaaatattacatgtataatatatgtaagtatatgttgtatacatgcacatatgtacatacagaaaatatagcatctgaccattgaagagtgtacattattttccagtaaatatagattttttttaaaaaaaaaagaattgaccatgtgctaaaatataaagcaagccttaacaaattgtaaagaattgaaatcatgcagagtatattctttgttcaccatggaattagtctagcatttcataacaagatgattgaaaattcctcaaatgtgtaaaaaaaaaatcccaaaacatacttcaaaataacccaaagaagaaatatttatgtagattaggaaatagtttgtgtcgatgataattaaaatgaaacattaaaatctgtggtgtgcagctaatacttttatttttagggaaacaaacatatgagtgtgatgtggtctttccaacaaggccgccatcaattttttccttgttttgacacagtgtattcaattccctgattgataggaggaattctccacccttccagaatctctgctggcctgtgactgctttaactaacaaaagtctaagaagttaggctatgtgacttccaaggctagatcataagaaaccttgcaacttgtctttaaatctgctttaatagtctccctgggggaggtaagccaccggtcctccaccctgaggacaccaagcaggagaaaagcaggagtttggcatgtggggagcttcatggagagagggggagacatctgactagccacccagatgttctgaccatctcagcccaaatcccaacatgggagtgtcaaagcctccatgcaggtctacctctagctgtcaccttactactaccttctgtaggaccccaaatgagcaccaaccagttgattattacctgagaatccctagacaggtggaaaataatagtaagttgtctttctaagccacttagtgttaaggtgattggttacatgtttacagataaccaggaatattttttaaaagaaagactgaaaatcaattatctaaatttccatctaagaacttagaagcagaacagtgaaagaaacccaaggaagtagaataaaggcaatgataaagatcacagcacaaattaattatgtgggaaaaatgtgcaatgctgaaaaatcagtagagctacagggcttttttaggaaaagactaaaatagatagatgatagatagccaagatagatagataaaactcacaaattcctagcaaaactgataagaaacaaaagagaagacacacatgaatttcaggaataggaagggtgacctcagcacaattggacagacatttaaaacagtagtatgagaatattatgagcaacttaacagtaatacatttgaacattaatacgaaagggacaaattccttgaaacacatgatttatcccacatatttaaataaaaatctgaatattattatatcaaagaaattgaatctgtaattgaaagcctgcacacacacacacacacacacacacacacacacacacacacacacacatatgcaccccacaatcccaggcctcaggtagtgtcataaatgagctctttcaaacattttattaataaattataccaatcttgcacagattatttcagcaatagaaaagaaggaaacacttctaactttttttttgatgtatctagtatgacctgggtgtcaaaatcaagcaagactatttaccaaaaagaaaaagtacaggcaaatctgtctcatggaaaaaatcataaaaattccaaatgaagtattacctaagtgaactcaggcatatataaaaaaagtagcgtatcatgacgaggtttattttagagatgcaaaaatcaatcctgttatttatcatgttaacagaataagaaaaaacatctaattatctttatagattcaaaaaagtggtaaataaaactttacacctgtttatgaatcaaatatgaaagaaattaggattagaaaggaacatttatctatatctatctgtatctaccctacagtacccatcatacctaccttgaactattaaaacctctcctgagatttgaagcaagaaaaggataaccattgccaccactttttcttagcatcctatttgaggacccacaagtacaataatgaatattttaagaattggacaaatggaaaagctatttgaacaagcatttcaacaagatgttatccaaatggccaatacatgagaatgtgcttaatctgattaatcactgggaaaatgcaaattagaatcataagctgatgctattattaaactcccagaatagatcaatgaaaaacccagcatatcccaaatgttggcaagaatgagtagcatctgaactctaatataccactggtgggagtgtaaattagaatagccttttaagaagaccatttgtctataaatactaaacaacaccttagaccttttgacccagcaagtccagtcttagatgtacagctgctcctcagtagctgcaggggtatattggtttcaggacacctgtgtatgccaaaatctgtggatactcaagtcctgcatctggccctgtggaactcgagtatataaaaaacaggccctccacatatgcaggtttcacatcctgtgaatactgtactttgaatccacatttggttgtggatgcagcacctgctgatatagagggtccactgtatttagaaaaatccacatataaaatggacctgtatagttcaaacctgtattgtttaagggtcaactgtattatccaacagaaacacattggtaagctcactgaagacatgcatgagaatgttcatagcagcactcttcacaaaagccaaaaataagaaaatatttaaatgctcatcttttgtgaaatgaatattgtagtatattcacagaagggaacaatacacaggaataagaatgtgtgatctacaagtatatgcaacaaaatggatgtatatcctaaacaatgctgaatgagagaagccagacacacttgaatgaaaagttaacttgagcaaaacagtcaaagctgcatagcaaggacatcagacaaaatcagttacattcagtcaagatgcattgttgctcagtctgcctattacctgactggtccttcagtatcagttgttttctgctctgatggatccacacttcggtgcgactttgcttatgcttctactttacttcttctgctgttcctgaccaaacccttctctcccttccctgtctctctctgtctccctctgtctccctcttcctctttctcccatttttccctgcccctccatacctcccccttgtccactccatcccctcttccagccacactcatctcatgaggcaaggatctatcaagttagctagtcaacatgcagaagaggtacctcatttgagcagaaccgtaatcaagccacctcacaggccactatcaaacttgaagatggattggaatactcgccaattgttaactggattggataaatacataaaattgagtcctgtctataaagatgacttatggccacaggtttaggagtggtctgtgggcatatcctgtatatggactcaaccaaatcacatttctgtttagtcctcaactccagctacattttaaactttggaaaccacagaaatacccttttacctttctcacactgtccactacaatggcatatatatagtggtgggtaactaataattatttgagaagccaataacaacatatttaatgggtaagcaggtggcctagtgtcctgaccttagtttagtttctctcattgttctcaatttcatcctcaaatgattctatgtaaaatttctgggtctgtaccataagcttcccaaatctgtaagactagaaaataccttagtttattgttcaaaagtaatatttcagataccaaaattatgacttgtctctttcttcacatcaaaattagagtgcattcattctaattaaaatgaaatattattttatttcatttaatccaaggttaaataatgatgtcattctatgatggttcatttttaacagagacccaccgaagtttctttttgtatgtctagttacaagaggctaattctgtttgactattcacttgcagatataaatgaatgtaccattgacaatggtggctgtcaagatcgatgctgtaatacagttggcagttattactgcaaatgtcaagctggccagaagctggaggaagatggcaaaggatgtgaaggtaacaggactgtctgcttactgataagggaagagagaacatctatgtaatgcaaaagaggaggttgtcttttatccagagccagttgaagtgcctgtgttgaatgttgtcaagagcacagatcttcctctcatgtctagattacagtattgtaaccctaagaacatttcaagtagcttattatgggaaacatatgattatatgctggtttggttgtgtcatgttctgattatggaatttcaatcattcatttaaatccctggataaagtacatattttttaaagcatttcatttaattctaaagtaaaaatgatacttatcataaaatactcatatgttgctacaatgtaaatggaggggcacaaaactaaccacaggaataatattcttggtatagaattagctttttgcacaaacctcaattttctgtttccttttaaaattaattccttcatttattaattcatcattttattcatttgacaatcattgagtttctgctctgtatcaggcattattccatgctctggagatataaaaattaatgagaaataaattatgtcctgaaggagctcactgattagaagcaaagattgaaacataagcccaagccttacaaagtggtatttttaggcattatagcatgcggtaagtgcattggattcaaagagacatgtgtttgagacctaactctgtcacttatgatttatgttaccatgggcaagttattttattttgctaatactcttccttcattgataatatttagaataatggtggtttctaaaccacaaaatttgctgtgagaattaaataaggtaatgcatctaaagcacttagcataaagggtggtgctcaaatgataactataagtggtactctcatttatgaacttagttgctgcctgtcttgggaatgtaatgggggacagagattgcttccttctcttaatttctgaaagggaacataatagattaaaaggatcactattaccatgccttataactgtctttctgaattttttctatctggccatattactaaaatgcctgagaattttatatagtcaggcatctttgtttgtttgttttaagataacagtagaaaagcatttattctgattatgttctatcacggatcttaaaaaatcacattctttttttcccttaacaaagttcattcctgatggggcatgtatgaataagttggtaaaagaaaacaaaacaaacaaaaaatatccccactgaaggcacctgaggctagggttgtgggtttcattgagactaccaaaggcaagacaaattgtaggtgtgagtaggttggaaaatgtatcaatttccctttatcattccctcccagcagggcttgtgcaggcaataataggaagggctccaggtagagagccagatgtttaaaggcaactatgtctggaccttcctgggacagggttcatctcaggaagcatcctctgcctggaaaagtgtaaattcacaaaggcaaaccctaaattcacccaggctcttttttcattcaagtgcaataatctctatttctggatgaaattatttggcaatggtgatcccagtactgattcaatctcagaagaagagtcaaggactgcattgtgttcaaggtaaaagtgggatggtgaccactgaagacgacatggtctgtactatgagaatagtgttttcatgaaccctcccttcatctgacaggcaacaagctatttatttctctttgactgagtattattattgctgtatcatcattgtcattattatagatatatttgaagcacctatcacagcaattcaccattgttaggtataataattatttttataatagctattaggctaataaggcatgttagacttcgcacccactggttcatttactttcacttatatcctattttaactgaagttagttactcatggtcactcatataagtgacaaggtatttagagaaatgatttccatggttttatttagctgagtccatttgtacaaactgaatacaattaaggtcagtatttgtatgaatcaagagtatgataatcaagaatccagagtttgatataatgagataacactgacttcctactttcccaggactagggatggtggtttgaagtagagcagcttacctgcaaagaacctcttctctcagtctcattgatgttagaatcttttttttcttttcatttccttaaatgactatttgctggagatggtactgctagagattcagcttgcttgattgttgaacatacaatcatctcaggtttatttatatacatgattaaataaaatataatagagatcattttgaaatccagtgcattctaaagacactgcaaatgaacattcatgtgagtgtagaaatgagtcattcatgtttatttactggctggtaacagtagaagtcagttggtttcaaagaccatttagttgaatgctacagcattgaattaaacagtcatttaaaaatacttttactttgcattaatataaattgaatttaagttatttgaattgctttttaaaatatagagaccagcattttaatgggcatttgttgtactatttaaataaatctaggctgggcatggtggctcacgcctataatcccagcactttgggaggctgaggcaggtgaatcacttgagtccaggagttcaaggctgcagtgagctgtgatcacatcactgcactccagcctggacagcagagtgagaccctgtctctaaaataataaataataaataataaatctagagtctgtccttaagtggacagaatttaaacatttataaacaatcttgttagttaatcttactctttaactttttctataaagaggtataaacttgtggagaaggctcttgattagctcagtttcactggtatccccttctttcaggcatagcactgaatctaaagaatgttttctgattcacacgcagattgattcttacaagatatagattaaagaagcaaatgaagggaaaaaatgccttccactggatgctgtgggagatattaaaatatttacatagtgtgtgtcaaggatccccaaacctcgggccacagaccagtactgctccatggtctgttaggaactgggccacacagcaggaagtgagtggcgggtgagtgagcaaagcttaatctgtatttacagttcctccccatcactcacatcaccacctgagctccaccttctgtcagatcagccatggcattagagtctcatagaaatgcaaaccctactgtgaactgcacatgcaagggatctagattttgtgttccttacaagaacctaatgcttgataatctgtcactgtcttccatcaccccgagatgggactgtctagttgcaggaaaacaagctcagggctcccactgattctaccttatgttgagttgtataattgttatctatcacaatgtaataataatagaaataaagtgcacaataaatgtaatacacttgaatcatcctaaaaccatcccccttaccccggtctgtggaaaaattgtcttccacaaaactggtccctggtgccaaaaaaattggaaactgctggttcatacacacacacacacacacacacacacacagatctatatatagatctatatatgtgcatacttgtatgtatatgtatatatgcttatctattgaaaggatgtaaatttcttctttcatttgctagtgtgagtgattatttttatagattttcaaatatgcaactataattgcacttcagaaaaaattcaactggtatcattttatttgctattaaagtcaattctctattattttgtttaggatgttgtatccacaactgtgagtgaaataggccagtaatttttgtttctcatatgttctttatggcagtggctctcaactggggtgattttgtaccccagaggcacttgtcaatgttcggagacactattgattttcacgactgaggggagtaggtgccactggcatctagtggatggaggtcagaatgttgctaaacatccccttcttctgtaattctgattatactgcttcagatttcaaccatttaactttatgttttagaaatatcatttttctcaaatttatagattatcttttgtatgtatgctcatttttatagttgtattatcttcttttgctatttcacatataagccttctatattccatatctgaatccagcatctggggtccttgtggaaggtctaaatctattgttccttatttctaggaccattagttacactctcttccctttcatgttatatacactaatacctctgttccataacttcttacagagcactgtacttatttacacatttgtactgtcaattagattggggatatctcctgggaaagaaccatgtcttatcactttttcatccccagcacacagttgtctagcacatagggggattccataaatgcttattgaatgaatgaataccatcatcctttcaaacatacaagcatacagtcaatatggcttttattcattttattcatttccttatctacagattctaatcatgctgaaattgtcacttaaagtttgactagttaaactatttggttatcagtaggtcttaatgtaagtatttgctgataacaagtcatttgaaagggaaaaatcacatttttttgtttctagggagcaaatcaaagacttttggcttgctttcagctttctgaaaagtttcttcatatggcttgtctaaattattggtgccacaacgtaagtagtgtggctattcaagcacggtaatcttgtggtgtcaaagaagttttctaaatgaaatggtaactaatattactatatattctaataaattaacttagaaagatagtgaacattgtttggacatttgagataaattcttctatttgagagaaataaatgaacatatactatacattgataaaggcatattgtttaaataattgattgttaaaatattttaaagtaattttaatgatattttggatttttttttctaaagcatatggacatgattaagtgaataaacagagaatataattcagcatgccactgtggtggaattacagaatatttcagcttccaaaaggcttctatagttggaattccagggaaattaaatgatttggacaaggtaacagtgctagttgatgagcaaaatgacaccagaagccaaactttcttatttgttacccactgtcctttccctttgatgtggttgatgggcagcatgaaccggatgcagactagtctgactgtggggtcacagtgttgtgggggtagagaggccctcaactcatagaagccatgattgtcagaggagggaaattaagaccctgagagattgactgatttcctccaagtcctagacaatttatttgtaaagcaaaaaacagaatccagttccccttttcccatttgtcattcttcttcattgaaaaatcaatctggtcagtaaacatttattgggtaactactatatgtccagcactgtgctgggtaattcgagaatacccaacccatattttagtacagagtatggtttatttcttcacagagtttcagtattattaagcatcctgaatataaaatgattgtgtgatattttacatgaaagtcaagtaattatattatatcctttgagagttcactcaggctagctctttgcctccaagcagcatggtgtctaaaccagctagttgtttaccctagtattagagatctccaagggaggacatcttttaataactcttgtgatcaggaaagcgttccttatatgtcacctatattgctcccgtttaagcctgtgtgttttattttcttcttagttcagagacacttaaataatcagtaattctccacacacttacagcacactaatgtgtagttgttcaacttagtaaaaacatttattgtgccaaatatagtctgttggcacttgaagaataaaatatgatatatgtatacacatacacatgcatatttattttgagtttattaagaaaacttgaaatcattatgaagaatttttctacttctgcatgttgcttctcttaatagtcacttataaaggaactctgtacctctttctattggtgttgtggagcatgcaaagtaacagcagttccctggcctcaaagagctagccaaatactggagtagttaactattggaattgccaaccattgaaatttatacagatgaagaataatttgaaaaaaatccaatatagtctatctacatatactaaagattgtccattttgaatttatagaaacacatttacaatacagaataactacatttaaaaggtttgaaccacttaaaatgtgggggatttatctacttgattcataattgtattcagagttttttttcttattattcaccaagcacgtatcagacccttacactgtgctccatgtcaaacaaagagcacaaattttcggttcaaatattgactctaacatttactagctgtgagacttagagcaagttatttagtatctatgggctttcccttcatctataaaaccagagtaataatacttagccttatataggttgaaagatcaaataagatgtagtttgaaagcatcttgatggtaggaaaaccttctttcccctgtttcgtgctcacctaaagagggattgtttattagtaacattcttgacctctgtctgcaccccacatctcccactcccttcttaccaagagaagaggtgtgaaaatacctcactggtgagtttggggaaataaattggtctgttgggtttagctcacattcatattttctctttggggcttgcaaatgcctgcaaaaagtgaccattctggtctgcttctctgcttaaatggaagtttcaccatgccaggaccccacatgaagaagacaggttttccatctacacctgggaccaagtgggagagtttgtctaattctgcatgcatttttgggaagcccattgttgctgcacccttaaattctcttatccagtttcaattttaacaaaaataaaatggatattttgtctccatatgcctattttgaattagatctcaattaattcaaaattcaggcaggcaacatgaatttgttattgtatcccctcaaaatagtagcactttatatttgcctaatgcttaggaaattttatttctctccagtttttttttaatttcctcctatgctatttgttgttgaagatttaaaaaaatgtacaatattatctttttctctcccaggagcttccagttcaataaaggagattagatggatacacaaacagctatagtgtaagatagcaggagtaaatataaggcaggcacaagtgctatgagaattaagaggagaaaaagataacccactgttgaatcaaaatgggctgcaaggaactgggacagacactaatcacttagccctgggactgaacaaccaaccttccatttctttaatttccttaataaattccctagtggagttctgcccaatatgacttgtcctgctgtctcttgtgtctcttgattgacactggacggcatccgggattttaacaacaaagctgctactgctgttcccaagacattccttacagaaatttctgagagtattcttagatatatgtgtcttttagactagagtgaaaacacatataattcaaatctgaaactctgttatgaaaatggaaatcaactttatttatagttaagccagtcttttaaataaagtccatcatttctcccccaataatcctgagtaattccttcaatacctcagctttcagctaacacttaactgtagtcaacagagtatctacaagtgagaggagctggaagagactatagctcatacagattccccaaggtgagctggctcacttagcagatttcattagggatgtgcagatttatggcagttatggcttctacaggtagtgccaaaagaggcagacaagaaaaaaaaaagacgtcttagaggtctgtggctgacaagcaagacatcaaaaggcttcttattgcctcagcagcccatgccactcttactacaaaaacaatgaagcagaagcagccaatcagggcaaatggctgtgtgaagctgtctgaatgtggtgagcagcaagatacctccttaccaaaatttggctcatggtccttaaattttactgtaaattgggaagcataaaatattttatattctgaagaataaaacttttagtttcattcacaattattttttagtttttctgtttagtagtcttaaaaatgagctgatatttttaaaagactgtattattatatttacttcccagaaatattttccaactgatgcatcctggcttgaattcttcagatgtgtgtttaccttgtaggtattttttgtattatgaaatcatacctaccaaaagatcagtgtgatcctgtattctaaagcatgatccttttagacttctgaaatgtagagggttggttcctgcccttacaagatccatattcctttctattactatcataaaagtagttacggatgactgactttttaattttcttgctataagaaattccttcatcaatttttaaataatggagacttatttttcttgcaataaggacttattaagggagcctatgaatacatatgtgtgatttttaatcaggaaataagtcagttaaagttgatttgttattttgctgctattgactttcatgtgtttgtatttttagtggccttctgatgaccagtcatcctcagcatatgatatcatagaaagaaatgaaggtactcatttctgaaaaaaactatatactgtagttcataaattcaagttaattttctgtttttattattaattccaattctgagtttgtcaacaggccaggtctgtacttccttgaatttaatttagatcataataaaaggatagcactcattttatttgtcccaatggatgcatgtgatgcgtgtattccacatgtattactggtaaacccaaccttctgagagtatgcatatttatttgtatttttactttatatcttctctatgagtatctcattggtaagagcatattcctaagaatagtaatattgtaaacatacagaattctttatgctattacaaatacaaatgtcttatatttcacatttcctataaataggaaagatatatgaaaagaatctggagaacttttctaaaaagtgttgttctcattttaataaggaagatagcaggtctctaacattgtatgaaatcacaggcttttgtgattatcaaaatacacagagtgattataaattaattattgtcattcaaatatgattttttaagtctatcttgcagaatgagaaaggcagttaatgttgtataaagccatttgaaaatactcaagtaatagaccacctgaagggaactgcatactgtaggaggtcattgctggctaggaacacacataggaagggaacaggtgttagctttggttggtctcagactggcactgggtcctagtgactcccagttcagggttgggatagagaagagcagaactaagataccctaggtttctctgtctgtgtgggcatgagaggtcggggagaagggcaggagagaggagagacaagaataatcatgtaaaggaatgcattttatacatatatactttatgccgtatcaaacacatgtttctaagttataaagttctgtagttctgacaagcttactgaagtgggacacttcaaatcttatagcggtctcagcaatagcataaaccatccagatgagatgtgcaaacaaaatgtcttttctctgcttgatgtatatttaataattttttagcatgactaagatgacccctgtggtaatccatcaaaaaatgtagacaagaataagaaaaaagttgtttataaattgcttttcattggtgagaaaataagttgatttaaaatcatctgttgtataattttgaacaagtgaactggaagcttctgtatttaaatcatttatctatttatttttgtatttattttaaaatatatttatatctatatttatttttctgtattcaaatcttttgtaattaaattttctgtataaatatataacatatttatatttatttttaaatatatttattttatatttatttttctgtatttaaatcactggtctatttacttttatatcacttcttttattttaaataatcatcacattttggtggcctgactgagctttggaaaacaaattaaaactgcagctaggaaaattaggttaattataattcattcgatgctgtctttattaaaagtgaattgatttaatccctgtaaaaaaccctaaggcatgagaaagcaaaatagctgtgtaaaagcttagtgtactcaacaattagaagatactacagttcagtacttaatgtgcatatgaatcaccttagatcttgttaaaatgcagattctgattcagcaggtgtgggatcagcctaagaatctgcatttctaccaggctcctgggatttgagatgatgctgatccagtgaccacactgggtaaaaaggcttttgtcagctcattctctcaatgtgtcagataataattaagcatttgctaattataatacagccatagagaagggatacaaaatgctgtgaaatgtggtgcctgcaattctgaaacattttaagaaaccagtttgttgagataaaattcacagcccatacatttcatccatttaaattgtaaaattcagaagttttcagtatattaacaaatatatgcaatcattattacagtagattttagaacatttttatcatgtcaaaaagaatccctatacattttaggatcacttccctccactcccatcactcccataaccctaagcaaccacaaatgtactctttgtctctatagatttctctatacttttatataaatggaattatatgatatgcaatgttttgtgaccggcttctttcaattagcatagtgtttttaaggttcatccatgttgtatcagtacttcattccttttcatggacaaataatatttcattgtgtagacataccactttctgtttatccatttgtcagttgatggacatttgggttgtctccaccttttggctattacggctaatgctactacaaacattcatctgcaagttttgtgtgtagataagttttatttctcttgggtgtatacctaagagttgaattgctggattatatggtaaccatacatttaattcttctgaagcttttaatttagataaatagaaagattttaatacataaatgttcatatgtgtgtgcatataaacacactgtatcaaacaattggcttcatgaaaaagggtccatggtcaaataattttggagagtactacatgctaaagctctcttaaatcaggcaaaaggggagccatttcactttgtttaacacaagtttccaaacatgtttttcaaacatgtttggaaatattttttttattattattatactttaagttttagggtacatgtgcacaatgtgcaggttagttacatatgtatacatgtgccatgctggtgtgctgcacccattaacgcatcatttagcattaggtatatctcctagagctatccctccccccttcccccaccccacaacagtccccagagtgtgatgttccccttcctgtgtccatgtgttctcattgttcaattcccacctatgagtgagaatatgcggtgtttggtttttttgttcttgtgatagtttactgagaatgatgatttccaatttcatccatgtccctacaaaggacatgaactcatcattttttatggctgcatagtattccatggtgtatatgtgccacattttcttaatccagtctatcatttttggacatttgggttggttccaagtctttgctattgtgaatagtgccacaataaacatacgtatgcatgtgtctttatagcagcatgatttatagtcctttgggtatatacccagtaatgggatggctgagtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccattctaagtggtgtgagatggtatctcattgtggttttgatttgcatttctctgatggccattgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagacaatacagggatgccctctctcaccactcctattcaacatagtgttggaagttctggctagggcaattaggcagaaggaaataaagggtattcaattaggaaaagaagaagtcaaattgtccctgtttgcagatgacatgattgtatatctagaaaactccattgtctcagcccaaaatctccttaagctgataagcaacttcagcaaagtctcaggatagaaaatcaatgtacaaaaatcacaagcatttttatacaccaataacagacaaacagagagccaaatcatgagtgaactcccattcacaattgcttcaaagagcataaaatacctaggaatccaacttacaagggacgtgaaggacctcttcaaggagaactacaaaccactgctcaatgaaataaaagagtttacaaagaaatggatgaacattccatgttcatggataggaagaatcaatattgtgaaaatggccctactgcccaaggtaatttatagattcaatgccatccccatcaagctaccaatgcctttcttcacagaattggaaaaaactactttaaagttcatatggaaccaaaaaagagcccacatcaccaagtcaatcctaagccaaaagaacaaagctggaggcatcacactacctgactttaaactatactacaagcttacagtaaccaaaacagcatggtactggtaccaaaacagagatatggatcaatggaacagaacagagccctcagaaataatgccacgtatctacaactatctgatctttgacaaacctgagaaaaacaagcaatggggaaaggattccctatttaataaatggtgctgggaaaactggctagccatatgtagaaagctgaaactggatcccttccttacactttatacaaaaattaattcaagatggattaaggacttaaacattagacctaaaaccataaaaaccctagaagaaaacctaggcactaccattcaggacatagacatgggcaaggacttcatgtctaaaacaccaaaagcaatggcaacaaaagccaaaattgacaaatgggatctaattaaactacagaacttctgcacagcaaaagaaactaccatcagagtgaacaggcaacctacaaaatgggagaaaattttcgcaacctactcatctggaaattttttaaaagcaaaatgtttaaaattcaaggatttagtagagagcattttgagaaatggcttaattgcatattctggaaatagaaaacttattggatagggcagagagtatattcagggaactagtggatgatttattggggctagacagaggacagtttcaactcaataggtaaatcccctaggtaagtggataggaatgtggtttctgatggaggacatctgagtagaggaataatagggtggaaatgtgatttctgaaagttgttctgggcatgagtcataggatgttatagaaagacaaaaagacatggaaatgacagggataccatttatgggccagtgaaattgcctagctattaatatccataagttgtataaagagggaagaatcagttaattctgatgacacaatggacccaagggaaaggggacatatcaaagtctctttaagtaagatgatgatgaataataaatctattatcgatagcagaaatgccaaatgcagtatgtagaataagtgcatctttaaaagcactaaacagaaatatcacattccaaccagatatatcttatgaaatttcctgacattatagaaaaatgattatataaaaatgacgaagacctatttattcatccttttttatttgaaaattagtacttgatttctgtatgtgccctgccataggttttgatgttgccatctggcagaatctgcttattatcttcattatgaacctagactttctttttatgctggtgtctatttcccattaaatcaaaagttatgtcaatttcaaattaatgagaagtaagtataaagatggaaacttcccctcaatattactatttttatgcttttggagcataatatttagcactgctcaaatctggttgtaaataatttctttcattgatgagatgaactgtctttactttttctcctgttactatatttactgtttcccttttgtttgatgtcattggaaaatgaaattgccagatggtttgcaaagagaagtgagcaacaactctttttttaaaaaaaagtttctttatatacaaataagtaagcaagcaaacaaaaaagtatgtttgcttaaaaaaaagaaagaaaaaaattttgcttaaaagatacacagagacacactcagaatctcagagtgttaattagatgctcctgtttatatcaggatgaatatgccatatatgggtaatagttcctaaattaggtaaaaatggggatcttgaggagccacacattgtcagcataacacacagcatgaagacagccccctggccagcctttttctttcagttatagctattcaagtcttcatttttacaagtagtactctctgatatcaaaacagattcactctttttgtccgcatgactttaggcagtatgaagatcactaacgtaggcattatgaaaccttagtgatttcagattcaccaccaagtctataacccagaatatatctcttcacttctctgggccttaatttgcccatctataaaatgagacattaggaatggaacatcttcaaagtctctttcaggttgtaaatgccgtaattcacaagcgtaaatctacaaatttaagtgtaattcgaaagctggaattctgtgcaagaggccaggaaaagatttttagaggttataatgaccacataaaaactacttttctgaaccttatagctaacacagagaacctatggtatctagtaagatatgagattatatcacattagaggctagaagagagcaaagcaaaagcagcaattaaattttatcacacattacagcagccgtggattctacttggccttttatgcacagctttaaggtaaccttgttttccatttggctttctttgtttctgtgtctctcccaaaaacatttcttagatttccccagttctatcccagtgttagacacctaccttgtattcaatatattcatgttgaccttattgtcatcaattatccacatcagtagtcagtttagaggagattttagacaagaaaataaaacattatatgttttctcaaataattatttgacttcctcatttttcaattgagaggaatagctgcagtctcaaatacttctgcaaaaaatatattcacatattaatttaaagtgctagttacaggctgggcatggtgcctcacgcttgtaatcccaacactttggaggctgaggtgggtggatcacctgatcaggagttcgaggccagcctgaccaacatggtgaaaccccatctctactaaaaatacaaaaaaaaaaaaaaaaaaaaaagaaagaaaattagctgggcatggtggtgggtgcctgtaatcccagctacttagggaggcaggaaaatcgcttgaaccgggaggcagaggttgcagtgagccgagatcacgccattgcactccagcctgggcaacaagagtgaaactctgtctcaaaaataaataaataaataaataaataaataaataaataaataaataataaagtgcaagttaggttcttttttgcccaataaaatggtttacatttgctgtgctggttctcagaaaataaattttaaatgataaaaatttacatgattttgtgtgatatatgatatttattttaacagaactgcttatacaaattttatccttggatttctatatatacttcacacactctgataattaagttcgtagttatcatagattattaagcttatcagaacagagatgtagcaattatagttttaagggattggtgctttttaaaatgttgttcttcataggtcttttctaatgtgtatgtgatactggcctaagtgagagagccagtaggccaagctcaagaatttggagaaagaaagaaaattagatgtcttttaaaattcaacacaaaatcaagtggagaaaaatcaggagaattaattctgttctcagagaggcttaaagagcctgactataatctgatggtattcatagagcttaagaaggatcctggcaatcaagtgtggtcagatacagagatgtacaaagagaaaaaaccacccaggaatgcccaggaaagatgaagccttaaccaacagactttgagaatccctgtcctatgtgcaaatgaatatgttaggctactttatcccattaaacagcaagtttcatctcattgattccatttgttagatctctgtgatagcttatattatagttcctgcatcagtctgggtccaatcaggagagaaagaactgcacagtaatttgaacatgggaagtttaatataaagaattaactataacaggaggttggagtaataaggaactggcctataagaaataaagagaatgctaaaaaatacaggatttcaactactaccttctaggggtgaactgattccatttcacccaaagaagagactcccccagggctgagatccagacctagttagaaaggttgcaaccacggttcactgaatggcagagaggtcactgtgttgccacaccagcaggacttgaaaatcgggcttcttgaacttgccagaaatctacagtctaggaggtgggagaaaactgttcaaggtaaattatcttttgcccaaggggagagtcgggaagttgctggtcattggatgctgctggccacccgtgactgcacaagtcaggtgctaaagaaactacatgtgctgcaggagcccagcaccagagaagctgccgcgttgtagaagatgggtttgaagaagctatgtgcaaagtagcaacctagctgtaaaccctagaagccaccacactgccggcgaatagtgctggagaaagggccttccaaaggctggagaaggcatttcaaaggctaggtgctgggaaagttggacacattgagaaaaccagttgctggagaagatacctgaactatgggagccagacactgaaaaggctacacaggctccaagagccggactagagaagtcgtctgctttaggggagccaggaacaagagaagctgcatcaggagcctgtctagaaaagtacactggagccaggaaggatgatgcttactctacaatgtctttccgttgtcctttactggcaagttttaacatagtgcctgctgacaaagggaaattaaagggcccagatccattttcacagtgaaggcaaaaataatgaacttggagataggaggcaattaatcaacaataagcacagttcccagctatgcttcctgtgctccataagagacgtataaaaatgtgtccttcatcccttataaatacatgtagatttgagtactcccctgaaggcaaaggtatttctcccatccattggttgacttgggcttatgacttggttgggtcaatagcatagcaattaatgtgatatagcaccagttctgagcagatgttttaaacgtgagtccataggttagcatgaactcttccatctttgccctgtgccataaagaaagcaagtcccagacagagtctactcttttatctgggtcctagaatgatgtacagagctgagtagagcgacagccaacctgagacctctaagcaaggaagatattggtggttgtatgccccttagcctttgggttgttattacaacaaaagccaactaatgcagtttctatgcttgacaaccaactttccgatttctgtttggctaatcatgataatgcagcattaagacctataaaccattaggtcattttctgattttacttattcgtctgcagcaaggagataaaatgaagtgacaaggcccccttagattgaagagaattcatcatagtcatttcatcctgagagaagtcttcagtggcagctagccagaacttcccagatgacatctcagacttgcctgagtataaatcattgggtggaagattagagatggaaaagttattgtcaatagtttctttaaggtatagggcctctctacatggctgttgttcttctctttgccggttttcatgatttgctgcaaagattataatttatttcattttatctggtctttatcaaatgtcccctaatcatttgggacactgggttgttgtctaaagtttatctttagaaactgctgttcttgatgagacttggtagacttctacacaactttctgtggaagaaaattgtttttgataatagtgttatataaattcttcttcagcggtcactatagtctaacaacacatagttcatattaacataggctttcttttcactcattgatttattaggagaaaataattttctaactcactattataatattcattataactataattggtattataattattattatatttggtaatcttggagcatccccaactggccacacacacatatacacataaagaagtctgaggctagatatttcagcctttattgagctgaaaaatcatactgctgttcaaaaagatttttttcaattaaaatcaaaagtaagaatttacttcctatgatcactaaataattaaaagcataggtcaaatattagcatgtatataagatatacgtttaagaaaagaaacagtgctaatactttgagtgctaggactattacttcctgtagatattcaaaaatattgactagagtttttaaaccctccttctgcagtaatgatcagtcctggaactaatttaatttgggcacgtgcatgaaaagaaacatgaggagatagaaaatagccacagaatctagtccagtctctgctactgtacatggagaatcttagttttctcatctctaaaaagggaataatcacatatgcccaaacaaacttaaggatttttttttttttttttttttttttgagacagagtcttgctctgtcacccaggctggagtgcagtggtgcgatctcagctcactgcaagctctgcctcccaggttcatgccattctcctgcctcagcctccctagttgctgggactacaggcgcctgccatgaagcctggctaattttttgtatttttagtagagacagggtttcactgtgttagccaggattgtctcgatctcctgacctcgtgatctgcctcccaaagtgcagggattacaggcgtgagatgggatttttttgagaataaactgagtgtcacggtgaaaaggagatgtcaatagcaaaggtctttgcaaatgtgaaattttttgatgccctgaaataattggttgatggtatgttaatgtcttcctaaatgccattgaacctggaacctagccaagggaataatcagaggagtgatcttcaaaatatatcttactacagaaaaagcagaagatattaggacagatcttgaagtttagggtgggtagaaatgtaatttctccttctgaagtcattaataacctgattgtaacttcgactatcagaacgtatgatattccccaactcctatttaaaaaaaaggaatgtgatcacacagtagagaaatttactatgggaaagctccttaacaaccacgtggtattatcatttaaaagtggaagggatagaatgatgggagagacgcttaatggcaggttggaggtggggagacagggatggagggaatataaccagctcacaaccatcttctctctgaacttttctggacttttttttctctagtgtatagtgaaagtttaatccttttgtttccctgtgatcccagaactctttgaacaaacttactattagaacttcagatggtgtattacatttatctgttaaattgtctttctcatcagactatagatgtcttgaaggtgaggatcattccttaattgtgtagtagcccagactgctgccttgcacaagacctggcatgtagtagatttatactgagtggtatgtgaaaggatgaatgggcacaaaatagatcagagtaaagccattggaagagatgggatttggtaaggttttaatcaagtatttcacttcttaaatactaaggaagtattctcagaattcagcacaatacaaattttatattaaattttaatttaaaaattagtctgtagacatgattgaaatattctctcaggagactcctggaaaacatgattaacttccctttcctttctttttctttttcttttttttttttttttttttttttttttttttttgacgttgtcttactctgcacccaggttgaagggcagtggcacgatcttggctcactgcagccttcgcctcccaggctcaagggatcctcccacctcagcctccagagtagctgggaccacaggtgcctgccactacgcctggctaattgtttgtatttttggtagagatgggtttttcacatgttgcccagtctggtccaaattcctgagctcaagcaatccacctgcctctgcctcctgaagtgctaggattacaggcgtgagccaccatgcccagcaagcataattaatttctaatgtctgagttcctaagtttaagtttatgcattcttaaaaatagacctaaaacaactatgatattctgcttcagaagataatagtagctttccttgctacccagagaggggcccataccgcattgttctggattcccattgtaattaaagggaaactttcaccatgtccagagtctttaatgtcctgcaaatgaagaaggatgtcctcaaattccttgcagcagaaacccacttagatggcaccaacctgactttcaaatgcaacagtacatttccaaaaagaaaagcgatggcatctataccataaatctgaagaagacctgggagaagcttctgctggcagctcgtgccattgttgccattaacaacagatatcagtgtcatgtcctcagggaatactggccagtgggctgtggagaagtttgctgctgccactggagccactcctgttgctgatggctctatttctggaacctttactatccaaatccaggcagccttctgggagccatgtcttctggtgcttactgatcccagagctgaccaccagcccctcacagaagcatgttatgttaacatacctaccattgctctgtgtaacacagattcttctctgcactgtgtggacattgccatccaagcaacaacaagggaactcattgagtgggtctgatatggtgggtgctggcctggaagttctgtgcatgtgtggcaccgtctcctgtgaacacccatggaaggtcatgtctgatttctacttctgcaaagacccttaaaaggaagggcagtctgcttctgagaaagctgtaaccaaggaggaatttcagggtgaaaggactgctccagctcctgagtttactgctcctcaacctgaggttgcagtctggtttgaaggcatgcagatgccttctgtgcctattcagcagttccctattgaagaccataacacagcctaccatggaaaattggtctgcagctgccactgcttaggccactgaatgggtagaaacaaccactgaatgtcttaagccatttttctacagacttttaaacaagatggaaatcaggttgatgaaaaataaacatcagttcctaaaactaaacaaaacaataattgtttttgaaaaaggaatgtatttttaggtgggaatgggatgggggagtaagtgttatgaaagtcagaagcatatgcctggcacataaacctaaaagcataggaatctttgtcataacatacaggatattgcaattattttgttaaaaaacccagaaagttaagaaaattgaacatattctaaattacaatggcattaacttcttttttttcttaagatatcttaaagaaggtgtggaactcgcagacattttctggtagttttgagcggactaatctattataactattatgtatataatatttatattatataaaatataaatattatatatttataattatataactataacctactataactattatatataaatgggtcatctcgttcctaatactgagcatcaaaaatgtgtgtatgtaatccttgaatgcgcttaaaggaaatatcaggaggaatgccacatcagccaggttgtatggatttgactttctatggaaagttttggcatggtaaatcttactttgtccattaccttacctgctatgtgatatgaattctttgcctgctaatcacaaatctcaagatctgggaaaatggagctccctagaacaggctatatattttttattgccatctcgaatcaaactgatgccgtttttcatgggagaactaataaaagtcatattctgtattgaaacatccctgtattttatggacccatctgatataccattaataaagttttaaaacaatctataatagattttgcaagaaccgcagatctgccagcactctcattaacagcccaattttaagcactactttaggcatgattatctacaaaatgttagtggggctgtttaatattaaaagactagtagctgaagaaaaaggaagctcaattactcaaaaatccagttagattgctatttcgagtaatttaacaaacaaaattgcattttgttctgttttcaaagtatgggcttgtattcatttcctggaatatgaagttcattgaaaatgccagtgtttctaagtgattctgtatgagaggagttgataaaaataaaaataccctttggcttgttaaaacacaaatgttttacgaatgacaccttgctcaatagtgtttcctcgaatgactatattctataaaataaaaaagccagagcctctggcctacatgatgttcacagaaaagacaatgagcaaaatcatcacctgtgattttcttagatatgtaattgtcttttttccattggcttctttatcagggaggatatcctttgtgcctcagacctgtttacaaaggtatttacttacctagactttcatgccttaataataaatgttaacaaatttaaacataaggtaataatcaaaaagaataaaatagttacttatatacagatgaaaaattgtctacactatattaacccttgcgtgtatgtgtgtgttagaactggtattttaaggtatctggataaattcataggaagttattaacagtattataacctctgtgtctgggaaaatatgagggggtcattaaaagggggagacttttattttcagttgtttcttctctgcactgtttatacttttttcttaccttgaacatgggatacatttataataaaaacaaaatattttcaaaatggcactattgtgctttctcaaattttaacattattttacatccagtaaaactattcaaagagaaaaatttgataaaatatatacttgttaaatttaaaacgtgcaagaatgttttattattagctatgatgaaagaaaaccaggctatggtaattagaccactagcattcatagtaaattttttttaaatatacacaaaaagacttcacatacttgctactagtcatccttctctactaaacatattagtggaatactagttaatattcattctttgttatatagcttaaacatctaacaccagattggcagtaaatttggcaacattcttagtttttagtttacaatttaagtcatgatagccattttggatcaaatattagtacttagaattacagaactgaaattagcatcaataatatattcttgttcattttattataccaaatcacatgtctgacttctaaatgtatttgttcattatgatttctctaaaattattttaagtttccaaagaccattaggccagaggtaggttaaagtaagaaacatatcatatttgaaattatctctctgtctctttccattcactgttctcttgttttatccctaatgattatctaatccttcatgagagaagggggacaaaatgagataaaataacatcctgggctcatgggtacaattcaataagggacaggtttccctgtagtattcttggaagaattacttacttactcagacagcaatgagctacctggtctcctcaccaagtaaagtaataattacaggacctgttttttgactttgatatatctgtttccttttttggatattactcccaggctgttaattgcaactgttatatttcaagcactggcttatatggtatctccatatgccaagtaggacctggacttttcaaattatgctttatgcacggctcactcctgcttgttatagtgaagatatcctctatgattaagcctacaatgtctttttaaaaaaattgttgctcagttcatgctaattatagtttgctattttaaatataatggagtcaaaacgtttcttttcagactaatgaggcatcagacaatttggggatttatctctatatataggttgttgttctttttctaaagccagagaaaagtaatttagaatcatttaggaggatctatcacctgatttataatttggaaccacttattcccaagtattggtattattatttctttttaagtaactgaggacataacccaacttttctaggcataccctgacttaatgtgagctttctctttttaatgaagtcaatttattaagggtgttactaagtatatatatatttttataacatttttatatgaatacatttataaataaaacattgttgattaatgtttctcaaaatttggttcaggaaatattcttattttctttctggaaagtaaataatatgaaatataataataataaaataattttagagatttaatggcataaaatcctgctttttacggtgaggttggtgagatgacaggttaagcctgcctaggtagctgcttggagtttcttggcctggctaaaaattgaagtctgttcttatctttgctaaggtttggagaactagttggcaattccctattacagtcagatattgctagaggaaattctgggtctcatggctgggtggaacttgaaggacagttgcaatgattcaagtagtatccctgtacacttttgcataggtgcacttaggccaggtgagtaccaggatcaccgaatagaataattgtaatgatataggagttaagaagaaatgatttaggcagatagtgaaggtaaggaagtcctcagtaaggttttacttttaataaaaagcagcctccaaatcatttcttttataacaaaaagcagtgtgtaaaataaacctgcagacatagacaagcaagcttctagcttgcttgaatgctggcagctgtgccaataggaaaggctaactgggactaggcatgtccaacatggtggcgccattgtcccctttccttgtcaaccacatgcacagtaaggagcaggcaacatggcagatggccaagtagagattttatttgcgtaataaaagattagggtagggtgaccagcttcctcgcatactatgtaaacatcaaacctggtccaaccaatctttgggccctatgtaaatctgacacggccttctcaagcctgtctataaaatcctgtgcactcttccttggggccggaggccccattcaggtgcacttctctctcccaggagagaaagctattctttttttttttcttttgactattaaacctccgctcctaaacccatttctcatgtgtccatgtccttgattcccttggagtgagacaacaaaccttgggaatttaccatagacaaggacaccgctccacttaaactgattgcctaaactaggacactttggagaataaagggaggagaagggaggtgcttaaataattaaaattttatagttataaatattgtaacataaaaaattattacattccataaaacaaatatttctgatttatcacttaggataaatgaaaacatcagtgcagcaaggacattcataccattctgtgtgccctgtagcaggacttctcagcttcccacaaatgagggtataatttcctaattatccactgtccctgtcaactaatggcaaaaggactattggagctaatcttctctagatttcctgaggacaaattgaccatagctaatatatgggtgatatctctacttcgtggaactgttgggaaggttacattgaatgggaaaatgtatggaagatgcctactcttctgacactcctagtgccccaacgtttgcttccttcttccttccatttcttcctttctttattttattttattttttttttttggagatggagtttcgctcttgttgtccagggctggagagaaatggcgtgatctccactgactgcaacctccacctccacggttcaagcaattctcctgcctcagcctcccaagtagctgggattacaggcatgcaccaccatgcctggctaattttgtatttttagtagacacagagtttctccatgttggtcaggctggtctcgaactcccaacctcaggtgatccgcccacctcagcctcccaaagtgctggcattacagacgtgagcaatcacacctggcctgcttcctttcatttctttttccatcactcactgcacactcacataaaatctacacaagactcaatcttatttttattatagttaggggttcacatgtttgtcttattagactcagcattccttgagtacagcgtcctttccatacatctgtatactacctaaggtccaacaaattgctggctcatagaaaataaatattggccgattgaatgtttctgattctgcccaaggaagagtctgctttccagcccatcagaggagcgcaagtctcactgggcttgttcagcttgatggcagtaaaggctcatgactttctttgttcatagtgcaaagtctactttcccatctataatttgatttcttgaatagatctactcaccaggaacatgattcactgtgaaaaaagaacagtccaaggttttttacccactaatatatccataaataggaattcagttgaacctgtgtgggtttggttcatcagaccctttatgtgaaccaaatattattcaaacctctgactccaccatagtgattgaaaacatgaagcaaaaagatcagggccagtgtatctgaggccaagccatgcacttaagtcagcctgcacattatgactagacacgtgtacattctttcacaagttgaaataacgatgccatgatgtgtctttacttttcaaggagataattcgtttttgctgaattttactttttttctgttcttcagccatttttctccccatgtttttatagtaatgtaaataaattgttaaataacacttcattattgacataatctaccatgtaaggaaagaggttttattcctgcttctacttctgaggaaaagaggactcagaaagattaaaattttcttatggtcaataacttatggcaccacagtttgttttttactccaaatctagtactctttctacaatgacacctaccccataaacatcttgtgcaaagatatttataatatctccaatgaagaatttacattgaaaatgtgttagcttatataccagaaatgcttttaaaaaatgtataataaaaatgtgataagaattgtgtgggagataattcaattgcccttgctttatataattattgtctattttttatgtgcatgacctagatcctaggtttgttggatatttttaattgtatgttacaaactgacttcaactctgtttacaattttttaggctgtttgattggtttattggccatggctgatgtttgcagatactctgaatggggaatcattgaaaggttttattagcagtttattttaacagcgcaagctgttcatcagaaaaaatagcacaaatgcatttgaatgttggtctccaggcagcaaagcgtatccttccacccagcttcctaaaagacctactaggaaacttggtgccacccacacccatttcttaggggctctgatttagtgttgcagtttttttctctaaacagacgtgggtgaaagctagccagtgaaagacttaagggaaccattatatctataacagtggattagaaaatattaatagtaatcaaaggaaaatagaaatagcaatcgatttttcattattgatttaaaaaaaatttttcctgctccttggaatctgtgtttagagaaccctgacttatcctcttagagcaatatggacttccttttttgatggttttttgttgttgttgttgcttcttcactttctcatttcttcatatttttttcttgcctctgtaaaatattgttaaaaccatggatcaaaatatacattgttaaatgtgtctttttgccttaaaatcctttttacacttataaaagaatatatgtttcttatataattcttagaaaatagatattttggggaattattgtaatgtgagttcccatattaagctcttttattctgtccagagatatgttagtggtaagtaaaatatatttttaaaattaggtttaaaaagccaaactaaaaaaattaagattaaaaaaaagactttttcatgttacaaaaaaagcaacagaatcacggagttgtaagtggatgtggacggacatagctaaaatctcagatattttgggctccatttctggaaagagtcaaggcataaaaactcctaacagagacttaaagaaccccacatatggtagatatgttagttttctagagttgccaaaataaaggcttaaacaaccgaaatttattgtttcatcattctggtggatagaagtctgagatcaaagttccagaagggccatgctcctgaaggtgctatggaaggatctgttccaggcctcttccctagcttctggtgttgtgctggcaatctgtgctgaatgttggcttgcagaaacatcaccccaatctctgacttcattattatgtggcgttctccctgtgtgagtgtctttctcttcacatggtgttctttttcgaaggacagcagacttattagattaggaactcattttgcttccatatgacctaatcctaactaattacatctgcaatgacactttttccaaataatgtcaccttatgggatactagaggttagaacttcaatgtataaatttgtgggggacacagttcaacccaaaacgtcagggtaccagggcagaactcactgcagggaattaggggctaggaaaggaggctgacttaagctgtttgttctaatttgcatacattggatggcgagaaggactcagaaccaggccaaaccacccgattgttccaagacagtctgtgttagttccattttctggaatgcataggcctcatgcaatacctctcctagagagtccagatgcaggcagctgcaaaatgatagaagggaggaatgaattcagagagagagcagaagaaaaaaaaatgcttttatgcaaatcgaagttgccaactaaaattctaaggcacatagaaaacaatcaatgccagctgggcgcggtggctcatgcctgtaatcccagcactttgggaggccgaggcaggtggatcacctgagttcaggagtttgacaccagcctgaccaacatggtgaaaccctgtctctattaacatacaaaaattagctgggtgtggttgcggtacctgtaatcccagctactcaggaggctgaggcaggagaatcgcttgaacccgggaggcggaggttgcagtgagccgagatcatgccattgcactccagcctgggcaacaaaagcgaaactccgtcccaaaaaaacaaaaaacaaaacaaacaaacaaacaaaaaaacaatcaatgccaaggaaaaaagcttaaaaaagaaaccctcaacattagaagatgaacttagtttcatcaacaagtgaataatagtaataaatggcttgtaattaactacggtcaaaatcatcaaaaagacagaaaaaggaatactaaaaatttaatgaaacaaaaactggcaactgtgaatcgaaaatgaggaggcatcaaaagtgtcaaaattgtgcatataggtattgatataacttaagaaagaattagcaaaagataatgctgaggatttcatttatagcacacagccaaattatatagagataaaaatatggaagaagagttaagctacacagatgatctactgaggggttacagtacatgggtattaggagtctcagaaacaggagaaatggcaaagaaggaatgtttggagagaggacagctaaaaatgttttttttttttcagaattagagaaagatatatactttcagattagaagtgaagattaactgttatagaggtaattaaagccataccacctctagtgaaacctcagaacatcaggaataaagaaaaaattctaaaatcagcaaggctgaaaagacagaatgcctaaaatgccatagttttttttatagtagaatctagaaaacaactggagcaatatctttaaagtggtgaagaatacacagttgatgctcatcatttgtgagttctgtaccaggagactgcaaaaaatccaaccccttaagaacaatagttaaaacgtcatccaggaattaaagtatgcttccattttttgtaaatttttgttcactgaaacataaagtgattttttaaaatgttaggtaatttatttaatggcacattttaaatctttatattcctaattgatcgtagtatttttattttaatttccatagtttactgggagaacaggtagtgtttggtgacatgagtaagttctttagtggtgatgtttgagattttggtgcacccatcatccgagcagtatacattgcaccatatttgtagtcttttatccctcaccctttcccaccctttccccctgagtccccaaagtccattgtcattcttatgcttctgcatcctcataacttagctcccacttatgagtaagaaaatacaatatttggtttaccattcctgagttacttcacttagaataatagtctccaatctcatccaggtctctccagatgccattaattcattcctttttatggccgagtagtatttcatcctgtgtatatataccagagtttctttatccactcattgattgatgggcatttggttagttccacatttttgcaattgcaaactgtgctgctataaatatgtgtgtgcaagtatcttttccatgtaatgacttctttgatttttttaaagcttagagcatcattaataaaatttaaacttagaagagatattcacaaattcaatgaaagcatattctttgtttacttgaatagggcatcacacctttagcaaggaacaaacaaaagaataatctatcacatggatactatactagtttgcttctgctatctaatgtttaggtaattttgatttagttttttttttcctgtattgtcctatgtttagtaaagaacccatctgtaataaatatttcatttttttaattggcctaaggcaggcctcaccttgcttgggtattaattgtttagagatttttatgtacttgaagtttcagagaaattttgttaaggaaaggcattttctgtattcttttcgtaccgtatatgcctttgttggaatgtctctgtatttagcattaagatttctgcaaaacctggccaggtgtggtggctcaggcctgtaatccggatctcctgaggtgaggaggtcaagactagcctggccaacatggagaaactctgtctctactaaaaaatatgaaaaaaataaaataaaataaattagccaggcgtggtggtggatgcctgtaatcccagctacttgagaggctgaggcaggagaatcgcttgaacccaggaggtggaggttgtggtaagctgagattgtgccactgcactccagcctgggcaacagagcgagactcagtctaaaaaatatatatatatatattcaaaacccagcaagagagcacttgtttaactgctaacaagaagcagctgttttccatgggcgatcaatcattattttctgtacttttttttccaataaccttattttcaacttatgtcgtgtcctgctgaggacatgttcaggaggcttgtcatgtaacagaactggacacagcttgagttttgaaacagcagacctacaactgaaaaaaggagtccaatatttccttctttaatgattctgctattataataataatggcttttacagagacaggcaaagtgtagatggagttctggttcctgcatggaaatttgtgtgtgttaagtggggatataggacagacaagaggatttttaagttgactattttacttcaagctcttttttgttgttgcttttatcttctcctcgggataatactttcacccttatcaactcgtcttagatgcccagtggtctccaccgtatcaaaagcagaataagggaagaataggttattgctgatttaattcttagtattactaaaagtaaactctctcagaattttatttaatttttatcagtttgtctttggtaaataaatctcaaatattttgaattaggagagataatttgaaaggatcctcctaaaacaccttaataataatgaaaataatattagaagctaacatttattggcttctcactatgtgttaggctctttgttatcaattttttaaatcctcaaaccaatcttatgggttaggcactattactgaggtccattttatacagataataaaagcttaacaaggttaagtaaccagcagccttagcatcacataaaagaatgttacaaatgcaaaatctcagcccccactcttgaccttaaaaaaacagaaacttagaatgtgaaacccaacaatctttttgttttaattaaccaattggttttagtaaaccctccaggtaaattggataccattaattttgagaaccacttccaagcctttctagtggaacttctcaccagtctttttttcctttgtgctagagggcaggggctgtgttatgtttgtttctgtgtttcagtgcctaaaaatgtgtcatacatgaaaagtgttcagtaaatgtgcactgcatagtcatggatgaatctataatgaatcatcctatgtagctgtatttggggatgatctgattattcacatgcccattttaaccaggtccgttttctcatctcttgggtagaaaggcctgtaatacctttccagcaaacattagtcttctgagacaccaggaccaatgtgcagtcatgggatttttatttgtgaattagagcattctttttaagacctcaatccctcagcaatgcagctgatgtattgtgctttctttctttcttttttttttttttttgttttggacaagatgggagtggggaatggaggataaaagcaagggtttctactatgttctaaggcattcaagagaatcacaaataagagtagctaagcagacgagtcttgaacacctaaaaaaaataagcatcaaattttgaaatactaatttaaatctgtgaaactacattataaggcaggtcataattaataaaacaatgtatgcagatagttattaacaatgttgagtgtgttactgtatcaagagcattagaatacgaatcagcaggccagggctccagactctttctgaccattacttgccatgtgctgatggatgaacatctaagctctctggacctgtttcttcatctgtgaaatggaggaaatagccctgcctacctcataagtttatttattcatttattgtcagtcacggtgatgaagcttcatttcacaagattatgagcctcataagtttgtttagacaaacaaaaaacacaatgtacaggtatttctactataatatgagttcctagaaaacctcacagccctaaaaatcattaatgaaaacaagggcacaatactaaaaacaaatgcaactttataacctgagctctatctaaaatgaccatactcataacaatactattgcaatttcaaagacaaatgaaatcctaataaatcaattctgcagtaaatatagaactttgccttaagaaaaaaaaggagagagagagagagaaagaaagagagagagaagttggcttgataaaagggggtaaggaaggattgaggcttttgagctatggaaggcaggtcaaaatatacaaagtgcaatgggtatgtgcttccaagagcatggatttggttaacccaagttaagaggaagaatatggagtaagggaggcattgtacgtagtcctaaagttgtgtagtgtacatttagctgctggcacttggttgggcaaaacactaatatgctaaaaaaatttagatctgaaccaatgcattaaattaccctaattccttcatttaccaatatcttatctgctaattctccttccagcagcacttgtttaaaaaacaggctgcatttgaaagtgttgtaaagcgtggcacagaagtaggctagtattattaacattactttatccaggtttataaagaaaggcccaatataactaaagtcattagtgtaatcaagtcctctatgaatttttcattaaatcttttacaatatgcaaatggtagtgtgccgagtgacttcaggaatattagtcaaatgaactatttgttgtggtctgtgaattctattctgagtgattgggatgtatctttggatgcaatcagtcaatgtccctgtgtttatgaaaattctacagcgatgccaagacaatcttagcgtctccaggaattagtcatttagaataactaagcctcctagaattttgtttctgcacaaaattattttcatttggaatcttttctaacttaaaattatggcaagtagaatagtatatcacaatagtaatgcatttcttcttaccatggccctaggagtctggaaagtataaaccggtttttccacccatttcttcatctaatctactctcctcacctacatttaggcacaccttccctggattttgaatccatttgcctcacaaagtggttgtgatgctgcaggttttgaaagcctaaacaacttgaagggaattttactagattaagtggggaaagaatttgggaaaatataaaaagtgttagacttttgtgtgaagactagaaaaaaaaaatacaccaagatgttaacatagagtctctccgaagagtggctttctgggatatttaatttccttttgaaaaattatttcctgttgtctccatcttgtaactatagtaatatgttatctttataatcatattttaaaatgtttatgcctgaggtaagcttgagaacagggtagggacctatttccttagattaagaagattgtttaagttctagttttaaaattctgagatccatctgtctgtctatctatctatctataatatctacctatcatcacttgtttagaggagaagagagtactgtgtcaccctttacagggatattaatgctgatacacaatgatatatataagtgaatttgaggtttttcattatggattggacaagattattcacacctctctctctttttgaaaacaaaaatgcacgtgtatagggtctgcttaatgtaaaaaatagtagttaatggcctccagataataaagtaatttctttagatttcatcctggtattcaatctgtaatctgggtcttcttcacttccctgttctttcattgaactcattcactgacatttttgaaaatattaagtagattttagaatcagtaagtgttaccaacaatatcagaaaaaaataatcttagtgagctagaatcacccaagaatttatcagccgaagtcacctttgtctttcatcttatgaagaggtgggaataggggaggtggaaagtaaattaaccctttttgctgtcccttaatatttcaggaaatgagtatatataaaaaagacttattatctctatcccttagggagattgtcagggtttttaatacagtattctaagaggtttggatacgatgctaatgagcatactgaactgtattcactgtattaaaaactcatttgcttcttcctttctatgtttagaaatgtttttaagaccagttgctagattattcattttcacctcattaatgtaaaaaagaaagtatgtttatggtcttgaactttgtgagtttggtgtgaggaaataaacagtagcttttaaatatgtatgttgctcttaatcaaaagaaaatctttcataggttgataatagaaagattcagcacattacttttgagatgacattttgataatgtatgatttaaatgggaaatatatgtattaaatttctgtgaaaatattcatgagaatattagagatacatttggatgtgaggatatttaaaagtaatagaaagtttttctgggctcaaaatatatttctgaacaattaaatttgaaaatctctactataaaaatctctaatatatttttattaaaggaaagaaaatgatactaaatgtcaaaatttatactcaaaataatatattttaaaataaaacttttatatccttatcctgtaatttctgtacttatacttaaagtattataccaaatgttattactcttgcttaaagaaacttttgagagaatcttgaaggtattttgttcagagtttattagaatcttagaatttcagttaaagttttcctttatactgagtgaaatatatggaacaattattaagcatttgtagcaaatcaaaataaaggtgattataacaaaaaatagagcatttttcacattgtaatataaattaaaaattagatgaaactgagcaagaatatcttttctttatacaactttccacttggttaaaaaattacagcttcagttaaaagtgcatacaaaatttatgaattttagaatttcttctttaagaaaaagctggttgatcatcagagaaatgctaatcaaaactatgagatatcatctcacctcagtgaaaatggctgttattcaaaagacagacaataacaaatgctggtgtagatgtggagaaaagaactcttatacactgttgttgagaatgtgaattagtaaaactactgtggaagacagtttggaggtgcctcagaaaactagaaattgagctaccatatgatccagcaatccctctactgggtatataccaaaaaaatgagacatcagtatatcgaagagatatttgcactctcacatttgtggcagcactgttcacaatagcccaaatctggaaacaatctaagtgtccctcaacagatggatgaataaagaaaatgtggcacatgcacacaatggagtactattcagccataaaaaagaatgaaatcctgtcatttgcaataacatggatggaactggaggtcattacgttaagtgaaataaaccatgcacagaaagacaaacatcacatgttttcacttatttgtgggatctaaaaatcaaaacaattgaactcatggacatagagagtagaaagatggttaccagtggctgagaagggtagtgggtgttgtgagagaggtagagatggtttatgggtgcaaaaaaatagagtaaaaaagatttggtatttgatagtacaacatggtaagtacagttaatattaatgtagttgtatgttttaaaataactgaaagagtaaattggattgtttgtatcataaaggataaatccttgaggggatgtatacggcattctctatgatgtgattactatgcatcacatgcctgtatcaaagcatctcatgtactgtataaatatatacatacttactatgtacccacaaaaattaaaaattaaaaaaatgaaaaagaaaaggtttgtcttagggaaatttcagtaaattgcatttgaagtttgttgatgatgggggctgagcattaatgttttttgtcttccacgtaacctcacagagtcatattactagtaaatacctgttttttattgattcagttaaccagaaatttatctgccattattatttttaagaaaacacattaaagctctgccttttaaaaactatcttttcttgatgttgttttatgtaactaaataatttgtcactcttttgctgtgttttatctttttcagttacaatgcctgtggaattttgtccaggtttctgagtgcaggcttccattttaattatctttccacttattttcaattatccataattttacttgcatttagtaaacatcttttctttaccacagttttatctctctttattaaacattttttttgctttaatctcaggagagcctcagagaagaaattcaatagtttccaccaatagactcatccttagaaattaatagtaaaatgttgttttacagaaacatgttacatgttcagaaatacgttatatattcccataaaactggaagccaaattatttccaacattaacattttactatatttttttgaaaattttttattgtgaattattttgtttcatatttggttttaagcccgatttttaaatgaattgtcacaaggtggattcccaggaagcacactctgagatggagataaatgagccagcattttatagggagtgcccttaggctcaacaacagtgggtggaaaggcggggaaacaggaatggacaggagaaaatggagggtgatgcagtcacacaaaagcttcagcccatcttaggggaagttctgaagctgggatagcccttcacagtagtcctcacataggaccaggggttgggtttttatactccacatgaaccagtcatttgatttgtgctgtcccagaaagggaacatgtccttggataagggagctatcttcagcaaaagcaccccaaggaggggtgacagctaaaggctgtagactggcggcactcctggcacgtggggtggaagccttcgttactgaaaggagatccgggtggtagatctgatagcatccactacagtagcctatcatgtgaagaggttgacacatttagtgagtgcaaattgagctgttttgagctgagggactctcataacttggcacacgtaattgagcagttgctgctttctttgcctacctgcttgaatccctgacgttttagttttctttgcatatttcgaaaaccaacaagtgatgtgctttgttttctgatattttgtgttacaaataaatatgaagacttcatagatttaaatgacagtgggtctgttatattgctatctgtgtgtagtttttcttaaaatattagggtagatttcaatatggtttctctgatgaccttgtataatttgaatggacacttttaattagagcctgcaaaatttctaaatgtgccatatggtttgcataaagatttagaataaaagtaaggataattattgtctgtggaatagctaaaagaatgttcaactagccaactatcaaatgtgattcagatgttaaaaaataaaaaactgaagcaacagtaatcagtttggaattacatgtaataattatttctggattttttattttctgtagaatttgtggtaaaatcttaatgaaagtattaaagactccctcctaaaaaaaagtacagacatacttgtcttattgcacttcactttactgtgctttgcagatactgcagtttttacaaattgaaggtttgtggcaaccccatgtcaagcaagtctatcagcaccatatatttcccaatagcatgtgctcacttcatgtctctgtgtcatgttttggtaattctagccatatttcaacattttttattattatgtctgttgtaatttgtgatcggtgatcttcgatataaatatagttgtttgggggcgtcacaaattatgcccaaataagatggtgaacttaatcaataaatgttgtgtgtgttctgactacgtcaccatcccgctgctccccaatctctttcctgctcctcaagcctccctataccctgaaacacaacaatattgaaattaggccaattaaaaaccctacaatggcctctaagtgttcaagtgaaaggaagagtcacatgtctctcactttaaatcaaaagttagaaatgatgaagcttagtgagaaaggcatgtcaaaagcctcttgtaccaaacagttagctaagttgtgaatgcaaaaaagaaaaaaaaagttattgaaggagattaaaagttctgctccaatgaaaacatgaatcataagaaaccttaaggctgtatgaagaaggttttattgatctggatagaagatcaaaccagtcataacattctctccagccaaagcctaatccagagcaaagccttaactgtcttcaatttcttgaaagctgagagaggtaaggaagctacagtagaaaagttggaagccagcagagcttgggtaatgaggtttaaggaaggctgtctccataacataaaagtgcaaggtggagtagcaagtgctgacagagaaacaacagcaaattatccagaaggtagagctaagctaattgataaaggtgtctatgctaaaaagtagattataaatggggatgcaacagtcttctattggaagaacatgccatttaggacttccatagctagagagatgtcaatgcctggtttcaaagcttcaaaggacaggctgagtttctggttaggggctaatgcagctggtgactttaagttgaagccaatgcttatttaccattccaaaaatcctaaggtccttaagagttatgctaaatctactctgcctgtgctctataaatggaacaaataagcctgatgacaacacatctgtttacagtatggttgatgaaatattttaagcccattgttgagacaattctcagggaaaagggatttctttcaaaatattattgctcattgacaatacacctggttagctaagagctttgagggagatgtacaaatagattaatgattttatgcctgctaacacaacacccattctgcagcgtgtggatcaagggggacaatgatccttatttatttaagaagtatgtttcataaggcgatggctgccataagtagtgattcctctgatagatctgggaagaataaatttaaaatcttttggaaagagttcatcattctagatgccattaagaacacttgtgatcatgggaggaattcaaaatatgaacatgaacaggagcttggaataagttgtagatgactttgaggagttcaagacttcatccaactgttgtggatgactttgaggagttcaagacttcatggaggaagtaaatgcagatgtggtggaaatagaaagagaactagaattagacttggagcctgaagatgtgactgaactgctgcaatgttatgaccaaactttaacggatgaggagttgcttcttacggataagcaaagaaagtgggttcttgagaaggaatcttgaaagagtgtggacgttgttgaaatgacaacagggcatttagaatattacataaacatagttgataaaccaatggcaaggtttgagagaattgattccaattttgaaagaagatctactgtgggtaaaatgctatcaaacagcattgtgtgctacagagaaatatttcatgaaaggaagagtcaattgatgtaacaaacttttttgttgtcttattttaagaaattgctaccatcaccccaaacttcagcaactaccaccctgatcagtcagcaaccatcaacatcaaggcaagaccctatactaggaaaaagataatgactcacagaaagctcaaatgatcattagcactttttagcaataaagtatttttaattaaggtatgtacattgtctttgagacataatgctattgcacagttagtagactacagtgtagtataaatataatctttaatgctctaggaaaccaaaaaattcatgtgactcactttatttccatatttactttattgcagtggtctggaactgaacctgcaatatctctgaggtacttttgtatggtggtgtagatatcagatataacttactctaccacatgtttggagcaggtacttaaaaatacattaaaacctagccaggcatggtggcttatatctgtaatcccagcactttgggaagctgaggagggcagattacctgaggtcaagagttcgagacaagcctggccaacatggcaaaaccccatctctactaaaactacaaatattacctgggtgtagtggcacacgcctctaatcccagctacttgggaggttgaggcaggagaattgcttgaacccgggagacagaggtttcaatgagccaagatcacaccactaaactccagcctaggtgacagagcgagacttggtctcaaaaaaaaaaaaaaaaaattaaaaaattttctgtgtggtaaataatgatgcttttttctgaagtttagattctgaaatgtgggcaattggctttgcttctagctcatcttaagttagtgaagaagttaaagaaaaccctggaaaggcgtaattgcagcaatgttattatatatagaatatgttatatattcactgtctgatagagattagcatcaacatgccgttggtgatttcagatgtccagttttagagacacaattcgtgtaaatttaaaagcacagaagcaatgcattcttattataatacgtataataaagaggaagtgaaattatttcttcagtaactttttctgccttttgtgctcacccttcccattgcctagatttaactgctgttatcatttctgtgggcatccttagtcttagtggtctccttctaaaatatatatgtatatgtgtgtgtgtatagattcaaaacatttacttagatgcatacacacacacacacgtatatgcacacacacataggttgattatccaagtatccttaatctgaaaatatgatatatgaaatgctccaaaatttgaaactttttgaagctcaaaggaaattctcattgcatcattttcaattttagatttttggattagggatactcaactggtaagtataatgtaaactttccaaaatttgaaaaagttgaaacccagaacacttctgattccaagcattccagataaggggttctctctctctttcatgtatatctatatatccacacacacagtcatctatgtcatgtcacatatattgggcatggactcttttctgtctttctctttgacttagtattatgacatagatatatgttcattccagcacattgaaataaaacttattttttcaaactgctgcacaatattctgtagggtaaagttaccatttatatataagcatgtaaaagaatataaattgtgttatttaagatatatttaacttgttacagttaattaattttattaaataggtaattttgtattattttgtttattccttttttctccacatttgattattatattttgcaaaagtttaaatatttcatttttattttaatattttgagtagaatattaattgtaaaataaatcttctattatgtattttaaagtaactttatgttcttctcgtctatattttccttttctctgaagcagcttcttctgtgctttttctcttttctgagaatgcaagttcctctacaacgttatataagagcaaatgccaggttcatcataaataggtacaatcttataaattaaagtttacctctaaatatagtttatattttgggttgaacttccaatttttgaaacatacatgataaaactctgacctactacagcacattcttccaatttctaatcaatgtccattcaaccacagcaataactgcttcataagctaaattagagtgccttcttattgctgataattcttggtacagcctcttgagcatcaagtgcaaatttcaagagaatccatccctatacaaattcagcgttatcagcctgaatccagacagcttttgcttccttttgaatgttactagcctgtacttttccatctctttcatttgtgctgcctttgtgaatccacaaaatcacgttcagaacagtagtggaagaaagagcacaggggttagacgcatgtttctttactaaagcacttcagcccttacaaatttatcttccttgttcaattctcactgagaacctcatctatgtcttgtttgcctgcagtcagaaactcttaaatgataagcctgaaaatgtatttttctaacattgtcacatcaggtgctaacagagttctcccttttggaatcagatacactctctaaaaatgaatgacttaaatcttggtccatcctgtgacatttgttgaaatatttctaacatccgccaaatatattcttggtaccactgcctctttgggatcaaagatttgtctcttgataagtggattttttttattatatctcttttaggttaagcaagttattttgttaccaagtatgtatattattattcatttttaattaatacatctttcttgggtatctactattcccaagatattatggtaagtgccaggggtcatttacttctagatctaatgaagtctttatgaaagatgaagaatctcagctgggacatgaaaaattgtagaatttctgcttatggaaaatggaaagatcactccagatgcagggttttaaatgagttagggcatagagttagcaaacagcctctgcaataataagtgacagtttgattcaggccctgagcacagaaaacaaagtagtgagatgttagtctggaaggagggtcagagctggagaactagcttggatgtgaggagtttgctgtccatcctgaagacattaggaacacactggaaatgggaatttgccaacatattaatagttttcagcaaacaaccaataactttcagacattggttcatgaaactctgacataaaggtcgatagtttgatagaataggcgaggtacaggtatccttcgataaagcagtgttagcagcacaatggccaggatggctgaactgctgaaggagccctaactcatttaaaaccctgcatctggagtgatctttccatttttccataagcagaaaatggtggcaatggagcagagactgagtgggggaccactggcttttgcagttggaggagggagcagaatgagggaacagagtgagcaaaatggaagacaaggaaaaataaccagtggtaaaggagtgaggaagatatatgctgaagggagtaactgatgttatgaagcctgaaggatggaaatggaatcagatggaaggcataatcttgtcaaatttactttaggacccatggcaaggaaaagaaaatgagtggaaacaaggcattttgtgccacaaagagggaagttaggagagtcttcactacctagccaaggtttacaataagatcaaaagggaggctgggcatggtggctcatgcctgtaatcccagcactttgggaggccaaggcgggcagatcatgaggtcaggagttcaaggccagcctgggcaacatggtgaaaccccatctctactaaaaatacaaaaactagccaggcatgatgccacgtgcctgtagtcccagctactcaggaggctgaggcaggagaatcacttgaacccgggaggcagaggttgtggtgagccgagtttgcaccactgcactccagcctgggcaacagagtgagactccatttgaaaaaaaaaaaaaaaatccaaagattcccagttcctggaaagtgagaagtgtgttcaggatgaccaatacaaaataagaactacagtccccttgttcaaaaggcaggaaagatttgttaaagataataaaatagaaaacatattttattgtctctctctctctttcatcctgtcatggtgtttttcatttgttattgtgctctttgaacatcgggatactaatagtgggaaggggtgtggagactcacaggtgccctgcaactcggctcaggagtgtttgagcaccagcacactgccctcatttggggcagaaaagccaatcttccctccctaccagcttgttcctctccccacaatggatggacggaacccaaaggattgcagcctctgagctgtgactcacacagtactgaatcgatagagggtcagtgggagggtcacccctactatgtcacccttcaaatgctttgtgacctgaactgagactggctgctgccataatctgcagaaataccagggagaacgtccaccaccttggccctcttgcaactgtgcccattccctcacaaaggggtgagggaagcagagagcaacagtagtctctgattggcagtggggagagggatgatgggcagccctgaggagagaagagatgcgaggaggtggaattgtgcatgaactgaggctccaagtccctcgtgcatgctccattgtcccacctgactaaaaggaagttccaagataaaaggaaattccaagataaaattaatagatatttcaagacggtgagcaggggccatcaaaccctgagcatgggacacttctaagttcagggcccttctaagttcagggcccccagcaccagtcacttgttcatgaagctagtgctgagtatatgttgtgtttgtgcacacgtgcatgtgtgtggggtgtgtgtgtgaggatgtatcttaagggcagcacatattgaaagcttagaatagtcattctgcagaattcaatagggaatcaacatgtgctgaatggtaaataatacatagttccttcaataatgctgtaattcatgagtgtctttggagttaaagcagaataagtggatggcagagccacattatgattattgtgggccctgggcacttggcactttcattttactggacctctttctccatagtaaaaaactaaaatgtatgatttataactgcattggtataagggtgaatatgttaatattatatatgaaaatatttttcaaccttaaattttttttcttctgatttaaagatattaaaacatatatgtgggcctctaaaagtattgtgggttttaggcacagtacctgatggataagttggccctagtggatagtgggtatcagtcagaaatgccacagtacttgaataataggatcaggggaagggattctggagagccagtggggacagcatgatatcctggctgggtgaaaacaggtaagtacttgagggaatgatgaattgggagccacggtgaaaggagaggtaagttgtcaaatggaagtttggggtcagatggagaaatgggctaagtcttttggtgttgaactactcaaaaatgaaaaggtttcatgcttttgtctagagataaaattcagtcatttgccacatgactgttttattttatgtctaattttattcatttgctttgctatatgtacctatattgtcatcaataaattaattccctaggaaataaattctaggaaaacattttagattattcttaaacttcgaaatggaaagatctctagattacattattttagttctaattttttgactgagattaacaacatcaatgagaaaaagaaatattgtttcgtttcagttgggacattaaaatataatcagtgcaccaattttttgtgcacagtaactttagggttttgaattcagcacatttatacttaatttataagtgctaatgtttctggaattattttaagcaatatagcatccgattatatatgagctactttataatattagaagtcatatttaactacaggttaagtgactacattaaaagggaatacaattattttaatggatttttaattaaatgcttaagtcctaggtagtctagaggtgcactttcaattaaattgatctttcttggaggtttggttaaaagctgttggcaagaagaaaaaaaagattgtgtttttagttttggtaaacatcagacaaagaaaggtagaaaaaagaacagtagaatgtaatttaataataggtgaaaaacataaacagacatctcactaactgtgtaacttgtaaacaaacataaaatgtctattcttggtagcaataaagtacaaatcaaagagaggcaccaattttactacataaattaattagcaaaatattgcattgttttattcattctatcttctatatgcaattttttatgttttaaagtatctctttttctctgattcaaaaaccatataattatggattttaccccctttcaaatgttgtgtaatgtggttatgttacataaataccgaaagacaagagggaggaggagaagtagcagcaggagggataggaagacataggaaacataaaacagcaagctccctacagctggaagtatttaatcagagtctgaatagccatttgttaaaaatgttgatgaagcgactcctatagtgtatcgtttggagtagtttatcttctaaggtcctttcaaagcctgcaactggataaatcagtgagatttctagtgttattaataaaatttcttactaggagaaaaaaacaaatggcattagaagtgacacaatttatcttcacaaacatgtaaagcaaattcaagcttttgtaatataaataaagagcgaatttcaggcatcctttttattttgttattaaaccttagcctgtatttgaggcattaagtaaatgaaaaactacttagtttcttaattatttgggaacttttaatatacagttaccttaaatcttacagtttagatcttttcctaagtgtggtccttagaatacagtatcagaatcacctggagagcttgctaaaatgcagatcccagtacattgaaactgctggatcagaaaatgtggagtttaagtctgaagaatcttcattttaaactaatttcccaagttattcttatgcacccaagtttaagtactacttattatgctcttgaaactcaaagtgtgatccatgaccagcaacatgaacatcgcctggagtttgttagaaatgcagactcttaggccctaccccatacctatagaatcagaataatcattttaacaagactcctaggtagtttgggtacattttaaggtctaggaagccctaattagacaatatccaaagagtgacaaaatgaagtcaaaacttcactgtttcgtcaagtatataaccagtggtttactttcactcaacaaatattcattgaaaataaacaccgtaggccgggcgcagtggctcatgcctgtaatcccaccactttgggaggccgaggtgggcggatcacgaggtcagtagatcaagaccatcctgactaacacggtgaaaccccgtctctactaaaaatacaaaaaaattagccgggtgtggtggcaggtgcctgtagtcccagctactcaggaggccgaggcaggagaatggcgtgaacctgggaggtggagcttgcagtgagccgagatcgcgccactgcactccagcctgggtgacggagctaaagaaacactgtaacagctaatatttgagaataaatgaaagacaaattctattctcatgaaatcaataatcacaacatcatttgataaataagggatgtttaaatattttaattctctaaaataattttacaaagaatcaacaattggcatttttcactgatgtaagaataaaacagattatgtctactagaagaaaatgatgtgaatttttaattgagtcccacttttataattttatatattttaattggtatacaactaattttgttgatgttctcagtcactaaattctatgtatttggtaatgtgatagagtgaagatctgggggcaacactacaaaggtattatctaagtggaagggaaagtgccacttttagaatggctgtataagctccaatcagaatgaaactctcacaaataacaataaactcaatatttacatagttgtttattttgttttaaattacctgacagcacaaaaatagagagattgtagaaggaaatcaagttggaagaagagggtacagtgattttcccatttttaagtgttttagcctgcaggcaggctcgtatctgcaccttgtgggcagctatgatagtgacacaaaacttagcagagggttttcctcaagtattaacagagtactgatcaacacatgcatgtgaggaagtcacacaaggctggagaaaggagcactcaaaaatattagagagaacaaacagttgccaataatgctcacataaggataggaatcgtccctcttctcatcaaccagacaagaaaaccttaaaacgcacaaaacactagaatgaatagtcaatggctttccttggtattattagcctttgactgaaaactattcatgtcttatatagcaagtcttaaaagcaagatgcaaaatgatcaaactgtttccaagaaacaactacatttgtgagcaacgctcaataatatttagaggaatacagagctgtccagcgtttaacaagtaaaattcagtgtctggaatccaatgaaaaattagtagcatgcaagaaagcatggatgtatgactcatcgtgaagagaaaaatcaataaaaactgaggtcactgatgtgtttttgaatctaagagtggggggaaagtaataagatttctttaaaacaagcaagtagaaattattgctatcttttcttaaacaaacaaaaaaaagaaaacatagttgtttcatatctcctacactttcctggaaattctatcctcttacctgtgaaagaaacaagaaatcttacaggataggaaggtaatttgaggagtatgtcagatttccctaaataatatgtctttaggcattcagaatatacagacctctgatttctaactgactgcaaaaatagctagttgattattacattttgctgaaaaggatactaagcttatatttggataaaattcaccaaacattgtagaggtagagggggaaagagagagaaataaaagagggggggagagagaagactgtatgactagtaataacagagcaaaatattttaaaatataaaataaaaggtaagtagtcaaatgcatgaacataagttggaaagggatatatggattactgaagagaagaagtacatgcctagtcctcgtaagacaacctctcttccacagtttataatctctctgccaccaatgataatctagtatcccaaaaggaaaaacaatatgtaataaatgttatagaacatgaagtatcatgaaatcagccatgaaaatcaagaagtatacatcattctatttgttttggtacatggaaattatttcttttcataaaaatacaaactaaaactacaggacaatataagtaaaatcatgtggagtggtctatcatagttatgtcggccttcccgtcaactctcccatccatcttagtcattctttgtctctcgctgtgtgaagaggatgtttctcttgtctagttaatcatttgacacctgattggttagtggctagaattagataacaaaccaggcatttggtgggataaatggaaggagagagaggggaagggttctgtgtaaaggaaattgttatcagaacttccatagacattttgtcatctagccatttatgctattctcatctgagcaaagcaaaaattattgaatcagcaatggtcacaaacatgaacagcatgcttatttaaaagaatgttgaccacagactcaaagttatctgactttttatcttaattcaaatctgagatccatcactaacaggacttgtgcatatctcctaatttcttggagtcttataatcatttcattatctttaaaattcatagtaattcttatcttttaaagtttcagggaggacaaaaggggacaaaaataattaaagtctgaaacaaggtaggaagccaaaacataccagttccctacctgccattcctctttcttagattacccagaatgtagaaccattggccataaaacagtctgtagacaggcctgatggagtaacagtcaacaatgtttacctgctctgataaatattttcgttgtcatagcatatgggagctcccaaaatattacccaaagcatacagttactggctcaacataaacatgaacaatgacttagagatatcctgagaataataattcctgtctcatagggttttaggaagaacaaagcagtggcttgtcttatgtcaggaatatggaatagcagatgcatttctctaaagatgctctttgagtcatccaggatggtgggctcatttttgagataaccctggattaatcaagactcttggttgtaactgagtgaaatttacttaacatcagcttaaattgctgctgttgttttttgggaggaagtattataatatgtaactgaaaaatgcagatattacccagctttcaggcagaattgtatccaggcacataaacgctatcttcagagggctgtctcttttcatctcctgattctacctttctctaggttgtctttattctcaggtagactcatcctatggtggaaaacacatcccctggaagctgaaagttttcactgtctcttgtaatggatgattccagagaaaaggtagtggtgtttgtttgtttgtttcctaacagccttagcaaaagtccctgatagaattttacttcatttggcttgggtcacatgccctttcttgatctactgaatgtgactaaaaagatggagtcctcaggtgtaggtccaaccccacagggtcagtgggtctctccccgtgtgcggagatgagagagtgtagaaataaagacacaagacaaagagataaaagaaaaggcagctgggcccagaggaccactaccaccaagtcacggagaccggtagtggccccaaatgccagactgcactgatatttattggatacaagacaaaggggcaggataaggagagtgagccatctccaatgataggtaagaccatgtgggtcacgtgtccactggatggggggcccttccctgcctggcagccgaggcagagaaagagacaaagagagaaacaatttacaccattattagagacttttagtactttcactaatttgctactactatctagaaggcagagccaggtgtacaggatggaacatgaaggcggactaggagcatgaccactgaagcacagcatcacagggagacaggcctctggataactgtgggcgagcctgactaatgtcaggccctccacaagaggtggaggagtagagtcttttctaaactcccccggggaaagggagactccctttcccggtttgctaagtagtgggtgtttttccttgatacttacgctcccgctagaccacggtccgcctggcaacgggcgtcttcccagacgctgccgttaccgctagacaaaggatccctctggtggccctgtctgggcataacagaaggctcgcactcttgtcttctggtcactcctcactatgtcccctcagctcctatctctgtatggcctggtttttcctaggttatgattatagagcgaggattattattatattggaataaagaataagtactactaactaatgattaattatattcatatataatcatatctgagatctatatctggtataactcttcttgttttatattttattatactggaacagctcgtgtcctcagtctcttgcctcggcacctgagtggcttgccacccacacttaggttgtctcagccagggcccctgtgcctgccctgtgactttgtggtggtcctggggcacgggaatgggaatagccccccacttcatcccagcatacatatgaggagttctataatcagggaaaagaaaggagtaaaaaagttctgtgcaggtaaatgcattactagagcctttcggagtcagtattcattcatcattattacagtttttatcaaactcctaagcataatataaactgtaaggtttctgtgtgttaagaaataaccaggttattttagttagtttgaccagcttggttgggatgtggagtggagtcagttagaaggagtaaggtccgttggagagatggaagaaaaagaggttgattcctgaacaccatttctgacttttaattcccagcttgtggagcctcatcctgctcccccagctccccagtgacccagagctgtacaaagtcccaaggctgtcccacttactatggaccaagcaatgaaataggtactagaaacacagtggtaagaaaaatgaataccatctctgcactcagcaagctaagaatatagtacaatagttgttgtttcctgggttgggtatttgtgtccttgctgttctttagaaatcacctaaagacacaccagcatgacatcttttccttccccattctgagttaacacaaaggatcaagtggttgaatcctcaggaagacagagatctgcccagaattatgcttcactgataatttcaaggctacaaggaatcaacaagcattgatagaacaagaagaagacaggaacatcctctactattccccaggtccttccattctgcagtgaacgtgctctctctaaccccaagtagtagatgatcatgggtgttttttttgtttgtttgtttggattcttgttgttgttgttgttgtttgtttttgtttttgttttcttttgagacagagtctcactctgtctcccaggctggagtgcagtggtgtaattccagctcactgcaacctccccctctcgggttcaagcgagtctcctgcctcagccccccattagctaggattacataggcatgtgctctgctaccacacccagctaatttttgtgtttttggtagagacggggttttatcatgttgcccaggctggtcttaaactcctgacctcaggtgaattgtccgccttgacttcccaaagttctgagattatgggcatgagccactccacctggcccgtgggtgtgatttctattctgtatactactgtcaagaactgtgcaatgtttgagattttaccctgcttttatactaacaagcttttactgtttcacagttgctgacagaagacatgagattcctgggtcagaaacaaaagacattattactcatggcaaaagaagcagccaggccttcgtttgtttgtgttaattccccgtgttcccccaactctcacaacaaggacacacaaacagcccattatggatgcctgcacctgcaattagttacattataccagggaaacactgagcttagggcatctaccacttttatagttagtggaaacaagtctattctttattgtcaaaggagatgttagctcatttctctgtggaactatagccctgaaaaatggcttgggtaaagatgatcagagccttgaattcttagcatacacagcaagaatatgtagggataatcagggcctgtggcaaattctttcccaatatatactttattttagaatgcactaatgtgttatcatttgagagtctcagtaatttgagaattccctttctcttttgtatctttaaatcatctctctgttggtccttttcaatgagtaaacttctgcaagtgtcattcaccttaaaaaacttcccctcttccactaccacactttactgtacaactacaacctcctctccttaacagtcaaacttattactaggcgtgtcttaattccctgtctttcttcctttatctccctcttctttgtcaacccagcccactaaatctggtaccaattgaaccactccactaacacagctatatatactaaataaattatcagtgtagtaaaatagagtatactatattatatactagtatatattataattatatgtagtaatatactatatagtatatacttattataccatatataactgtatatagtctgtatatatatttatataaaactgtgttaatgtagtgactcaactggtaccagattttagtaaataaataagtaaatatatatatgtgtgtgtgtgtagatatatgtttttatgctaagtactaaagtatactaaatttatatgtatatagtaaatatatatttagtgtgtgtgtatatatatgtatttattatatagtagtagagggagacagagagatcactgtggtgtggcatatagaagatattggagggtcccatggtggacatggagacagctgtaattaggttactgcaaccatcaatatagtttaaattagtgtggtgacagtggagattaaaaatgaaaagatttgacacgtgttagaaggtaactttgatacagtgaaatttggtattaggttggttagtatgaaggaggggaaagtgtcaaggatgacttctaagtttcaggcttgtgtttgtagatagatggtagttgaaaaatcagctcacatttttcccctgatcttagtccacatattcaactgcctaataatatccccaacttttcatctcttttgataattcaaaagaaaatggatttggtgatcaggcaagccagagataaaaccagaaactttaaactgataatatttcatcatctagtcagagccacatttacacaggtggagagaaaggacccagtatgtatttaaactgtcgttttatatagttcctgagcaggtaagtgtcctcctttcctcacttactggaggatgcttaactagcgtttttctttttcttctttttttttttttttggccgtgagagataataacaagtagataacaaaatttgtcttttgacttatgtacttgcccatcaaaatatttatttctaaaactgatctattcatctaatatgcagtgtttcttctcttgtgctattttggtgaatgccacaaccatctatccaattattcaaggcaattgaccttgactctttcttctccatcacattcacttaataaccaagtcatactgatttattcttcttaagttcttttatatctgcccacatctctctatttcttctgctactagcttaggtcctcatcatctttcatctggattttggcaatagttatttgttggcttctctgccttcagtctgccacccctcttatctattcttcactctgttagtgcccactgcatataaagtaaagtcataactccttaatgtagtataaaagactttccatgatcaggcccctgccacatctctagcaaaatctttttccactttaactctccctctagagagatcaaactaattgcatattctatgaacgtgcatactctcctcctatccttagcaaaagataagtcctttaagctttgttccttctcagtactgtcattctcttcaaaagtcctattcgcctcttttctaaactaagtggtttttgttattgcttggtgaatgcctgtgctagaaaattggtaacttttttttttatttgcagcaatagcagaaattagggaaataaaatccacagagttaccagcatgcatttatttcctattcaattagatctgactttcaagataccagagattgtagctgccaagaaaagaacaaaaggaaacacacaggataaaggatgagattttaaaaaaaaagtaaggagagatcattcaccatgaagaaaccattcaagaagccagctttaccatccctgccactgtcaggtttatcatgactttgtacaggcaattttataaacactaaacatttgtagtcaagatgaaccaagatgaaccatcaaattcattataattttgacagaatataatatctccaataaattctgtagggaacaactggaaagtatgacttttatgtactttatgaaatacagattaagtcattttacaggctagaggacaacaaatctttttaaaaagtagatgttacatttgagctgcacttggtgattttctcccactgtaagctgctccagtttaccacatgcatcagtaaagataattttgtttgcaagcaacagagtcattgaactaaaaaataattaaagggagttattggatgacctaacagaagttcagagatagggaggacttcaggcagagtttaatcagggctccaactccagttctctgtaagttcttcagttttgtcctgtattgattgactttatctttagtgtagcttcactcatggaagcaaagtggttatgcaaaatggctcacattcatacattatagtttccacagcaagagagcatctatgtcccaggatccccagcctatatgttgagcttcctactgactggatcttatctgaagtaatgcattcctcatgagaaagcctcatgcattcctcatgaagggactacctgatcaaattactgtggtaaatagagatgagattatgccaaataaagcccattctggatttggaagaggggcagtgtttatcaatcccacataaactacataatatctctaaagtgaaagaggtaaaatttccctaaagaaaacctgggaacccccaggtttatttagtatgaaagaaggaaaatggatgaatcccaaacaggcaaccagtcaatactcactacagacacaattcatagttgttcatcagaagatttagaaattattttgtaatccagatgtttcaagctacttgtgagtagtcaaaaataaatatcaagagtctgctgcgagggtgaaaagagggtaaacagaggcaaggagcccaattctgagaaattccatcagtgagtatagatgcattagaagattgaatggtgtggatgactctcaaactactcattcattcattcattcatccctatgacatgtatagggtgtaaatctatgccagaaaatatttaagtcaatgggatctttaaccccttaagaaattcattctatcaggcactgcagaattttaaggaagaaataagcaattttgatatatagagtgattgccactatagtagaacacaggaaaataaggccacatggaaaacctagcagagtcttcatgaaactcttcaatatttcttccaaacctaatacttctacagtgcaatctccaacataaagcaccctaggagcactttattttcaatcaacaagtatctgagagtagtatattaaaaggcaaaggaagaataatttatcttactctggttctcagttaaatggtcacacaatctaaaaaaaaaaatgaaacgattttgattgtttggaaacaatctcagggagctcttaagtacaaaatacatttgctaataatatgcattcttttaagatattatattgtatgtccatctgaggaaatagttttgagggatacataaagcaaaaatatttagagaaaggacataaaaggaaaaatagcagacatagtttattctttttgacagtcttttatagcatagaatcatgaaatcttgggtccatatcacagtggtaatgctgagaaaattctaaccactttatccttattcccagcagtgtcctggaactccaattctaagagtaaggctttccataagcatctagcatgaagatataactcagagagtttttgaaaaattatttcttcacatgaagtatacttgataataacattttaatgtaatattgaaatttctgattcttaactctgttgggcagaatcttgatagccaagaaaatcacttgtgacagttccagaataagggtctaatatcatagcaatttaacccagtttcatcctatatcagaagtattcgatcagaaaagaagtaacatttccttcaggttaacagaagtagatcatttctcgtaacagatcgtgttaaaattgtcttgaaattgcatagttttgcttactctaatacgtatatatatttaaatattttggtctgagtacagatttaggaatttggactgaattggtctaatttaattaaactgagaaatctagctaaattatgacatttgtgattcatgtgacattgaggttaaacagactactttctacactcttgctagttggaatttatggtccacagtccagtacatcagaattaccttggatctagttagaaatgcagaatctcagacctcagttgcagatctactaaatcagcatctgcattttaacaaaatccctaggtaattaaaacacttactgcaccaggcaatcttaactctgactacacattagaatcacttagggtgctttaaaaatgttttgatacacaggccttagccatgcccaattaaatcagaccctgtaagggtgggaccctggcactggtattttttgatgctcaccaagtggttctaatgtgctgccaagtttgaggacttttgattacacaatgcccaatcagtaaattcagtgtattctgaaagggcaaaaagaaaaaagaagtcaaaccaattacttagtatttggtcccactctataaatgattgattttttttaacttttaataagtttgctttgctatggtgtgaacacagcctattatgtctcaacctgcccagaaatgtattgtattttaaatcaagaagagaaatgctttaccatccaaattaaataaaaggagacttacgtttgtttttcaattttacttccctttggtgaccttattctccagcttgacagagctaaatgctaaatttcagataaaccactgtacttttggattgtccaccctgctctccatgcactcaattttcatttttcccctaagcctaatggacttcttgcctctggatttctatattgttcactgctcctgccatgcactctcacttcatggtcttatattgttagctctactagttagtggaataaaaatattatttaatttctacatataatctcaagcattaccatatgccaaaatcttacatatgaataggaaaaaaatcacagcacagtacatgtggccatcactatcatctcattttatagatggggaaactgagtctcagagagacaaggtaactggctaataagttcgaacactgtttttcccaagactatttgactcaaaatacagaggaagtttggtgtgtgtgtgtgtgtgtgtgtgtgtgtgtgtgtgtgtgcatgcttatttcaactatagtatagtactttaattaaaattctaggacagattaagaatataaacatgttaggctgcgtgcaatggttcacgcagtaatcccagcactttgggaggccaagctgggtggatcacctgaggccaggagtttgagaccagcctggccagcatggtgaaaccccgtctctactaaaaatacaaaaattagccaggtgtggtggcatgcacctgtaatcccacctactcagtaggctgagacagaagaatcacttgaactcggtgggtggaggttgcaatgagccaagatcacaccactgcactccagcctgggtgacacagcgagactgtgtctcaaaaaaaaaaaaaaaagaaaaagaatatgaacacattaaaacatattaaaaagaacattcattctcaaaatctatgcccactcttacctttggaatggactcagtgatttttcttattttcactaactttgtttcttttgtcagaaaactattgaagttcggtgggtgggtcaagggaggtggtcatactatattggtttctttaaaatttgttttcattgcataaataacaactggataactttttcctgtaaaaaattagaacatcatagatatgactaaaatctttgtgtccagcacagccccatgcacaccctgcactaaacccgtttgaacaccttttctcccccatcagaagtagcatcctttaagacatttcccaatgtatttaaatatatatggcacattgcaataactcttgaggatggcaaaaatcatttgtgatctaaagcttagtatgcttgaaaattaagagttttacttatgtctaaaattttaaaacctgggaaggatatctaattcgggggttgacaaaattaagattcaaaattatatcttaactccacagaataataccataaagtcagaaagataaaaatttagccatcataaatattgagccctgcgtaaaaatacaagtaacacatagagaattctggtttaacattagttcatatgaaaaagacctagaggttggttatcacagactcaaaacataataaaaatcctagcactttgtaaagtcagtaattcttatctttaaaataagattcctttgaaaatatcaggaattataccagaatatctactttttgaaggaaaatactaaattgtataaaattgtaaaatagagtgaactagtagtttttaaatatgggacttatttgatgacttaatatcctctttttatatattttgtctcttaattcaatgccaattaagagaaaactcttttgcttccctcaggtcatatcctctagtctttattacagtacaaagcactcattacagatcataggattttagcctgaaaaggtgctatgatgagtcattgcaatagtaatacttctccattttgatgtcttcttgaataaggatcttgccgtgtggaattaatgctgctcgttgtaatgctgattgtctagtaggctgactatattttagtgaagaatattcattcccaatattcttgctggaatatctgagattgggagcagggaatactatccattagcaggcattctatccgttagacacatgcgttcctatgctaagtctccaccttcctgaaagatgattatttctttgaaacttgtcaaaagccataggtttttatttaaaaataaatccccaaacaagaacattcagaatttctctatccaccagccacctgaaaatacctccctaggtttatggatattttctttttgtgattttagacacacaagtactgattacacagggtacaaggaagtgtagcttctgagagagaaattgatttttcttttctaacagaagatgaagatcatattcatttatcatgaccttggctgatcataagacataggtgatcatgaatcttgaccacttgctattttttataaaattaaagtaaccactcatataaacatggtatttcagaaaatggcatcttgagtgagaaggaagaagttgaatcaatgacacaaatgtatatttttaagaacaccaaaccatggtttcattttaatttatctatctctgccctgatgttcctcatagcacatgagagggagattcaaggtcttgactctattactggctttattcagcagtgccagaccaataataggtgtttatctaccagcgtgtgctgctcctgatagagtagcttattgtaattctcccctccagttttccttccccaaggaaatacctacatctcagatctgtctaattaaccaatatttgaagaatagaaaattacgagcaatccctatgctcatcattgatgggctttaaaaagctcgataaagtttctaggtacattttcttgtttacacgatgaagcaaaatggatcaaacaagcaaagatttgtggcaacagagatggtgcctttgtataatataacacatactgtgtatcaaagaaatattgtgccacttcttcgaagctgacattggaacgacattgtaatcctgaccatctgtcttcctcctctagatgtcgatgaacgtgcagtggtgaatggaggctgccagcagcgctgtattaacactctgggcaccttccactgtgaatgtgatacgggatagagactgcatgctgatgaacgcacctgcataagtgagtaaatattagaaccagcttgaagctgttttcaatgaaaatcgacctgcccatgtagaggcaggaaggaaaggttgttctattgtgaaaatatctatagaagctgacagttttgagtacaattctatcccttaggatttttttaaaaaatatattttgctattaaaagactaccagacaaaaagtggggaaggagatatagaaattaacattcagaagcaaaccttgaatccccaaatatgtaaatatttctgtagcatgtaatttctgccatatacagtagagtacacatttgttagttgttgcttatatacaagcacagcacagaactacaataaagtgaagatactgggccattataattactagcaacaatgtcactcattttagactagaaagaactggactcagaaccccctgactggaaagaactggactcagaacccccgattagaattcaagccccagcaaaattatagcagattatatgccaaatatattaggactgttcaagctcagttaaaactacacatgtgaaatctgaaattctgtatgttcattgtgcatcaaaatttcttaatactatttgtgggtagtaggattattattttttgtgtttgtatttttctgaattttctaaatttcttaaaatgagcatatgggactttcataaacagaaaaaaaactttaaaaatgctatgtttcctgtatgacttgtaaatgctccttgttgttttaactgaagtaatttacataaatattcttttttcattaagtgatgattctcagatcacataaaattgcattctaacttcctctccaggtcccttttgaaaatatttatattaaaaaaggagcacattgtacagcacaatttaattactggctttttgtttatagagtttgttaactagttcatccatacaaaattgtcagtatcttacaatgtaggcgataattatgaaacttggaatcgaaatcagccaatttcaactagctttataacatatacccctccttcttcttcttagcctatcttttaagaaattaaaaaaaaaaaggcaatgcaaacaggtaaagaagtcctatttgtaggtctgattttgatatgagaaaacaggttctgagagaaaaagaaaaaaaattcttgaagtcaagtgaagatacaaactaaagtcatatcctaggcttcaaggagctcaatatcataatgattgtatcgacagcaagcacaggttgggggacattaatacacgcatgtttaaatcaaaacaaccctttctttttgtgggattactggttttagctggaagaatccctttccatcctcatttccaatctgtaaagtctccagctagtaacatctttaaactgccaccataatgtctctcaatcacaaaatacataagagcagcaggattattgatacatgcagatgggatatttatcagtaaaagttgacctggtaaatttttgtttctgatttaaaaattttttgccaaatagtgatttatatgaatctacaatatctggtctttgtgataaggcaaaataaacactctagtcaccaactaaattgtatttataggtataattaatttggcagttcctagttatttcttagtaaaatcattaagctcttcccttattcctttccatcactgtccttgaattttcaaaaatttttaaggacatcaggtcaaaagtggagtttgacaaggatattgtaggttatcttttctctttctattcctttaaagctaattattattgtacatatacatgggcactatgataatagcttacttgcagctccatatgctgatctccttatgcagaatcttaacatagggaaaaattaaatttatatatgcatactgataacacatataaatctcccattttatatatatatatatatatatatatatatatatatctcgagtgaattaagctattaagaaatgtagagttaatgattgccgtcatttaaagtgtttaaccccttgataccattctacagaagttactgaactaaaagcccagcacttgacccttgcaaaaattttgatgccttttccacttaatacactgaagttttggtttcaaagggtggtcttaagaatttcagctgatacagcttacatttacagcagtctttttaaaaggagcccaagaataacttaagcactttgtattgaaacataaataatgtgtaagattaagaacaataactatttgcttatttgttctgaaagaaagggtttattgcagagaattgactttcaggctggtctgtattccaggctatcttgtaaacagggtaagttttttttttacattaatttatttatctatttttgaaatttcagcttttattttagattcatggggtatgtgcaggtttgttacatgggaatactgtgtgatgctgaggtttggggtgcaattgatcccatcacttaggcagtgaccatagtactcaacaggtagtttttcaactcttcccctcaacaattagttccccatgtctattgttcccatctttatgtccaagtgcatccaatgtttagctcccacttataagtgaaaagtatgtggtatttagttctctgtttctgtattaattcacttaggataatggcctccaactacatccatgttactgcaaaggatatggttttgttcttgtacatggctgcatagtactccatggtgtatatgtaccacattttctttatgcagtccaccactgatgggcatctgggttgatttcacgtctttgctattgtgagtactgctgcaatgaacattcgagtgaacatatctttttggttggagaatttagtttcctttgggtgtatacccagtaatgggattactaggtcgaatgatagtcctacttttagttctttgagatatctccaaactgctctccactaatagtgatttaaaaaaaaaaaaaaaaaaaaccattgaattatctcacatttccgttgagattttttacctggtagaaagctgaatatggtggttggtgtttaatgggagattgtagtagatggaagtttattatgattcacggtagagtcacagagaagaagataaagttatgaaatgttgtgatttcatacattagactacttgaaattaagtgcctccatttcttccttcctcctttccttcttttctttccttttccccattctgcttattagtcataggataagactagtgtgactttttgagttagagcctctggtgctttttgtactttatcttcatcaaagctacaataaagtaaactccccacacacagacacttacagagtttcagatgacttcatttcaaaagggtctcctttctcagggctgtgctcttgtagtggtgtgtgtgcagtgcagaacagtcagcctccgtcagaacaatcaagcagcatagagtggtgtaagggaaggagtccatggcagctggctaaggtggcaggaagtatgagtgcatggggcatgtggctcaccatacaagttgcttggactgctgatacaatgggattgcaataaatctggggatctttgtttagtggaccacagtttgaacccatggacttgtcagcaaatttttggaatgtgtcattgctttggaggccagggcctttgctcagattctttaagatgtctatggcacccccaaaataccccacatatatttttgtcattatgatgtcacttcttaaaaagtatgtaggagaaggatctcatgacattgttatatcatgttattgtctcatgatactgtcatatagtctgatgcaaagttgtgcagtgaatgcttctctcaacagctttctttataatgggatttgaggctaggaacctcagtccctgtccttgagaagcatgactcctgacccactgtcatttctcctgaaagaacatcaggaaaaccagcctgaaagcatgccccacgtatgaggagcatcacagcaagtgaaagtagctgcattttgttgatggaagggtgcagacacagcatggggaagcaaacaaaagtggaattcttgccacatttgctttgctattggtgttctcccttaacatgcatattatggaataatttttatatttttaaattttcttttatgtggagaccaacagtttaaaagatggaaaatagattttagcaatcatcagaaagacagagaaatttatattcagattagtgaacactgaatctcatctatgtggtctcgggactgtggcacaataaaattcaagttggcatgtgagcttaagcaagtcatttaatctctctacaccctggctgcctcctgtgcaaaacagaaattggacaattgggcttaaaattacttcatcactaaggtattataattttacagtttctaaaattactagttcattataaataatctgctaacttgtattttaaaaattctactgaatcaggcataactattttatagagctctaattttatttaaaaagtgttgaaataactcagctctatagagtacaagcataaaagcagtgtgagaattttgtgatctagtttaataaaaatgaatgagtaacttgcatttcttcttgaaaaaaaaaaaaaacttcggtgcttttgtgacaatactgttttccatatcacagaataatatctggaggggacccaaggattatgatagtccaatttcctatcttagagatagaaagtctgagagagaaagagatcaagtaagtaaattactgtgagaaagaaaaatttagtcttcaggaaatcctggctaatctcactcctgatcctatgacctcaaataacttctgttcaattttgttttgttttattttgagagagtctctgtctgtcacccaagttggagtgcaatgatgtgatctttgctcactgcagcctccgcttcctgggctcaagtgattctcctgcctcagcctcccaagcactttttctacaggtgcgcaccaccacgcctggctaattttttgtatttttagtagagatgaggtttcaccaagttggccaggctggtctggaactcctggcctcatgtgatctgcctgtctcgtctgttcaatatgttttaaaagactaagataaatcatgaaagcactgctaaaagaaattcttacattacattttagtaaacacagctaagggttaaaacaatgtatttttaaggtagctactgaagaaataaatctactttatatcatctcttgtcagttcaatcttatcacttctctcctacatttctgtgatatgctccaacaaaacctggctactctcagttctctaagtaagccatgcccttttctgcttctgcactttgctttactcttagcctaaaaattagctcacccccaagtctttgcctatcaaaactacacttactatgttccatgtcaaatgacctgtaatgctttctctggttacaacagccaaaggcattctctcttatctgaaatatcaagcaattttatttgtgttggtttaataatacatcataatatatagacttatgaatgtataattgggtttcagactaaatgaaagacactgatgaccttttaattgtcaacttcaagtggaatcttttccgttctcttcttgatagctgttaaccactaatttttctaaatcttccttttgagttcatgacagtgcaattttcactttcaattgctgcttctctgttactttcactctgggtaccagggttctgacttggagttatcatctgtgtctctcctctgttctcctttattcacccttcctctagtctatcttcattttgctcttctatttttatacatagtacttgcaaaatagttagaatattcccttgcacattgtattacttaaatataacctattagaatataaaaaatataaggacttcacccagatggatttgcttgttagggaaaacaaagttgttccagtatttctagcttttggaacgttgctgatattctcttttataaagtacattgtctttcgatagctgttaaatggtggtttttttccatggttgagaggcaggggctagtagatatagctaaatatgagaagtaatggtaatgtagactaaactgcttttattattagaggatgttttttaagagccaggggctacatgccaaaataatttatattacccgtattttcagtatttaactgtgtaatttacattttaagtaacttgtaaggctataatttgatatacctcacaaaatctttcttgaatttttatttttaataacaaccttatgaaacatgctcagctcagatctccattcataatcatgttcttcccttgatgtatttgctgaaattggccttcccagagggaagaaataattaaatgattcaaagttttaatgcttgcatagttctcttactgctttcatgctttcagtacataggtttattaacatctgcattcataaataaacaaatggaatctgatgtctgcatagagaaaccttagataaagaacattttaattacttcagtctctgatgcaagaattctttatttccagttgcagggaatgatcaggatctgtttttgttcaatggtctctttttagaagtccaatgtgatattcattgcacaatggaacccagtgacccctttttagtctcactaaatgaaaaaaaaaaaaagaagaaagatgacctagaaaatataatctaaagattttagatattttgtttgtggtcaagtgtgtgacatggtgcagtcaatggtgatactttaatgataattaagcagaagttgtgtggcaaggagagggtaggtgtaccagcaagagcttgattaaaataaagatgtccttactaaaactttgagcttgaataaattttcttatatcagatttttatgagtttgacatgttaaaataatgctaattttaaaaaaagattgagaaaactattagatgtggtggtcttcacaatgagttcttttgtttttgatctcagtgttctgatcactgatgtctaagttttatttgataagaggaaggattctttccagggaatgcaaagagattgccctcaaataggatatgaaagaggttaaagactttcattgtaactacctttcaattagttgcattatttatgaagacaaattagaaacagaattcatttcagatgacagctgatgtcttgaacagggccatgtcaggttaaaaaaattgtttagtttgtcagattgatggcatctctccatcattatcagattcatcaccctctcaagattaagcacttttgtgtggcagatgataaacttaattcccaaaagttaaatttaaggaacactttttctctgcccgtctcattctcaatctgtggccttagggaaaaatcatgaacttaagtttttcatccagagcatcgactgttaacccagtttagtaactttttacaactatttgagtttcaggaacacattaagaaatcttcccttttttttctgtagtttttgtacagtttgcagactcaggaaggtaagactgacaattttagataaagacagattgaggtttgaatctgactgtatcacgtaagagttgtgtgatcttagcccagttacggggtgtccctgattttcagagtccatatcatctctatgtctatgtgaatacctatatctactaaaatcaggataataattcacaaaaatcatgttgtacatcgtgaaagagcacataccttataaagaagaatgtatgtaacatactataatgatcatccatgggaaattgggaagattgagagtgggctctggggttaaaagtgaacaaataagagaggctcttaaaaggacaagggagtgataaggaatgtccttgtggtgtgatgaactccaccttctgtactggagattacaacaaaacaaaataatgaaatgtttgcgtagtggtcttcacatttggtaattggctttttgtacttctttctctttatgtggcaagtatctttacatgtcttccttcagaataatttttaagttatttttctagttccttttataaaatatatgacattaaatgataaaaccctaatattaagcaatatttaattttgttttcttgtgttccctaagtaatctcatagtgcattatagaatacccaccatatagcataaacttacatgtgaagagattaaagtcgtaactgacacacagtgaatgctcaataaatggtggcttagattaatgatttatgtatctactcctacattattttctcacaacctgaacacccgttcaatacagagatactgagaatgggagattcttcattgtgtgccactggaaatccaagactttagctttaaattattcattcatgaaaatataccatggaatttaggatcgagagaaaaatgatactaatctgaaaacagtatatcttgggaaaaaagttcctcccctttcagagtaacaatgttagctttaccacatagtttttgtttatttctttttagtttttttattttttaatttcgtgggtacgtagtaggtgtatatatttatggggtacatgagatgttttgatacaggcaagcaatgtgaaataagcacatcatggaaaatgaggcacccatcctctcaagcatttatcctttgagtgacaaacaatccaattatgctctttaagttatttaaacatgtacaattaggttattattgattagagccacccttttgtgctatcaaatagtaggtcttattcattctttctgtaccacccatcgccatctccccccatcagccttgaactacccttcccagcctctggtaaccatcctgctactctttatgtctgtgagttcaattgttttgatttgtagatcccacaaataagtgagaacatgcaacatttgtctttttgtgccttgtttatttcacgtaacacagtggtctccagttccatccatattgttgcaaatgactggatctcattcttttttatggctgaagagcacttcattgtgtatatggaatcacgttttatttatctattcatctgttgatggacacttaggttgcttccaaatcgtatatattgtaaacagggctgcaacaaatataggagtgcagatagctctttgatatactgatttcctttactttgggtctataccagcaagacggattgctggatcatatggaagttcaatttttaggtgttttttgttttttttttttttttaggaacctccaaactgttctccatagtttacaccatcagtgtacaagggttcccttttctccacatcctcgccagcatttgttactgcctgtcttttgaataaaagccattttaactagggttagatgatatctcattgtagttttgatttgcattcctctgatgatcaactttaccatgtagtttttatattacaaggtgttagacgttgagctaatgacataactgcttaataactcagcttctccatatgtaaggggacagttgaggaaaagtaacaatgcaagtgaaatctttagttcagtgcctgacacagagcaagcaagtaaaaaatattaggtaatattattagtatagttccataccttggaacttggctatagccatagaactaagtaaaattatgaagggtcagaaaccataagtataaattggctttggtgatcacattacttctattaggcatttttgttagtagttgctatggtgtgaatgtttgtgaccctagtattcatatgttgaaatcctaacccccaggtttatagtattttgagatgggaacttttaggagttgattaagtcaccagggtagaatcctcatgagtggctttagtgccttcataaaaaagaggcccgagggagcttgtttaccccttccaccatatggggatacagcaagaaggtacaatctacaaaaaagatgtacccttagcagacactgaatcagccagtaccttgatcttggacttctcagcctctagaactgtgaaaaaatatttataagctgcccagtctatagtattttgttatagcagccaaacagacaaagatagtagattttaaaagcatacattcactgactgtttcaacaatccccccttttctttatatttttgatattttttgagttttagagcaatattcacaactatgttttgactatataataacatactcccattctcatttatccctaggttgaagatttatatctccctttttccaaaagcactgaaggcagcaagctacaggaagcttatgcatttttacaggatacaaagtgcagaaagacattaaacataaaacagtattgcctacatctaaaagaggcagaaggaataagtgcttgcaaatagcagatatgagcagaaaacttaaatccaaatttagtatcccaatatagcttctagctactgacaagaaaagaatagcatgatttcagagtttgcatttttctgacacaagtcacagagacatcttttttggggggtggggggagaattcagtgatttcataatctgttactgaatacacatattttattttgcagagaaaatagaaatttttagctaaggtacctcccaacttttactcccacccagaactttaaaattaactctaagctctgcctactttgctcttcactctgaggaaaaagtgctctgctgtaatttcaggctaatcttcccatctctggataggatctcagctgccctcctccttagaacatggctccattacatgcttctttttcctctatcaccatcttctttatctctatcttaaaataaaacttctctctaaaactagttttgccaaggttattgataaattatacactgttaaattcaaggagtacttttcataccttattttgcttaatatcttgaaagtaatgatcttgccttctatcatagtctgttttctgctgctataacaacacaccagagatggtgtaatttaaaaagaacagaagtttatttggctgtcagttctggaggctggaaagtccaagagcatggcaccagcatctggcaatggtcatcccatggcagaaggcagaagtgggcatgtgaggcagagagtgaatgggggccaaagttatccttttatccaaagcccactcctgtaataatggcattattccattcatgaaggcagagatcttataacctaatcacctcttgaaggtcccatctcccaatacgattacattggcaattaaatttcaacatgaaatttggcagagacattcaaaccatagcaccttccttcttgacattctctctttcttggattatagaacacaactttcttttggtcccctcccatctctgtgatggcgtatcttctttcatggagtcttttccctccactcatcctcaaaatcttaatgattttcagtgttctaaatttggctctttcttttctccctcctgtgtaatctcttccacttgcaaagctttacctgttacaagtagctagcagggaatgatgtccaaatcaaattactaaaccaaatccttcttgtctgttgacccacagactcagctactgcctgggcttcttcttgaggaggtccccttagcaaggaaaacttagtgagtctaaaattcaacacgtcttcattcccacatgctcccaacttttctcttctcttttgttcttttttcttagtgagtggcagcaccccaggccagttattctccaggccagtgtagtacaccaggagtcactatggtttgaatgtctctgccaaaattcatgttgaaatttaattgccaatgtaatagtattgggagatgggaccttcaagaggtaattaggtcataaggtctctgcctccatgaatagattaatgtcatggcatctccttactctgactttacaaatctaatctccagtaaaaccaataggctcttcttccgtcacactccccaagagctatctccactatgactgcttacattaaggccctcataatctcttacagaaatgtttttgcaattgcctcttaaccagggttatcgtccatacttactccccttaactcattatctaaactacttccagagccaaagatgtaatttaaaaattattttactatgcttaaaacctcttattgtttttagaattgcttttagaatttaccccaaacccttactatggcttacaaaatgattcagagtctgacttctggctacttctgtcgcacgtaacaagtttctgctccatactttatactacaggctcagacacccagaaaatttgcagctccctaagtgtactcaggggatccacattccttacacttttcctcttagtgttctatctgccaaacacacctgcttctgcatctgttcatccagtagttttgataaacatcaacactcccttctcttaagttctccctttctctacttctttgtccctaacttctacttgtgtttcaaagcttactgtggactcacctctcctgagaagacttcccagatctattaacatactcaaaaccaaatttgccacctgttttaaaaaatttaaatattattttgatggcagagcacaacaaaaagacactcaggcagacgaaaagcagggcttgttgccacttacagctccaaatgagatagagctgccatgcagggctatacattgagttatacctgggactagggtaacagcaagctagaactggaggaggcagcttatgtatggtaacaaggtaggggcaggctaagtatcaccatctatctgaggattgggaataattccacaagcccaaggatagtgatattattcatgggtgttaggtatccaggaaactctggcagttgggtatgtgtgtgttgcatcccaggaatgttggattctcaccaaggtaagtagttggggttgggtctagcaaactgcctgtgaaggggaattgaggtttttagccatgattcaaaactggatcaggacagcacttgggaaatattataatacatcaccacatggagctaggatgtatctctaacatagaacttttcccagtgggttataaagctttatctttttgtgtgtctcttgcactagactttaatctctcctatattctcaatacctagaatgtgactgaaataaagcatttaactttattaaatgactatttttcagtgttcaaaatataaaggtctttgcaattagttatgctttgtttataagtaggagcttattgtctctcttgtgaacttctcttaatttgataagaggaattatataatacatggctttggctcctaggaaccctacactaagttgaaggcttaacttcagggattctacttagtctatattcctaatttaactatcatctcgaccctatttcacaacatggttcttgttttcttcaatgaatatttttgtacttttccccctccttttaaaccttagcattagttattctattgtagatatgttttagactgcacactgccttaaatcatctttggaaataaatggaatataaatgtagtaaaaataaattcaagcttagatttatcacctggttccttgcaaaaaccaacaagtgacatcattaacaatagtttaaacttcagggccgggtgcggtggctcacacctgtaatctcagcaccttgggaggctgaggcaggtagatcatgaggtcaggagttcaagaccagcctggccaacatgatgaaaccccgtctctactaaaaatacaaaaattagccgggcatggtggtgcacacctgtagtcccagctacttgggaggctgaggcaggagaattgcttgagcccaggaggcagaggctgccatgagccaaaatcatgccactgcactccagcctgggcaacagagcaagattctgtctaaaaaatataaaataaaaaataaaaaccttgagatttaccaaagatataaacctgctattcagttgggtggtttgcatattggtcttttgaaattctgagtctttctgtcgttgccagggcacaagagagagagagcatgacaggaggacgaaccctggacaccacaccacaggaataggaagaatgcctagggcttctcagagcctagagcctgttgctgagaggccacttcataaagaggctacttcataaagcctagatcctggtgccgagaggccactgttattaatgacagtcaagggaaaagctgtggtttgagtcctggatatcatttcctatcagagaataagagcaaggagagggacacactacatacataaaaggactgaggccaccattcagaagttcaggctgaacaccaaatcataaaccagtatacataaattcagaaaattagtttgaaaggtgatatggttaggtgttgtgtcctcacccaaatctcaccttgaattataatctccataatccccacctgtcaaaggagagaccaagtggacgtaatcgaatcatggtggtggcttcccacatggtgttctcatgatagtgagtgagttctcacaagatctgatggttttgccaagtgttcgatagttacttctgcatccattctctttcctgctgccttgtgaagaaggtgccttgcttctccttcaccttctaccatgattgtaaatttcttgaggcttccccagccatgctaaactgtgagtccattaaacctctttcctttataaattgcccagtctcgggtagttctttctagcagtgtgaaatcagactaatacaaaaggcatggaagaagtggtgtcaacaagtataaaaccaagttaggattaaaagttgagccaaagacaagcaggaagcagattttcatctctgacattgaaagcttttcagggaacatctcttcagtagtcgtaaataaaaaaaatataaccattgacctgactgtcaggactgtatatctccttcccctgcaggcttctagtgtgagtgggcaaagactgctaggatatggaacattccctggggagggcaggtctcctcaagactcagtctttgggttgacatcttaataagaagctgaacaagcatggtctaagtactctgccttgagacttaactttaattaacccagagattcacattctagcattgagataacagtagtttgcagataattttggctatgtccattagcaataataaattaccgtgactttaaaaaaatattatctcaaatcctcacaacaaataaagggagaaatactatgatcctcattttaaagatattgaaatggggttacacagaggttaatattatagctgtggaatcacagacttgggtttatagccccacagattactgctcttaagccaataaacatcatagggaagtgtattcaagtgtgttttatactttttgaagggaaaaaagaagatggatagatggttgggtacatctgccatgcaatctttgctaaaattctttcttccaggctatatgatatggtaatttaagtcttattttatcccaagtttgggagtttacaaagattctctctgtttcctcttggaaaataaaaagttggctcattctgtagactcccccactggttttgtctggactgcagtgggttggccttctgtctgggcaggaatacaagtctgaatcttaagcttttacaatggaatgtcaaccttgtctccccagtgtctggtgtgtaaatcttatggctctcacttcaatcaacaatatagaaattctgcactacaggtctgtgttagaggatttgactgaactgaatgggagccagcattcatccaaatctcccttaagacatccgatatacagagtgcatagcggaaagatcatgagccttagcaccaagaagctctaagttagaatcccagctttgcacctgctagctgtgtgaacgtggggatgttgttaaatgataacaatggataatatttatggagtacttgttatctataggagcacagtgttaagcgcatcacatctactgtttcatttaaactttatgaaaccctatgaggtgggagatattgttgtcaccattttaccattgtgaaaaaaatgacgcttagaaagtttaaataacttggcaaaggtcacacaccttctaagtggtagatcctgaatatgtcttgagcagagatgaccaattgaatccagttgtgctaaaacaaacaaaagccataactatgcaaaagtaggttgcttggattttattgttaaagctttttaaggaagggaaagacaccaattgaaatataaagtgttgtgttaaaagtgttgcagtgtgttgcagtgttgtgtgaaaatgagtttgttatgtatagaatcagggagcctgagaaagagattattgcattaagatggaactagtgaaaaattctggcactgtgggtaatgataataatcaaggactgaatgccaagaaactgcagtgcttttcctatgcatacttagccataaacattttattttaccaaaaaaaaggttttatatagaccacataaaatttcatagttagattttttcacaaacatttaaaattagctttatcaaagtcaatacaataatttcagtatgcattcaaagggcaagttctaaaactttgctacattgtttaataataacccaatgattaataataaaaaacaggttccatgacttatttgtatttgacattgtttaaaattggatttgaaggtttttatattgtatggttttgaatttgctaaaaccttcatcatattggttctcaccaaataagattcatggattgtaaaccaatagcatgaaaggtgtcttggcctgttctgcttggtcataatcccagtgcccacattcatttattttagaagtgaatatagtatgttactcaaacttttaatcattgcaatggaatggtttgactgatttcctgcttctaacattttcatattgtatgtcaggaaaatgttcaagatttcagtgtatctcctggattcaggggacaaatgtaaatttatttttatactgagccaattaattaggcctcttttgtctatggagaatgacctgacttctacaactcacattttaaaaaattatttaagtttgaaaacagtctaatttcaatctggtcttatttccaaaaaaaaagatttaataatatttcttatttctcattataacttttatgagaccctgtggtataagaactacactatttcatctcttagtatttccataagactagtgaagtttttgctaagtgccgtatcatatacatatcagaacagtgtattaaaactaggaggaaaaacagtggattaaaactaggaagaaaaaaaaattaggcctctgcagccttactccacagtgttgaaacagccctgcctttgttacacagttgattaagcccatggtataaggaatttaaacttgtatggaatcattgaactacaaaatttaagatgtggaagaataggcttccttcattccagtgactgacatatttgctaacccttctccttgtagcaagcataaattagtaagtgcagaatctcagattcagtaggatacatcttgcattggaagcaaaaattatgagatcaagaataattgatattctatgtgacccattaaaataggtcttatttaaggcaatactgtttcaaattgtatctcttttaagtaggctaacctgaatgtaggcaccctttttttgcactttacagcaaaactaagcaattcccgcaaccatcccgatcagaggaccttgaactgagagcacatgtttaatgatgcccagactagctattgattaaacactgacagtgttcagaggaattgagaatcaaaaagtctcccccatggccagctctgccatgctcacttcttaatagatggcaaaggaggattctaaatgagatccgctgccctgcgcatcctcagaactccacaggcaatgggattaatttctgctttgcagttttttggaactactatgtctaaaatgtccatccttctccagaatttactacagatgtccctccttttttattttttgttcctcttctttgaagaaaaaaagttttcatatgaatttaaggcatagaacaatatcctttcaaatgtggaatgaattaaagctcactgttaattactctataaacaaataaaagaacaaatcctggagaataattcaggctgaaatatcattctctaaatcaaataaacaacaatataaaaaaggctaaaagaaaataaaaagaagaaaggtttcagacaggactaatattctcattggcattgctccattgagttggttactgcccagaggcacagatatttttaggatattcttttgtctggtaggagattatgacccagaactgtgaagtaaggctgtttctacacttaaaaaaatgtaatttccaatggtggaaccacccagctgttttaccttcaacaaacattgatgaaacacctagagggtgtcaggcacgttgcttggtactttcccttttaaaattatttaatccctccaacaatccatgaaatactcattataatccttttaaagatgtgaaaactgaagctcagaggaattaaataaatcctctattatcaaacaatcagtaaataggtgagagcaaagtcacattgttagaaactgtcagaacaaggattaaaatccagatatcttgattaatattatattggcataattactgtatagtaccttccttggcttaataatacacatttaatgaaaataatatacggattttttaaaatcattgtttgctcttttactattttatttctgattttctaaggattacatccttagggtgaatttttttttaattacaaaaaagggtaaataaggatagaataaagcaatcataatcccaccactcaggggcaaccattgttaatattgcacttattttgttccagtgttttgtctacatatttcttcataattgaaactatgctacctttttatatattcatatatacacagaacacatattttacattcacacatgcttctcaatatacattaaaactatttattaaactcactataatggtggtaaaaaccttttggtatgtatttatttatatagtcatgtatatcatggtatcttttttattctcttctaatcaatatagatattaatattaatttgtgtatatcatttagatattttgtttccttgggatgattttaaccaaagggattaaagtttaaaagagttaaaagaatggatcttaaaaaatgttgatacctattgtcaaaatgtttttccaaattttaagacaatttattgatccatcgtcactatataatacttcctgtcttatccttactggcctcaagtttttctttgtccctttcagtctttactaatttgataagtaaaattatgtatattcttttacttgtttcagtaagttccaattctaaaaatgtattcatcatttgtatatccttttatgagtttgctgctaaggtactttgcctaattttttcttaattgtgaatttcatattttagaaagttcacatgtaaattatatattatataatatgtgtaactttataaagcaagcataacaatcctttgtcatctttgctacaaacatgtcatggtttgctattttttaattgagctcatattatatttaagccattttttttagcataaaagcaatatagggagtgaagtcaccaagatcgtggaatagaagaaaacatgctcatgttccatgacaaaagtaagaattctgtacctatctatagtcaaaagtttctctgcaggagttttaggattcagataggagtttctaaaaccctggtaaagcccaagaccaaggagggtcattttgagagggcagaccagcacctagctggctgatctgccggcttgctcccaagttcaagcccagaaatggcctagtcccccaagggggtttgctacagccacttttggccttgagtctgccaccaaaaccatctgccaagaggtctagaaagaatcgtacatactagtgccttggtgggaaggcttgctgatacttgttttggcagtgaacctgaaagttgccctgtggctctgttccaacactccttgtctgaggtctcagctcagaggtccttgcacaaggacctagaaggggatgcccatatctcacagcctggaattctgctgaatctctctgatgggatctccaacctttattgcatagcagatcccaaggggacccagttgcagcactagccccttccagtgcagttagggaactctcccatctgtgctgaggcctgctaggagatacctgtctgggccaacaagacaggctctccagtgactgtcccacagcaggtctcaagggggcccagtcttagctctagtgcttcttgctgcagtgggggaaaaaatcccatctgtacagcaacctgctaagtgacacacacccctctgagtcaatgataccaggctcactagacacccccacagcagactccaaggaggccactctcagctccagattctcttgtttcagttcaggaattatctcatctgcactgaaacctgctgggagatgtgtgtctgtctaagccaatgagataggatctccagattgtgtcccacatcagatcctgaagcagcccaatctcagctgtggaccctcttgctgaagatgggggactgtcctctctgtacagaaacaggtggggaggcatacacatctgggccatggaggcagtctcctggactcagatcccagccatgtctacacagctccagtactctccttgggtcttccccagctccgcttagccagaaagctccatcaaaattggagccctcatgagacttgtggcaaacttgggcatagcacttcctctagcgttgggacaggtgcaatgatcacagcctctgggaacataacagtcaggccgcttagaatttctagaaggccttctgaagaaaaacagacacaaacaaatccagattgcaaagactgaaataaataccttatctttcaatgtggagatattgccacaaattaagaacatttaatatgaccttatcaactggacaaaataaggcatcagaggccaaccataaagtaatgaagatatgttaactctcagacaaagaagtccaaatagctgtttcaaggaaattcagtgaactaaaaaagaacaaacaaacaaacaaaaaaccaatttttgaaaaaaataacagagatattgaaataagtttaaaagtcaaacaaatcttggaggttcaaaatacaatgaatgaaataaaaaatacagtggagggcaccaacagcagaactgatcaaacaggagaaagaatcggtgagctcaaaacaggctatttaagaatacactataaaaggagaaaagagaatgaaaaggaatgaaaaaagcttacaagatctatgggacaaaatcagaagataaaatacttgggttattggagttaaagagggaactgagaaagataaaagggtagaaagtttatttgaagaaataataacagaaaaatttccaaacctggagaaagatataaatatccaggtacaggaaagtcaaaagtcaccagtcagattcaacctaaataaacatatgccaagagatatcctaatcagactctaaaaaatcaaagacaaagagaagattctgaaagcatcaagagaaaagaagcaaataatatagaagggtgatccagcatgcctggtagcagacttttcagcagaaatcttacaggccaggaaggagttagataaaatatacagagtgctgaaggaaaaaaataaaaaataaataaactgtgaatactgtattgagcaaagctatcttttataaatatagaagatataaatgctttcccagacgaacaaaaactaagggaatttatcactaccagaacattcttacaagaagtgctaaagggagttctttaaactgaaagaaaaggatgctaacatgattgttacactaatattgtaattatggtatgtaaaccacttacatccttcataagaagactaaaagacaaaactcttaagataatagtaactacaacaatttttaaagaaatgggcaatacaaaaatgtaaatggtgacgccaaaaatttaaaatatgagaagacaaagaagttaaaccgtacagggtttgtttgtatcttttttgcaatcaataagttaagttggtatcagttttaaataacttcttataactacagaatgttttttctaattctcataatagcgtttttttctaattctcataataattacaaagcaaaaacctgtaatacatacactaaaaaaaaaaattaaaacatattaccagagaaaatcacttagccacaatggaaagtagtaagaaagaaaggagttaaaaaaaacaactataaaataagaaacaaaatggtagtagtaaacctttaccaacccctaataacactgaatgtagaagaactgaatgctctaattaaaaaaatagagtgactgaattcattaaaaaacaagtctcaactatacactgtctacaagaaactcacttgacctctaaagacacacatagactgaaagtgaagggacgggaaaaagtattccatgtaaattaaaatcaaaaaagagcaagactagctacatttatatcagctaaaataaattttaactcaaaaactaaaaagaggcaaagaatgtcattatagaatgaaaaaggagtcaattcagcaggagtacatcacaatatatatacacccaacactggagcacccaaatatatacagcaataatagatctaatggggagagaaagactgcaacacaataatagtaggggacttcaacacttgactttcatcaatgtacagatcacccaggcagaataccatcaagaaacattgaagttaaattatactctaaaccaaatgaacccaaaagacatttacaaaacattttatccaactattgcagaatacattcttcttattagcacctgaatcattctccaagatagaacatatgttaggccacaaaacaagtctccacacaaaatcatatcaaacatttttatagacacatccaaaactagaaatcaataacaagaggaaatttggaaattgtaaaagtatataaaaattagcaccttcctgaatgatcaatgattcaatggagaaaataaaaagaaaatttaaaaatttcttgaaacaaatgaaaatggaaacacaatatatcagagcccatgggatccagcaaaagcagtactatgagaaaagtttatagcaataaatgcctatactgaaaaatataaagatttcacataaacaacctacctacacctcagaagcctagaaaagtaatgataaaccaaacccaaaattagtagaagaaaagaaataataaagataaaagcagatataaaaaattgagaatagaaaacaatataaaatctctatgaaactaagttcatttttatgaaaagatcaaacaaaactgacaaaattttagctatcctaattttaaaaagagaagatatcaataattaaatcagaaacaaaaaaggagatatatcaactgataccacagaaatacaaagaattattaaaaactgttatgaacaaatacatgccaacaaattagaaaacttaaatgaaaaggatacatttctggacacttataatctactaagattgaaccatgaagaaatagaaaacctgaacagaccaacagtggctaacaatatcaaaacagtagtaaaaagtctcccctcaacgaaaagcccaggaccaaatggattcactgctaaagtctaaaatcatttaaataaaactaacaccaatttgataaaggccatatatgattaattcaccactcaaactattttacaaaattgaagaggagggaagacttccaaacttactctataagaccagcattcccctgataactaaaaacagacaaggtcgcaacaacaacaacaaaattaatgggcaatatccttgataaacatagattcccaacaaaataccagcaaaccaaactcaacaacacactaaaaagatcgttactgtgatcaagtgagattcatcccagggatgcatggatggttcaacgtacaaaaatcaataaatgcaatacatcacatcaacaaaatcaaagataaaaccatattatcatttcactagatgctgcaaaagcatttgataaaattcaacatccttcatgataaaagttaacaaattgggtacaaaaagcaaaaagaaaatattgcagcacagtaaaggccatatatgacaaagccactgccaatgttatactgaatgggaaaaattgaaaacctttcactaagttctgcaacaaataagaatacccactttcaccacttttatttaacatagtactggaactcctagccagagaaattatgcaatagaatgaaataaaaggcatccaaataagcaaagaggaagtcaaattattctagtttgcagatgacatgattttttatgtagaaaaatctaaatactccagcaaaaaagctcttaggactgataaatgaattcaggaaattaacaggatataaaatcaatgtacaaaacaactagtagtattctacacactaagagcaatcagtatgtaaaataaatcaagaaagtaatcccatttacaatagctacaaaaactaaaatctctaagaataaatttaaccaaagaaataaaagatctctacaaggaaaactataaaacactgatgaaataaattgaagaagacacaaaaaaattggaaagacatcccatgttcatggcttgaaataattagtattgttaaaatctctgtactacccaaagtgatctagagatttaattcagtctctatcaaaattcccctgacattcttcacagaaataagaaaaataatcataaaattcacaagtaaccagaaaagaccctgaatagctaaagcaattctgagaaaaacagagcaaaaccaaaagctggaggcagcacattacctgattttaaagtatactacaaagctataatagccaaaacagcatggtactatcataaaaacagacatacagaacaatggaacagaatagagaactcagaaataaatccacacttagagtcaactgatttgcaagaaaggtgcatttgggaaaggagagcctgtttaataaacggtgctgggaaactggatatccatatgcagaaaaatgaaactagatcctcatcttttgccatttacaaaaatcaaccccaaatggattaaggacttaaatctaagacctgaaacttgatactactagaagaaaacattggggtaatgctacaggtcattggccagggcaaagattttcggggacagacctcaaaaacacagacaacacaaaccaaaattcacaaattggattacatcaaactaaaaaccatctgcagagcaaaggaagcaatgaacataggaaagcaacaacctactgaatggggaaaaattgcaaactacccaaaaatagattaataatcagaatatataatgtattaaaacaactcaatagcaaacaccaaataatatgattaaaatatggtcaaaagacttgaatagacatttctcaaaagacatacaaatggccaacaaatttatgaggaaatgctaaacattaagaaaaggagatatcatctcaccccagttagaaaagctattatcaaaaagacaacaacaacaaaaatatcagatgctggcaaggatatggagaaggggaacatttatacagtgttgttggcaatataaagaagtatagccatcatggaaaacactagggaggttcctcaagaaatgagaaatagaactactgtatgatccagtaattccactactgagtacttccaaaaaaaggaaattggtatattgaagagatatttgtattctcatgtttactgcagcactattcacaatagtcaagatatagaatcagcctcagtgccactcgatgaataaatagataaaaaatgtggtatgcatagacaatggaatatcattcagccacaaaaaagaatagaatcctgtcatttgcagcagcatggaaggaacttatttcattctgttaagtgaaataagccaggcatagagagacatatattgcattctctcactcatttctggaagctaaagaaaagtggatctcatgaaagtagagactaaaatggtggttaccagaagctgggaggggaaaggtgttggacagatgaagacaagttggttaaaattggatacaaatatacagtcagatagaaggaataagttctcatatttaatagtacaactgggaaattatagttaatgataatttattgtaaattaaaatagaagggaataactgtaatgttcctaacacaaagaaaagataaatgtttgaggtgaatgatatctcagttaccctggtttgatcattatacattgtatacatgtatcaaaatattgcatgtgtccctaaaatatgtactactattatatatcagtaaaaaattaaaacacaatatgtatgtatgtgtgtttatatgtgtacatgtgtttgtgtatgtttatatatatgtatgacagtttagaatatataaattaaaaaaaattaaacaggggaaaaatcatcaacaccaccactcagagttaaccattattttttcattatactaggtggcaattaaggtacttgggcctggatagatctatgggccagaactacaaacaaatctaataaagataccatgtgcttccagcacttttgctgtcaatcaaaagaaaacattgagacaaaacaagaatcaacagttcatttgggtaaagaacaattcatgaattgggaagcaccaaattgaaatgagattatggtctccactctagtggcttaagcagcaagcttttataggctgaccacagaagcaaagcaaagaagttggttggtttattagctacagcgaggtgtttacctgatttggctatggttcaatgggaggtcacagttaacatatcagctagttgattgttgcggtaagctgaggcttggttcagctttttctttgatcagttacaagaaatgtctccaagtttacttatgatttgcttacataagaactctgggtacagagacaacctcaagctaatggtctctttcttatttgctttactactatctgtctatcatcaccgtatcactataggattgtaagagctttcgaactagggctgcatttcctcccttctcagaagatgacattgtacctcagtcttctagattgtaatgaaatgtaaagcaggtgactccaaggaaaagagatgcatcaaaatattccacttctctctattctctaatcctaagaatgccacatttcacagtccctgacataaacattacctgacagtgggatttttctcagggtcccagagctggtatagaagttctttggcagctgggctggtaaacacagaagttttctagcaaggacgtccaaagaactgttcaaataaagataaaattctgactttttatctggttttattcagggcaaacaaattaaggacccatggtgacatcaacttaatgtatttttaaactttgggacatttgtaaataataatttccctgatattatgtagaaatgcatacattttttaaagagtcctaaaagtatcaatctcaaagagaaaattctgaaaataatacttagaccagaatgattatcaattttcaaaaaggaccactcagattatacagaattccctatgtttactgtacatctaacaatttctttttacatgtacaagcttcttaaatttcttaagcattttctcaagcaatacacataagccttgaggagacagtgtcctcagtctgttaatctcatttgcttcccacaaggaagaaaaatgtcagagttgaagcgttttggatgtgagttaacatatcctttttcttttccaacagaaacgaaatcagacttcacaggatttttagaaactctttttaaaatttaatacattagtccctctgtatcctcaggggattggttctaggatccaatacctagattatggacagataatccatagatattgatatccctagattatggatcctggagtcccttatataaaatgatgccgtatttgcatataacctatgcaatcctcccgtgtactttaaatcacctccagattacttataatatgatgtaaatgctatgtaaatagttgttctactgtattgctcagggaataatggcaagaacaaaggtctgtacatgttcagtacaaatataatcatccatttaaaaaatgttttttccattggatgcagaacccaaggatatagaaaactggctatatatgttctcttcctgccattatatattttataaaatcatttttaatgacatattctactttatatcattttactgatgattgacctgtttgtggactgttttgtctgttttctctcagtcttttgtataatgaacagtcacttataagcacatttagagccaaatctttgaatatcttcagggttatttccatagaatcaatcagcacacataggattgtgtttattgtgattatttacatcagaaataatcctgttacaaattgtcctccagaaagtatgtatttaaattttcatcatcaatatgttagaaaaatctattttttttcatagagacatgatctatgttgccttttttatgttcttcacgcaaaacctatacattgcgtattatacttgttcctcaacttgagacgggactatgtctggataaacccattgtaaattgaaaatactgtaagttgaagatatattttcacagtccctgtacatttttgactatttctgtatgttttcaacttatggtgggtttatccagatgtagtcccatcataagtcaaggagtgtgctgaaggtgtatcaccttgtcaagccaaaagattgtaaatcaaaccatgtaagtcagggacttcctgtcttttattttatcattttccccaatacgataggtgtcataggttggatttcctagaaaacagactctaaaatttttgtacaagaggtttactgggaataacacaagtgaggggttagagaagcaggacaaggcagggggagaaataaaactgcagcacaatttcaacaagggctctgttgatctttataaaaactcgagagctgggatgttccttcaaaatcatcctgccttgaataaaagggggtaggacttgatatgcttgtaacaccctgcaagctgccctaggatgggtgtgaccttggatgaggaggctgttttcagctgaaggcaactcttggagaaacatttagccataagctgcgtgctgccaacaggaccagcacttgaggaatgaatgctcttctgaaaagagaaattgagtggtgtgctagcgcctcttctccaagagatccacttactttgtataataattagtgggaacagcacctctcggattctggttggtttagttttcaggaaaatttacaagaggaaggttagtgaagtgaactacatacaatcccagccagcgcatctggtcttgatgctgcaactgacaccaaacatatctcattacaagtctgtatttctcttaccctacttctattactgactgttcagatagggctcactgggaaacagactgagatgtgcatacaggatgtttactgaagcatgtgtgcttttgcgaacaacacatgtgagggggcagggaagcagaattgggcagagagaggagctgaattgaaatgcagttgcaacagacctcattcaattttgtgagaacttcagagctgcaacagcttttcagattgaccccaccatggcacaatgtagctggactatatactcttgcactggatcagtcattagacacaggctcttctaatgtaagggatattgtggctctctttagttaatggcatttcctagagagagaaactaagctgaaatctgtcaggtgtcataccatagcagctgagggaatgagcatttcagtcctgaaatggaatctgagcaacacatcatgatatctattacagtagttaaaaatggcatctcggcctagcgcagtggctcacacctgtaatcctagcactttgggggctgaggcaggaggatcatgaggtcgagagatcaaaaccatcctggacaacatggtgaaaccccttctctactaaaaatacaaaaatcggctggcatggtggcgtgtgcctgtaatcccagccactcaggaggctgagacaggagaatcgcttgaacctggggggtggaggttgtagtgagctgagatcacgccactgcactccagcctggcaacagagcaaactctgtctcaaaaaaaaaaaaaaaaaatggcatctcattattaccatatattatttgatatgtcattgaaccacatgacttctttttgaattccctgaatatttctttcatttttctgtgttaataatgttttcttatcatgtatgttgaagatatttgctctgtttttcaattgtcattctttcttttattttttaatttttatgggtacctagtaggtgcatatacttatggggtacatgagatattttgatacaggcttgcagtgtataacagtcacatcatggtcagtggggtatcttcgtttcgttgatacatccatgtttatattttgtatggtatatttccttcccttttgcatttctttctaccatttgagctttaagaattctttatcctgattataagtaaatacagattattttatttagtaattcgatagtgttactttatttaaatattttctattatttggaatttattttagttcatggtataaggcaagaatgtaaattatgtgtgtgtgtatgttttctggatagttcaacaattatctcagcaccattcttgaatgatccatctcatctttagtgattttatgcttccaatataatatattcagttctttatatgccagattttgtctatgcaatagtctatttatcaattaacctgtttatacatatgtcaaaaacacattacctgaattattatagttttatagtattgcttactgtccagttgaactaagtaagccacagtgtgatcagcttatagatacaggagtatgtcattattatcttagatgcctaaattttcatgcctttttcgcttatgtggaaacatccatttttcttcacttctgaccatctgttctatgcattttgccttttaacaaatgtttaaatgatgtttgaaagtgtcatattcttgtcttctttcttctcctcactaccttgttcccttgcagattggcaactttttaaaacaaccattgagctgcatgtttctttttaaattccttatctcttctatcccaggcctgagcacatggtacaacataaacaaatatttttgaatgttgaatgaataagattataatttcatttctgtgttatctctttggttcttgatttctctacattaaaagtcatatctagaatacctcacaaagtggtaggaaagtatgaaaaaaatacattgaaatacactgaaatagcatatggatatgtacttttcattctttttttttctaaagagaggtcattgatgagactttcaatatttaggctagattgactttcagggacattatagagcctaactttgaagagctcaaaatatgattgaaaattttggagctcatagtgaaaaatctagataatcactgcttttgttaattagctttttattctttccacacaggtactaagtgaggaaccagctatataatttatagggacaagtacaaaaatgaaatggttgggtcccttgttcaaaatttattaagaatttcaagatggtgatagcaaagcatttaaccaagtgtgagtccttttgcaactgcatagtttgagcacccgcaaacctggcccatgactaaatacaacccatatacactatgacaggtattagcgctgtagtggggaggaaacaaatatggttacttcccttgtggaactcacagattcaatgtagacaaaagcagaacagtgacaatttatttccttaatagtgccttactagcttcactaattcaaaattggttttagaaatttcactactttgtacttattcccaatcgccaacgtagtttttgaactgccatgtctttggataatcatatagcagaatttattaaatgacaactgtttgcaggaaactatgaactcggtgaaaataaaattagaaacttatttttatcatgaatattatttctaataaagcagtataaaagccctttgtgaagggtgttttcatatctgtagtgggcatatatgtgctacaatgtgtagcagcagctggaaattttttctgtcattactgagttttgaaaagatatttttctcaaaatgtaagaaacactgtcactaaggaagaaatgcatcttattagaatgagaatgttgtagataatgattatatggtttgtcctgagattgagattactatgtatgtgatggttctctttttgggagggagataatgtcaaaatatattagccaaagaccttcagaagtaggtgggaaataggcagaaatgtatacccattagcaattgattcctcagcatgctagtcaagcccattttttgacatctgttttattttggttcttgcctcttccagcattcaagctgtcagctcttgctctgttaacaatgggggctatgagctgaagtatattcagatcactcatgaacactacaggcactggttccttccataccaccagctgacatgagatggcaaacactgagaaaggaaggcacagtaagctcatattacctgctgcaaaggaacaacatgttgagagcaataaaacttttgccaacactgtgtaccattttgtaagattgtgggtttgaaagaatattttttcccctgcagtctacttcatggattgcttttgattaacagctctttcctttttttctctgaatccattggtggctgtaagtttgtatccattctctttggagggaggacacccaactatagcaatatgattcatggtggtgaactatggcagaattcaagaatttaaagtgattttaagtatctcactgagtttataaaaaatcccaaacaaagatttctggaaaatgcgtaaatgcacaaactaagcaggatgggtgagggcttttattcttcactatcaaaatgattcttcagcatcagtatgtattttgatactgaagactcattagaaacactgtatatattcatggtagtgttttggattaaaaatatgtcttctctcttttatttttatttaattaattaaaattctctgaaaagacttggaaggctaaattcatatccccagtagaggcggcaaggtggggaagctttagacctcctcccataatcttcgtttgctccccagtggcatccaccaaatgataaatacatttattagtatggaaaataaatttttctcagtcctaagtaaaatgtaattaaaatagttttttaaaatgttgatatctttattaatctgtagcatacattcaaaatataaactgtgcttgctagaaaaatgcatcttggatcacgaggtcagagatcgagaccatcctggctaacatggtgaaaccccatctctactaaaaaatacaaaaaattagccgggtgtggtggcacacgcctgtagtcccagctactcgggaggctgaggcaggagaatggcgtgaactcaggaggcggagcttgcagtaagccgagatcgcgccactgcactccagcctgggcgacagagtgagactctgtctcaaaaaaaaaaaagaaaaagaaaaagaaaaatgcatctgcaagactgcacttctttctgaacagattttttttaagatccttctgtatagaatttctgggactactgctgctcattcttcagatatttacaactttctatctcaaattacttctattctcccaatcagtgtgtctccaccctggcaacaaagctctcctttataaatccccattgggactgtagttcagtatcactgctcccccttttcatgccttgttactatcaaagatatggtctacataccctagagtttccttgactaggcatcattcttatgccacttgtagttatacaaaagaaggatagttttcatgaagtgacgtttcattccaccaggattgtaaaagtatcttcttattctcagacccaccagtttaacaggctcaaatatacctgcttattgttcttatttacctcttgttttttatgcatgagattgaaatttgtttatatatttcttgaccatatgaacactttctgtattttattgcccctttatgtcattttgccattttttatggacgtgctttttgttaatatacagaagcttgttatatattctaaacattaatgaaccccttaaatgttaatatattcaaatattttccccaatttaatattagatttttttacatagttgatggaagtttttcttgccattctaaagtttttttcttttgtgtaatgtcttttccttcacatttttctccaaatagaatttttactttaaaatacttcatattcaccaaaatatgaattttaaaattaattaaaatgcagaaatctttaatcataaatttcaaatatttaaaacttctactatgtaaagatgaaactataaagttttatttcaatgttttatgtatatatagtgttccattgtatagattgccatcatttatttgaccaatatcagttaatgaaaacttaaatcaatgtcctagtacatattcctcaaataatggtcagatatttccttagaataaatttctaaatgtggaattattgagtagaaaacatgtaatttctcaggcttctgatattatttactagtctgtcctcaggaaaagatgacccatttatagttccacagtcatgtaagagggctagatttttcatatctaccagcacagagtacttttattcttatttattttgcaaatatatataataatttataaaaattgtaatttataaatgcaaaggtatgatggggagagtagaaaaaccaaagtttaggaagccttggaagtcagtttgagtttggactggatgtggaagaaaaaatgttagagaagcttatctctgttgtcaggttggaagtgaaacagtaaagttggcattttatgaaaattgattgatgattaaggaatctgttgcaatgtttcagttatgattaaataagtttcagcaaagatgtaacaggattaattataactaagtttaggaagaaactagaagatatagtgagagattaaaagcaaagatgagagattttaagggtttcccatttgggagtgcggaatgacaaaagtatcattgtgatgactaggaagttgataaagagaagttttttggactgattagttaagatgatagtggtgagggaagtgaaggtaggagccaagtggagggcccattacaagttaaataatggacaggtgtgtaaggctcaagaatattttcatgttgtccccaggaaatcatcaagaaatatcaggcttccacttctggcattagaaaaaccaaggtataagataaatgagctaatgagctgaatattgaaagaattagaatgtcagatcatggtaactggttgagagttggagagtagaaaggagaacagctggacaacctttgttgagagacccagaatcatagaattttaaagattgtctagttcagttatcaaattaagtgttctctggaagttaattggatttaacaggccaaagaggttaaagaaggtacattagggaagacagtctgtgtatatgtgtgtgtgggtactcctgtatgtgtgtgtgcatgtgtgtgtgtgtgcatgcgtgcccacacacacatgcacacacgtctggggaggggagggtatagatgttgtcttagtcacttcaggctactctaacaaaatactatggaatgagtagtttaaacaacatacatttatttcttacaattctggaggctaaatagttaaggttaagtcgctggcagatagggttcctggtaagaagacttctcttaccttgcagacagccaccttctccctgtgtcctcacatggtggaaggagagagtgctgtcatttcttcctcttcttataaggacattaatctcatcatgggggcccaacctcatgatcacttttttttttttgagacggagtctcgctctgttgcccaggctggaatgcagtggcgcgatctcggctcactgcaagctccgcctccagggttcacgccattctcctgcctcagcctcctgagtagctgggactacaggcgcctgcaaccacacccggctaattttttgtatttttagtagagaaaggtttcaccatgttagccaggacggtctcaatctcctgacctcgtgatctgcccacctcggcctcccaaagtgctgggattacaggcgtgagccaccacgcccagccccaacctcatgatcttgagaggtgaagccagctggacgttgggtcgggtggggacttggagaaattttttgtcttacaagaggattgtaaaatgcaccaatcagcgctctgtaaaatgcaccaatcaacactctgtaaaatgcaccaatcagcaggatcttaaaagtagccaatcgcaggaaggattgaaaaaagggcactctgataggacaaaaatagaacatgggcggggacaagtaaggaaataaaagctggccaccccagccatcagcctcaatccgctctggtccccttccacgctgtggaagctttgttctttcgctcttcacaacaaaccttgctaccgctcactctttggggttgtgccatctttaagagctgtcacacttaccgcaaaggtccaaggctgcattcttgaagtctgtgagaccatgaactcactggctggaactaactccagacacaatctcatctaaaccttattacctccccaaggccccactttcaaataccgttacattaagggttagggtttcaacctgtgaattttcaatggacatgcagttcataactgaagtgatcctagacctatagcaatttggcttaaagattctcccagaattgtgtccttctgccttccacaatgggaatgaacctatccagaccttgaaatgacctctaaaacaactaaagtgaagataaccccaaggaagcatcgaaaattaataaatttatttaggactttacatattgcactcaaggtaaaggcactgtattttcaaagcattaaaaacaatcattctctacttcaatggcaatggccttaaaagttgaaattgtaccttttgtattttcagtagaaatggattttttggtcctaatgtcatcaacctcaaattccattactttatattgaatacactgagttcccctccacacctctccttctcccagtggtatttttgctgtcattagcatctcttgccttggaaaccattgacatactgatagcagcaacttctgctgaggtccttttaactttggcactgatcaatatatgccatgcaatttattttattttcatctctttagactttgttataaaagtaataagtattcactgaaggaaatttgaggtaaattagataataaaataacacaaatgaaacataataagaccacccataatctcatcacacagaagtaataattgttaacatattggtgtatattttttcaagtattttatttgtataaacacttttatggaataagattatactatatcttttgttttacaacttgatttattaaaatgtttttaaaacattttgtgatgtcattatttaattttccattataattttctattttatgatgcttaaaatgatggcattaaaataatagcttaaatttatttagaaatttttgtgctagtcaccactgaaagtacatatatatgcattgtatcactgaaatttcacagcgaccataggagattgatactgttactgtccctaatttataaaaagggaaatggaacacagtacaggtttgataattggcccagggtttcatgccgtggaagttacagaccaggacttgaagccagggacttttaactctagaacccaagatttttcaagctgactgtataaatatatagcatgccactgtttttgcaattgcactataacaattttctaatgttgggtacttaaaatttataccttttattgctttaaagaaacaatgaaaattcttccagtgaaatctttggttccatatacactattttcctaatgacaaatgccagtgattaaaattgtatggtccaacagttatgtgcataatttatgcatcaatattttttgcaaaaatctaaaagcagccaagtcgagccagcatagactagaaactggaagtaatagaatactaaattcaaattcttttatgatttccagcagatctcagcaccgttgtgtatattgtgggaagtaagcctaataatccttttttaaccttagagttatgtaatattttgaaagtctaaaagacgattcttatgaacttagatttgacaaaatctttaagaagtaacttttagaaagtgttttaaggtaaaaccttctacctagaaatgtgctttgaatatatataatggactctcagtagaggtttgatgacccattaatccagatctggaaacaatcctgtgttttctatttttgtgatatttcacctaaggaaatgttcacctgaatcctttgataattacagaaattatctggaagcagaataaatgacatattggagaattaaggtcaaatggtctttggtgacctactgtacttttgcaaatacatcaaccatttatatctaccattgccctaatagaatttcctggcatgcatgttttcaatattagtatgtctgcaaatgctttaatacatggaaattattgatggcagatattaagctatggtaacacattgaaaacaatttgaacattttacagtttaacattttccaagccaaaaattaaaaatctgacatctatatatgtacctgaaaatttgacttttctagaaaagtctagttcctaagttgcaaaccagtactccaccattcctcctgcactattgaaagaacaactcttgtaaaataatatccatatttaggaaagactaaacaataaagacttatttccattttttttctcatttttgaaataaactgttatcaaattctctccagattatttctgttacaaaaccaccacccattatgcctcctccttaaaaacattgtgcacgatgctggaaatgggttttccctagccagcactccaactgggtactgaaggttggggctgcacacatagccagtttcaaataactgaccccctattgtccctgctgctattgttctcaacctcctttcttcctgtatgaatgctccataattgtaggttgagtacaaaattctaaaatctgttttttctcattggtaatattggattatttaaaaaaaaaaaaaaaactattatggacatagtggtatgaagaactgtggaatcagatctggttggaatcccagattccccactcactgtcatggtaagcagctatttcaactcattgatcctttatttctttatctgtgattttggagatattaatgatacatatgtcataaggttgtgaatgaagcttgagtaggacaatgcatgtaaagagcttagtaagttgcttgactcaagataaattgcttgaaacctaaagcacagagtagtgtattttctgctacagtgttacaaagatgtttcttgacaaagtcagaattggaatgcaaacatatccataacaccaaatctgatgttcaaaattcatataccctatccagtacaaccttctcaggatctccttgctggctctcaatgcttgcttactgagttttaggaatcaaattctgtacaacctcaaacatttactacagtgtcatttctcctatcttccaggagcagagcttcatttccccttttacatttgtgtccattttagtcatcactgccatcccaatttaattctgtcttcttatcacttatcttctgaagctcttatcagctgggtacaccaccctttataatccgtcttttaaccatcctatctttatgggtatcatgagagagcccaggatcctcctccattatagtgtaggagttaagaaatgggctctgaagccatactacttaagtctgaagttctctgtttccacaaatcccactttttagcttggggaccttgaatacattttctgctttcagtttcttatctgtgaaatgtagattaaaattatacctacctaattgagttgttgatcagattaaatggatgaatgcatgttaagtacttgcaaatagcacctggaacctatcaagcacgatataaatattatctgttgttattattattattatttgttaaagaattccaaacatagctaagttatcacttccaaatttatccttttgttccctgctaccatccagtaaacggatcttacctaaatgatgtattgaataaaatgtgaaaagcctgaaactgtacggggcacagggaaacactcataaactgctagcctctatagtaaatagagtagagaggaattaaaatagataaacaaataatgagctagcattagaaagacagattttacaatttaagatatttgaagtaaaacaactatgagtggcatgaaaatctaaagtgtattcaggtttgtgtatagcaaaacctgagtggagttgaggaaatttagaaatgaaattcttctaaaaaaggagtttatgtcctttgcaggggtattgatgaagctggaaaccatcatcctcagaaaagtaacacagaaacagaaaaccaaacactgcatgttctaactcataagtggggttgaaaaatgagaacacatggacacagggaggggaacatcacacacgggggcctttctggggatagggggaaaggagagagagagtgttaggacaaatacctaatgcatgcaggacttaaaacctagatgataggttgatgggtgcagcaaaccaccatggcacatgtatacctatgtaacaaacctgcacgttcagcacatgtatcccagaacttaaaataaaaaataattaatttaaaagagttaaaaaaattaaaaaatactaaagtcagaaaagatttactagattcctactatgtgcaagatactaagagaaaaaagtaaataagatattcctactgccctcaaaaagtttacactttttgattctcagcccctcagcacttgacctaatttgccctagactttcttcctgaaagtccctttctttggattttgagaccctattcattcctagttctggttctgtttctaacacttaatcttcttctatatctcttcctatatgaatacacttgttcacctttccacatcgtgtaaactttttgagggcagtaggaatatcttatttgctttttttctcttagtatcttgcacatagtaggaatctagtaaatcttttctgactttagtattttttaatttttttaactcttaaattaattaatttattttttattttaagttctgggatacatgtgctgaacgtgcaggtttgttacataggtatacatgtgccatggtggtttgctgcacccatcaacctatcatctaggttttaagtcctgcatgcattaggtatttgtcctaacactctctctctcctttccccctatccccagaaaggcccccgtgtgtgatgttcccctccctgtgtccatgtgttctcatttttcaaccccacttatgagttagaacatgcagtgtttggttttctgtttctgtgttacttttctgaggatgatggtttccagcttcatcaatacccctgcaaaggacataaactccttttttagaagaatttcgtttctaaatttcctcaactccactcaggttttgctatacacaaacctgaatacactttagattttcatgccactcatagttgttttacttcaaatatcttaaattgtaaaatctgtctttctaatgctagctcattatttatctattttaattcctctctactctatttactatacttacactaataatgcctaacatttattgagtgcctacaatattccagacaatgtattcgttgttttacctgcattatttcacttaatatttacataatcccatgaaatattgttattatgtttattttacagataaaggacttaaggccctaggaagtcaagttattgtcccaaggtctcagagctactggctttgccagaatcaggctacaaattcatgtttccttcatcttttctctatgccattttgaaagtttaccatattaaatgttaacataaatattctagatgataatttttttgttgtttttgttgttgagatggagtcttgctctgtcgcccaggctggagggcagtggcacaatctcagctcactgcaagttccacctcctgggttcatgccattctcctgcctcagcctccctagtagctgggattacaggcacccaccaccacgcccagctaatttttttttctttttttttgtatttttagtagagacagggtttcaccatgttagccaagatggtctcaatctactgacctcatgatccgcctgcctcggcctcccaaagtgctgggattacaggcatgagccacagcgcccagcctctagatggtaattactatagcaattctgaggaatataatttttaataatatgtcttaacttttctttgaaagtctagtttctatccattggttctctaactgcatttattaatgcttctcaaagcacatagtctccttgtacctcagagaatgtggcatttgataaccagatttcttgtctgagctggctgcaatggtgttggaaattggctctgcagctgggctggactgcagttaggaaacatgattgtagatggtgaactgtcactgctgggatgtgaaccagacatgaatgctaagcaatagtgtccacagtttgcaacccaggaactgccaaattgacagctagactaaactgtagcagcataggaaaatgtggctagtttctccagtcagtcaatacaaagtcttatattgtactataatgaatacaatcttactgtcccaaaaactgagatgctgtcaattatgaatctcagttagattcttagcaagtatttcatgtgtgaacacccgtataagcctcataatggccctaactgtagttggtttggattagcttttacagtgaacatgcagttcattaagcttacagaaactccaacagcagctgcacatctctccatgaactatataggttttttgcattttatctaggactagatgaaagggatccataaggctgtgctagaaataagtcttgattctctgagggacttgaatagatatagagtgtgtatgaaatgaataatatcagtaatgagcaaaacttgaaaggaaaatctaaaggtttggggggttctgtttccttttaaggaagttgtggcaaattattgttttataataattttgctttgagaatttcttcaggcttgggatattcatttgttatttcactagacagaacatctgcttaccttcctcaccattctctcacatatttctttgtcattcatttccttcatgccagggacttctgcaagttcccattatgttccaagcactggggctggaaatgagttctttgatacaaaaaaacaaacgtctctgccctcaagaagctcatggtctagtggggaagacaattgcataaaaagagaatatagcaacacagtggtaaagatgtgtatattatattaaaggaaccccagtgggtagcatctatgccacctgaaagggggttcagaaaaggcttttaatagaagacacttgagttgaactttaagagaagtaggaatcagtccaaagaagaaaaatgccaatgtctagacatccccaatatataggattaccacacagatagagatcccattataattcatatatcaacaattaaagaagctattgggattttagagtagatatttttatttgcaatatatccaaatattttttcttaggactagaacattttctctgtctggtaaaatgccactgtatctttagatatgaacatgtgcattgtttaagtacatgaagacttcgttaaacatagacacctcaactttattagtagaatcactggctttagagcatctttgaagatcaaaaagtgagaatctagagaggtgaaatcaagagactctgaccagtgacacaccttctcagatgctctggggcttatggaggtatgcatggaagttaccagcatatgttttaaagaaagtgatttgaataaagcattacatgagtgtgttgggaggtagtcatgctgaggtcagaattagccagattctttccatgtcatctgcaatcctttcatctaacttccaaaagagtggttgctggaaaacctaaagaaatgtttaattttaatttttttaatttttttttatttagagacaaggtctctcactgtcccccagcctggagtgcagggggcaatcatcactcactgcagcctggccctcctaggctcaaacaatcctcctacctcagcctcgagtagctggactacaagtgcatgccaccatgcccagctagttttttaaaaactttgtaaaaatggggtctcactatattgcccaagctggtctcacactactggcctcaactgcttctcctgccttggcctcccaaactgctggaattacaggcatgagacactgtgcccagcgctaaggaaaaatgtaatatggcatcttttaggaaaaaagtattctggacttaagcttgaaatttgtgctgctgattttaataaaataacatttagctgcctccagtgtaaacctttcacagattctaaaagaggtgttttttgtgttttttttcttgcaatttcagaaatgtaaattggctattatagtttacaaggtaggtacatgttttgttatataaataactcagaaatatctctctggctcttcatacaatacaatctttgcaaagtagaaatatatcatgaagactaagtgaaataaatataatcatagccaagttttgattttttaaaaaaagaatattcaatgtttttattagactcaaaggtctttacaccccctccaggccccaggctttattaaggtataattgataaattaaaattgtgtatttttacagtgtacaatgtggttttgatacatgtatattttgtggaattattaaatcaagctaattaacataactatcacctcaaatatttatctttttttgtgatgagaacatttatgatctattcacttagcaatttttaaaatttacaatatattattattgactgtagtcaacataactctccagaaattatttatcctttctaacagaaatattgtatcttcaaccaacatctcatttctcccttacctcccttcccaggccctggaaaccaccattctgctctctgcttatacaaattcaaattttttaattccacatataagtaagataatacagtatttctgaacctgacgttcacttagtataatgtcccccaagttcatccgtgttgctgctcatgacgggattttcttcttttaaaagactgaatagtattctgttgtgggtgtcttttttctttattcatttctttatgcattcatctgtcaatgggcacttacattgaacatgggagtacagtaatctcttcaacatactgatttaattgtccttgaatatataccctgaagtgtgaataatggatcataaataaattccttttttaaaaataaatcactcagtttcaggtactctgttataagcaaggaaaatgaactaagacagatattaaccttttatcataagtataatttgcaaatattttctctcattccataagttgtcttttcgttctgttcattggtgttttttttgttttgttttgttttgttgttgttgttgttgttgtgttgttgtttctgtgcaggaggtttttagtttgactcagtcctgtttgtgtatttttgcttttttggccggtgcttttgaggacgtattcaaaaaataattgttcagaccaatgtcaagaagcttttcctctatgtttatttgaatagttttacagttcaggtcgtatacttaaacctttaattcattctggtttgattttgtatatggggtaagataagggttcaatttcattcgtacacatgtggatagttattgaagatactgtctattctctattaggtgttcttgacatttttgtcaaggatcaattaaccataaatttgtggattagtttattggttttctttctgtcccattggtctatttgtgtattttatgccagtaccatgttgttttgattagtgtagatttgtagtatttttgaaatcaattagtgtgatatatccagctttattccttttgatcaaaattgctttggctattgaaggtcttctgtggttctctatgaatcttaggatttctttctatgtccatggtatgtatacatttacctatgtaacgaacctgcacttcctacacatgtgtccttgagcttaaaataaaagttggaaataaaaaaattaaaaatgtgggaaatattttaaaatgcaatgagaattttgataggaaccacattgaatctgtagatttctttgggtagtaggggcatttcagtagtattaattcttttaatccatgaacaccggatatctttctatttgtttgtgttgtcttcagtttctttcatcaatgttctatagttttcagtggacagacctttcacctccttggttacatttcttgccaagtatttcatttttattgatgctattatatgtggaattgctagattgatttattttttgaataatttgctgttggagtataaaaatgcaactgatgttttgtgctgattttgcatcctgcaattttatttaatttgttttttagttctagcagtttctggtagagtctgcaggatttcctatatataagaacttgtcatctgcaaatagagacaattttatttcttcctttatattttggatatcttttctttctttctttttttttttttttttgcctaatttatctgtctaggaattccagcactatattgaatagatgtggtgaaagtgaacatctttatcatgtttttgatcttagaggaaaagcctttagcttttcattggttagtttgatgttagctgtgggctggttgtatatagcctgtacttagtcaagatacatttcttctacacataatttgttggaagttttttcatgaaaggatattgaattttttcagatgtttttacttcatccaatgaggtgaccatatgggttttatccttcactgtgttaatgtggtatatctcatttgttaatttgtatatattaaacaattattgcattccaaggataaatcctacttgaccatggtgtatgatcctttttttttttttttttttttgctattcctatttttttttattatactttaagttctagggtacatgtgcacaacatgcaggtttgttacatatgtatacatgttccatgttggtgtgctgcacccattaactggtcatttacattaggtatatctcctaatggtatccctccccatccccccaccccccaatgggctccagtgtgtgatgtttcccttcctgtgtccatgtgttctcattgttcaattcccacctatgagtgagaatatgctgtgtttggctttttgtccttgcgatactttgctgagagttatggtttccagcttcatccatgtccctacaaaggacacgaactcatccttttttacggctgcatagtattccgtggtgtgtatgtgccacattttcttaatctagtctatcattgatggacatttgggttggttccaagtctttgctattgtgaatagtgccacaataaacatacgtgtgcatgtgtctttatagcagctatgatttataatcctgtgggtatatacctagtaatggaatggctaggtcaaatggtacttccagttctagatccttgaggaatggccacactgtttccacaatggttgaactagtttacagtcccaccaacagtgtaaaagtgttcctatttctccacatcttctccagcacctcttgtttcctgattttttaatgatcaccattctaactggtgtgagatggtatctcattgtggttttgatttgcgtttctctgatggccagtgatgatgagcattttttcatgtgtcttttggctgcataaatgtcttcttttgagaagtgtctgttacgaaatgaaggcggaaataaagatgttctttgaaaccaatgagaacaaagacacaacatactagaatctctgggacacatttaaagcggtgtatagagggaaatttatagcactaaatgcccacaagagaaagcaggacagatctaaaattgacaccctaacatcacaattaaaagaactagagaaggaagagcaaacacattcaaaagctagcagaacgcaagaaataactaagatcagagcagaactgacggagatagagacacaaaaaacccttcaaaaaatcagtgaatcaaggagctggttttttgaaaagatcaacaaaattgatagactgctagcaagactaataaaaagaaaaagagagaagaatcaaatagatgcaataaaaaatgataaaggggatatcacaaccgatcccacagaaatacaaactaccatcagagaatagtataaacacctctacacaaataaactagaaaatctagaagaaacggataaattcctcgacacataacaccctcccaagactaaaccaggaagaagttgaatccctgaatagaccaataacaagatctgaaactgaggcaataattaatatcctaccaaccaacaaaagtccaggaccagatggtttcacagccaaattctcccagaggtacaaggaggaactggtaccattccttctgaaactattacaatcaatagaaaaagagggaatcctccttaactcattttatgaggccagcttcatcctgataccaaagcctggcacagacacaacaaaaaaagagaattttagaccaatatgcctgatgaacatcgatgcaaaaatcctcaataaaatactggcaaaccaaatccagcagcacatcaaaaagcttatccaccatgatcaggtgggcttcatccctgggatacaaggctggttcaacatatgcaaatcaataaatgtgatccagcatataaacagaaccaaagacaaaaaccacatgatgatctcaatagatgcagaaaaggcatttgacaaaattcaacagcccttcacgctaaaaactctcaataaattaggtattgatgggacatatctcaaaataataggagctatttatgacaaacccacagccaatatcatactgaatgggcaaaaactggaagcattccctttgaaaactggcacaagacagggatgccctctctcaccactcctattcaacatagtgttggaagttctggccagggcaatcaggaaggagaaagaaataaagggtattcaattaggaaaagaggaagtcaaattgtccctgtttgcaggtgacatgattgtatatctagaaaaccccatcgtctcagcccaaaatctccttaagctgataagcaacttcagcaaagtctcaggatacaaaatcagtgtgcaaaaatcacaagcattcttatacaccaataacagacaaatggagagccaaatcatgagtgaactcccatttacaattgcttcaaagagaataaaatacctaggaatccaacttacaagggacatgaaggacctcttcaaggagaactacaaaccactgctcaaggaaataaaagaggatacaaacaaatggaagaacattccatgctcatgggtaggaagaatcaatatcgtgaaaatggccctactgcccaaggtaatttatagattcaatgccatccccatcaagctaccaatgactttctttacagaattggcatatgatccttttaatttgctattacgttttgtttgctagtgttatgttgaggaatttgcatctatgttcatcaagaatattagcctgtaatttttgtttgtttgtttgttttgtttgtttgtttggtgacacaaagtctctctgtctcccagactggagtgcagtgccgtgatctcagctcactgcaatctctgcctcccaggttcaagtgattctcctgcctcagcctccccagtagctgggattacaggtgtgagcccttatgccctgtaattttctttcttgaagtgtccttgtctgacttttctatcaggatgatgttggctttataaaatgagtttggaagtgtttcttcctcttcacctttttggaagcatttgagaggaataggtgccagtttttaaaatatttaataaaatataccaatgaaaccatcaaatatgggacttttcttttttggaaagtttctatttactgattcaatctccttccctgtattggtgtgttcagatcttctatttctgagatgatccagtcttgatagattttgtgtttctaggaatttatccatttcttctaggatgttgcattcattggagtataactcttcatagtagtgtctcatgatcctttatggtgctgttctataaattgtaatgtcgtctctttcatttataattttatgcacatattctttttttagtgtagctaaaggttcatcatcttatcaaaacagcaaatcttagttttattagctttttctattgttttcctagttttaattttatttatatctactctgatctttctcattttcctcctgctggtgaattagggcttactttgttgttctttttctagttcctcgatgtataaattagttttttttttttcttgagatcttttttctctctcaatgtacgtcttttttgctataaacatatctcttagcactgcttttgctgcatgccatatgttttggtaagttgtgtatccattttcatttatctcaagatattttttgatttcccttttcatttattcttgacccattgattgttgagataggtgttgtttaatttccacattttggtgaattttctaattttcttcctgttagtgttttcaagttttaaaacattatagtcaggaaagatactggatatgatttcagtcttcttaaatttcttaatacttgttttatgacctaatatgatctacttggacaatgttccatatgcacctgaaaagaatgtgtgttttgctgctgttggataaagtgttctgtatatgtctaataggtctatttgctctacagtattgttcaagcccactgttttcttattgactttctatctagatgatctatccattgttgaaagttggctattgaagtcttccattattgtattactgtctacttctcccagcagtcatgttagtatttgccctatacatttacatggtgcctttttgggtgcatatacacttataatcattctgtaatcttagtgagttgactctcgtgacctcctttgtatttcataatagtttttgtcttaacatctattttctctgatataaatagccacctttcctctcttttgtttacatagaatgtctttttccattccttcactttcagtacatgtgggttttaaaactcaagttaatctcttgtaggcagcacataatttaatcttatctttttatttatgtagacactttgtgtcttttgattggagaatttaatcaatttacatctaaagtaattattgataggtaaagacttactactgccattttgttaatattgtcctgactacttagttccattctgcctctattattgtctttctttgtgatatgtgattttctctagtggtattatttgtttcctttttcttaactttttgtgaattttgtacagttttttttcttgtagttaccatgaggcttatgtaaaacatctcatagctatatcagactattttaggctgataacaatttaatttcattggcattcaaaaactacactttaccttttcctcctgcatgttttatgttatttatgtctcaatttacattttttgtatttatcctgtccattaacaaattattgtaaatacagttattttaatactttttttgtatttataaaccaccaggtttatttacataccaccattacagtatcagagtagtctgaatttgaccatattcttaccttataatgagttatactttcatatttttcatgttgttggctgacatccttttgttttaacttggaaaattcactttagcatttcttgtaagacaattccagcggtaataatctcccatggcttttctttgtcttggaaagtccttacttatctctcattcatttctgaaaattagatttgctgggtatagtattctttgttgacaggcctttttgtctttctttctttcattttaacatattgaatatatcagcccactctctcctcacctgtaatgtttttgctgaaaaaactgctaataatcttatgaactttcccttgtatgtagcaagttgtctttctcttgttttctaacttctgtcttatgtttgacttttgaaaatttcattattatgtgtcttgatgaagatctctccatatttaatctatttgggttatttgggcttcatggatatggagattcattttcatctccagatatggggagtttttttaatcattatttcttctggcccctttatctttctctgccccttcttgaactaccatgatgcatacattgtttcacttgatcttttctcagaatttctgtaggctttctttacacctttttattctttttttcttttcatttccctgtctgggtaatttgaaatatgctttctttgagcttgctgattctttctttgcttgattgagtccactgttgaagctttgtataaaattttcagttcagtcattgatttgtagtgccacaacttttgtttggttattttttatagcatatctttgttctactttttattctgtacatgtattgttttcctaattttattttttttttatttatgttcttttgtagctaagtgggcttctttaaaattattttgaattctttgtcaggaagttcacagacctctattttttaaggaagggtcagttactggtgctttactttttttcctttggtggtattatgttttcctgatgtttatgattatgtggacataaattagtatgtgcacatatgaaaaagtaagcacctatttcagtctttacagacaggctttggaaagaaaagttccactagtcagtttatccaaagattcttggaagaccatcttgcagggttcatgggtagacttgctgctagagtcttggggcctggtgtagggtcagaagcttggcaggcttagcacctggttccacaggtgtaggcttagtgcctgggtccacagggttgagcccagagcctgagtccactctggagtctggagcttgaatctgctgcggtgggcttgaatcctgagtcactggggctcagcttgtggctgagatccactgcagtgcgcttgtttactgggtctgtgggagtggtcatattggagtttggatcctcaggggcaggcctggaagctatattcacaagtcctgaatttgtacggactatcctgaagctagagttactgggattatagcttggtacctaggcccataggggcaggcccagggcctgcttccatgggaacgggcctagagcctaagtccataggggctggcctagttctggatctagcctagagcctgagttcacaggggtagttctggagtctgggaatataggggccagcctggtgctaaggtctactggggtggacctgaaccctgatgtactatagccagaggcctgaagcctagattcattaatgctagtctgaggcctgagacaaccactggagctagcctggctctagggtaggcctgaaacctttggctgtggggtccagcctggagcctggggctgtagggtcctgcctggcattggagtgggcctgaaggctttacctgtacgtgctggtctggaacttggggctatggccgccaacctgatgccagggttcacaatctcaccagcatctgttattttttgactttttaataatagccattctgactgatgtgaatgttgcctcactgtggttttgatttgtatttctcttatgattagtgatattgaactttttttcatgtgctttttggccacgtgtatatcttttctcccattccataggttgtctctttgttctattcatagttttcttttgctgtgcagaagctctttagttgaaatagatcccatttgtcaattttggcttttcttgcaattgcttttggtgccttcatcatgaaaacctgttcctatgttcagaatggtattgccttggttgtcttccagggttcttatagttttgggttttacatataagtctttaatccatctcgagttgatttttgtatatagtgtaaagacaggatccattttcaatcttctacatgtggctagccagttatcccagcactatttattgaacagagggtcctttcccatggcttgtatttgtcaggttggtcgaagatcagatggttgtgggtgtgtggcctaatgtggtgcttttcttctcatgtttatcctccttgagttcattgaaattttgggatatgtggttttagttatcaaatttagaaaatgtttgatcatttttacaatttatttattattattatactttaagttttagggtacatgtgcacaatgtgcaagttagttacatatgtatacatgtgccatgctggtgcgctgcacccactaactcgtcatctagcattaggtatatctcccagtgctatccctcccccctccccccaccccacaacagtccccagagtgtgatgttccccttcctgtttccatgtgttctcattgttcaattcccacctatgagtgagaatatgaggtgtttggttttttgttcttgtgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgacgcaataaacatacgtgtgcatgtgtctttatagcagcatgatttatagtcctttgagtatatactcagtaatgggttgcctgggtcaaatggtatttctagttctagatccctgaggaatcgccacactgacttccacaagggttgaactagtttacagtcccaccaacagtgtaaaagtgttcctatttctccacatcctctccagcacctgttgtttcccgactttttaatgattgccattctaagtggtgtgagatggtatctcattgtggttttgatttgcatttctctgatggccagtaatggtgagcattttttcatgtgttttttggctgcataaatgtcttcttttgagaagagtctgttcctgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttctcttgctgtgcagaagctctttagtttaattagatcccatttgtcaattttggatttattgccattgcttttggtgttttagacatggagtccttgcccatgcctacgtcctgaatggtaatgcctaggttttcttctagggtttttatggttttaggtctaacatttaaatctttaatccatcttgaattgatttttgtataaggtgtaaggaagggatccagtttcagctttctacatatggctagccagttttcccagaaccatttattaaatagggaatcctttccccattgctcatttttctcaggtttttcaaagatcagatagttgtagatatgcggcgttatttctgagggctctgttctgttccattgatctatatctctgttttggtaccagtaccatgctgttttggttactgtaggcttgtagtatagtttaaagtcaggtagtgtgattcctccagctttgttcttttggcttaggattgacttggcaatgcgggctcttttttggttccatatgaactttaaagtagttttttccaattctgtgaagacagtcattggtagcttgatggggatggcattgaatctgtaaattaccttgggcagtatggccattttcacgatattgattcttcctacccatgagcatggaatattcttccatttgtttgtatcctcttttatttccttgagcagttgtttgtagttctccttgaagagttccttcacatcccttgtaagttggattcctaggtattttattctctttgaagcaattgtgaatgggaattcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttatgccagttttcaaagggaatgtttccagtttttgcccattcagtatgatattggctgtgggtttgtcatagatagctcttattattttgaaatacatcccatcaatacctaatttattgagtgtttttagcatgaagcattgttgaattttgtcacatgccttttctgcatctattgagatcatcatgtggtttttgtctttggttctgtttatatgctggattacatgtattgatttgcatatattgaaccagccttgtatcccagggatgaagcccacttgatcatggtagataagctttttgatgtgctgctggatttggtttgccagtattttattgaggatttttgcattgatgttcatcagggatattggtctaaaattctctttttttgttttgtctgtgccaggctttggtatcagaatgatgctggcctcataaaatgagttggggaggattccctctttttctattgattggaatagtttcagaaggaatggtaccagttcctccttgtacctctggtagaatttggctgtgaatccatctggtcctggactctttttggttggtaagctattgattattgccacaatttcagatgctgttattggtctattcagagattcaacttcttcctggtttagtcttgggagagtgtatgtgtcgaggaatttatccatttcttctagattttctagtatatttgtgtagaggtgtttgtaatattctctgatggtagtttgtatttctgtgggatcggtggtgatatcccctttatcattttttattgtgtctatttgattcttccctccttttttcttagtcttgctagcggtttatccattttgttgatcctttcaaaaaaccagctcctggattcattaatttttgaagggtttttatgtctctgtttccttcatttctgctctgattttagttgtttcttgcattctgctagcttttgaatgtgtttgctcttgcttttctagttcttttaattgtgatgttagggtgtcaattttggatctttcctgctttctcttgtgggcattcagtgctataaattgccctctacacactgctttgaacacgtcccagagattctggcatgtagtgtctttgttctcgttggtttcaaagaacatctttatttctgccttcatttcgttatgtacccagtagtcattcaggagcaggttgttcagtttccatgtagttgagcggtttttagtgagtttcttacccctgagttctagtttgattgcactgtggtctgagagatagtttgttataatttctattcttttacatttgctgaggagagctttacttccaagtatgtggtcaattttggaataggtgtggtgtggtgctgaaaaaaatgtatattctgttgatttggggtggagatttctgtagatgtctattaggtccacttggtgcagagctgagttcaattcctgggtatccttgttgactttctgtctcgttgatctgtctaatattgacagtggggtgttaaagtctcccattattaatgtgtgggagtctaagtctcattgtaggtcactcaggacttgctttatgaatcttggtgctcctgtattgggtgcatatatatttaggatagttagctcttcttgttgaattgatcccttgaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcaggtgagatgggtttcctgaatacagcacactgatgggtcttgactctttatccaatttgccagtctgtgtcttttaattggagcatttagtccatttacattgaaagttaatattgttatgtgtgaatttgatcctgtcattatgatgttagctggttattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatacgaaattctgggttgaaaattcttttctttaagaatgttgaatattggcccccactctcttctggcttgtagagtttctgccgagagatccactgttagtctgatgggcttccctttgagggtaacccggcctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccccgtcactttcaggtataccaatcagacgtagatttggtcttttcacatagtcccacatttcttggaggctttgttcatttctttttattcttttttctctaaacttcccttctcgcttcatttcattcatttcatcttccattgctgataccctttcttccagtttattgcatcggctcctgagtcttctgcattcttcacatagttcttgagccttggttttcagctccatcagctcctttaagcacttctctgtattggttattctagttatacattcttctaaatttttttcacagttttcaacttctttgcctttggtttgaatgtcctcccgtagctcggagtaatttgatcgtctgaagccttcttctctcagctcgtcaaagtcattctccgtccagctttgttccgttgctggtgaggaactgtgttcctttggaggaggagaggcgctctgctttttagagtttccagtttttctgctctgttttttccccatctttgtggttttatctacttttggtctttgatgatggtgatgtacagatgggtttttggtgtggatgtcctttctgtttgttagttttccttctaagagagaggaccctcagctgcaggtctgttggagtacccagccgtgtgaggtgtcagtctgccccttctggggggtgcctcccagttaggctgctcgggggtcaggggtcagggacccacataaggaggcagtctgcccgttctcagatctccagctgcttgctgggagaaccactgctctcttcaaagctgtcagacagggacatttaagtctgcagaggttactgctgtctttttgtttgtctgtgccctgcccccagaggtggagcctacagagtcaggcaggcctccttgagctgtggtgggctccacccagttcaagcttcccggctgctttgtttacctaagcaaacctgggcaatggtgggcgcccctcccccagcctccctgctgccttgcagtttgatctcagcctgctatgctagcaatcagcgagactccgtgggtgtaggaccctctgagccatgtgcgggatataatctcctggtgcactgtttttttgtgtgttttttttttgtatttattttattttatttttatttttatttttttattttattttttttattatactttaagttttagggtacatgtgcacattgtgcaggttagttacatatgtatacatgtgccatgctggtgcgctgcacccactaactcgtcatctagcattaggtatatctcccactgctatacctcccccctccccccaccccaccacagtccccagagtgtgatattccccttcctgtgtccatgtgatctcattgttcaattcccacctgtgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaacaacagtgtaagagtgttcctatttctccacatcctctccagcacctgttgtttcctgactttttaatgattgccattctaactggtgtgagatgatatctcatagtggttttgatttgcatttctctgatggccagtgatgatgtgcattttttcatgtattttttggctgcataaatgtcttcttttgagaagtgtctgttaatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctttgcagaagctctttagtttaattagatcccatttgtcaattttggcttttgttgccattgcttttggtgttttggacatgaagtccttgcccacgcctatgtcctgaatggtaatgcctaggttttcttgtagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggttactgtagccttgtagtatagtttgaagtcaggtagtgtgatgcctctggctttgttcttttggcttaagattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttaagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccccggccagaacttccaacactatgttgaataggagcagtgagagagggcatccctgtcttgtgccaattttcaaagggaatgcttccagtttttgcccattcagtatgatattggctgtgcgtttgtcatagatagcgctgttttttaagcccgtcagaaaagcgcagtattcgggtgggagtgacccgattttccaggtgctgtctgtcacccctttctttgactaggaaagggaactccctgaccccttgcacttcctgagtgaggcaatgcctcaccctgctttgactcgcacacggtgagagcacccactgaccttcacccactgtctggcactccctagtgagatgaacccggtacctcagatggaaatgcagaaatcacctgtcttctgtgtcgctcacgctgggagctgtagactggagctgttcctattcggccatcttggctcctcccctgaaaatgttcgatcattattcacacttttttctttctcttactctgtcttctctcctttagattttctagttatgtgacattttcttcttgctactttccactggtcactgaaggctctgattattttgtcttcattaaacttttgtgagataattttagatttgcatccagttgtaagaaataatatagagagagcctatgtatgatttacccaatcccctttaatgctaacatcctgcaaaattataatacaatataacaaacaggatgttgaaattggtgtaatcaagatacagaatatttcattcattgcaatggtctctcgtgttgccatttaatagccacagtcacttttctccatccctactccctccgtaaccccgaaagctactaatgtattccccatttatataatttttgtcatttcaagaatcttatataaatagaatcatgcaatatgtaacctacatggactggatttttttcatccagcataattccctgcagatttattaggtttttacatgtaacaatagttcatttttatggctgagtagtattccatgatatagatgtatcacagtttgtttaaacgtttttcatttggactgatatcagttgcagcagttatgaataaagctgcttttttctatgaaaagtttttaatacttttacatttaagttagtgatccatctttggttaatatttttggtaaagtatgagatgtattcttgctgatgcatttgttgaaaaggttatccttctttattgaattccttttgcacctttcccattaatcaagtgggaatatttctgtgaattctcttatgggctctccattttattccattgattgatgcatatatctcttcaccaatatgacatagacttgattagtcttgaaatcaagtaaatgatcttaccttactcatatttattataactgttttagctactgtactttttgccttttcatatattttttggaaaaacttggttatatacaaataatgttgcttggattttgataagaattgtattaatcctgtatatcaatttcaggaaaatactcatatttttattacactgagtcttccaagccacaaatacaatatatctctcaatttatctatctttaattttgtttatcagtattttatagattttagtatagaagatctataaatatcttgttagatttacatcttttctctttttgagctatggtaaatattattgccctttaattttactgtccatgtgtttgtcactaatatatagaatataactgattttttatgtttatcttttattctgctaacttgttgaactcgttttttagttttggagtttataaattccttaagatttcctgacaattatatgcaaattgaaaccatttcgttgcttttctgatctgttgttattttatttacttttcttgcctttatacactggctagaacttccaaccctacattgaatagagtcatgagagtaaacattcttgccttgctgtcagtcatagagggaaagaatctggtcttttaccattgaatatacagatggtccttcatatctgtggcattttatctgtggatttaatcaacaatggaacaaaaatttttaaagaaacttaatcgttgtgtctgtgctgaacatgtatacagaactttttcttgtcattattccctaagaatacagtataacaattatttacatagcatttacactgtactaggtattatcagtaatccagggatgatttaaagtatatgaaaaaatgtgcagaggctatatgcaaacactacatcattttatataaaggacttgggcatccatggatttttgtattcatgaggggtcctgggaccaatctcccatggatgttgaggaacaactgtaatgttagctttaggtttcttgaatatactgtttgtcaagttgaagaagttttcaatactctcattttttctgagattttaaaaaaagtatgaatgggtgttgaattatgccaaatggttttttctgcattgattgattatcatacgaattgtcttctttattctatgattatggtgaattagattgattgattttttaatattgacctgttttgcatggtacaataaattccatttgatcatgttgcatattttttgtacaaatatatatatatagtatatacatatatagtacatatatagtatatatatgtataaaagtttcattcgtattttgttaaggatttttgcatctttattcatgagtgacattggtgtattttgatgatacacaaatcatcataagaatttctttcttctttctttcttctctctctgtctgtccatctgtctgtctgtctgtcttttttcttttctttctttctctcttaatatctttgcctgatttcggtatcaggaaaatactagctacactgttttctggaagaaattgtagaattattgttatttgttctttaaacatttggtagaattattcggtgaaaccatctgggtctagatatttttcttttgagactatttaaatgatgaattatttgtttcatagttacagggctatacaaattatctatttcttatgagtgagttgtggtagcttgtgttttttgaggaattagcccactttgtctaagttgccaaatttatgtgtataattatttgtagtagttccttattatagttttattatcatcggtgtccgtagtaatatccttgttttattcctgatatgggtaatttgtgtcttctctttttttttcattgttaatcttttgttgtcaattttattgacaacattgcaataatgttctgtattgcttttctgttttcaattttattgatttcttgtattatctttattattttctttgttttgctttctttgggttgattttgctcttcttattttaaattcttaaagtagaagttaaaattattgatttaagacttttcctctttttcaatgcaaacatttaatgctgtacattttcctctcatcactgttttagctgtgagttcaaatttttgatattgtatttttatttttattcagctaagtgtatttattttcccttgacacttcctctttgacttatgaattacatagaagtctcctgcttagttatcatgtgtttggagcttttcctattatctctctgttattgatttgtcatttgattccattgtggtttgattttaattccattacattttttaggtttgttttatggttcaagatgtagtctatcttggtatatattctgtgagcatttgacaagaatgtgtattctgctatcactgggtagagtagttaatgtcaagtagatcctacggtcttacggtattgagttctttgttgatgctagttttgtgtctagttctatttttaattggtacaagagtgctgttgaagtccccaactataattgtgcattagtctatttctcctccatttctaacagcttttgcctcacatatttcactattttattttttggtgcacatacatttagggttgttatctctcattggttgattgactcctttattattataaaatgtcccttcctatttctggtatcttttttttttgctctaagatctaatttatctgatatagccacagatatagctgtgtccccatcaaaatctctcatcttgaattcccacatgttgtaggagggagctggtgggagataatttaatcatgggggaaagtctttcccatgctgttctcataatagtgaataagtctcacaagatctgatagttttataagggggagtttccctgcacaagctctctctttgcctgctgccatacatgtaacacgtgacttgctcctccttgccttctgccatgattgtgaggcttccccagccacatggaactgtaagtccattaaactctttttcctgtataaattgttcagtttcaggtatgtctttatcagcagcctgaaaatggactaatacagtaaattggtatgagtagtgggatgctgctaaaaagatacccaaaaatgtggaagccactttaaaactgggtaacgggcagagtttggaacagtttcgagggctcagaagaagacaggaaaatgtgggacagtttggaacttcctagagacttgtcgaatggctttgaccaaaatgctcataacgatatggacaatgaaatccaggctgaagtggtctcagatggagatgaggaacttgttgggaaccagagcaaaggtgactcttgttacgttttatcaaagagactggtggcattttgcccctgccctagagatttatggaactttgaacttgagaaagatgatttagggcatctggtggaagaaaattctaagcagcaaagcattcaagaggtgacttgggtgcagttaaaggcattcagttttataagggaagcagagcataaaagtttgaaaaatgtgcagcctgacaatgtgatagaaaagaaaatcccattttctgaaaagaaatccaagccggctgcagaaatttgcataagtaatgaggagccaaatgttaatctccaagacaatggggaaaatgtcttcaggccatgtcagaggtcttcatggcagcctctcctgttacaggcctggaagcctaggaggaaaaagtggtttcatggggtgggcccagggtcctcatgctgtgtgcagcctagggactttgtgccctgcatcccagctgctctagtgatggctgaaaggggccaaggtagagcctgtttaacctgttttgatttggagaagcacagaaaatgaggcacacagagattcacataaagatgccatgtatttgaggagcaatctgcctgtgtggcaatagagaaggagagagcttttagactatgaagcctggaagtttacaatggccccttaccctgaccagaacttcctgaaaaaaagttaacaaaggaaatagtaaataaagtaaatatatactagcaaataaaggctgctattaagtaaaggctaatattgaagaatctgaaaagcatcagcagaaatttattgtaagagaagagtatagaagtgggaaacaatatttaccatcaaataaaaagtaattgccaataggaaaatgttgcacagaacacattaaagaaaaccctttgaaaaattcaaactaaagagactttttataaagatcatatataaaaataaacaacaaaaagtgataattttgaaaaagagcaattaagggaaattagctctttcagatattaaaatattttataaagcctaatatttaaatttatgtgatattaggatataaatagtgagaaagaataaaggaataaaatagaaagtataaaaattaatatgaatatatatatatactttaacatatgataaagatgacatctcagttttcttgggaacttggatagccacttggaaaaacttaagttgaatctctactttatatcctaacaagatacatctaaaatggattatattttaatgttaaaaaataaataaatcttaaatgtactagaagaaaaattgaatacctcctataaaagctaaaagaaaagacagagcatttctcaacagcaaaatgtaccataagataatgtcaacagaacaagttaggaatacatttgcaatacaattcatatcaaaaagggctaatccctttaatacaaaaaatcagagaaaaagataatgtaatcaatcaaacaagatgcaaaagacaccaagaggcatacagtggaaataaaaataactattagatgtataagttctatgtcactctaaatatatgacttataagttggagctaccatgaaatatctttttatttattagatgtttaaaaccataaaattttaataacagaatctgtcaaaatgtgggaacacactcttactttgctaatggaaaggtcaatatgtacaattacaagcaagagaaattcaaactttcaaacatctaattacaaacatgtatttcctctgatgtttgacctagcaatttaatttatatatatttccatgtatgtaaaattacatctagacatatttattctttcaaccactgtttgtaatagcaaaagactgggaacaacccaaatatccattaaaaggtgaaggtttaaataaatgatgatatattcatacaacagaaggtaatacaaatctaaaaacagactaaaataaagtcttctttatgctctaaagtgaaaggatctccatgatatattatgtaaggaagcaaggagaaggatttaacagtttttaaatctctgctcttaatgctgcatataaggagcttggaagtcaccactccatccagttttctaacaagtaaaaaaacagaacagactgaaaaataacaaattttctaggattcatcagagaggtgaggatatagaacaaactgcttcccacaatattggagagataataagattaatacagggagtcatgggtttaccacagcagagacttacaagcaaaactgctgcaggaaccagtgccaggtataaaaacctgaactataattgataaattgctagagactcagagaggacaaatctgagacttgtatatcccaatggaatcctgccaagaagaggtggggtatgtgagtttaacctgcaagagtatgaccaggttctcatagtaaatactggaggaagacttcccttgtgtttcaagtacagggagaggaaatacaccagagtacactgctctttgacaaggcctgccctcaggagaagctattcaaacagagccttgtctgctgaggttttgtagcctaactgacatgtgggaagggaaatacccaaatctagccatcctatctcatggaaaaggaaggggggctgagaaattgagactattgggaggttcatagtccagagacacagtccagaggctcactgaaacactgagatctaatcataagactacagaatggtttccttccccccatcccttaacaagatattactaaaggcctattttcagcagttccatttacatggtaaatcatttctgactatgaagaaaaaattactaggaaaaaaaaaaaagaattagaagaaatagagtaagcatcaggaccaggtaaggcagggatattgaaatgatcaaacctgaaattttaaacaacaatgaaaaatacgctaagggctctaacagataaagtagacagcatgcaagaacagatgggcaaatgtaagcatagagatggaaatcctaggaaagaaacaaaaagaaatgctacagatcaaaaatactgttgagaggtgacagtgtgctggcagtcttcacagccctcgctcgctctcggggcctcctctgcctgggctcccactttggcggcacttgaggagcccttcagcccaccactgcaccatgggagcccctttctgggctggccaaggccagagctggctccctcagcttgtgggcaggtgtggagggagaggcgcgagcgggaaccggggctgcgtgggtgcttaagggccagcgtgagttccgggtgggtgtgggctcggcggacaccgtgctcggagtggcggccagccccaccagccccgggcagtgagggatttagcacctgggccagcagctgctgtgctcaatttctcgctgggccttagctgccttcccgtggggcagggctctggacctgcagccaccatgcctgagcctccccccgcaccccaccccccaccctccctgggctcctgtgctgcccgagcctcccaaggagcgcagctgcctgctccacagtgcccagtcctatcgacacccaagggttgaggagtgcgggcgcacagtgcgggactggcaggcagctccacctgcagccctggtgctggatccactgggtgaagccagctgggctcctgagtctggtggagacgtggagaacctttatgtctagctaagggattgtaaatacaccaatcggcactctgtatctagctcaaggtttgtaaacaccaatcagcaccctgtgtctagctcagggtttgtgaatgcaccaatcgacactctgtatctagctactctgttggggccttggagaacctttatgtctagctcagggattgtaaatacaccaattggcactctgtatctagcttaaggttagtaaacacaccaatcaccaccctgtgtctagctcagggtttgtgaatgcaccaatcgacactgtatctagctactctggtggggacttggagaacctttgtgtccacactccgtatctagctaatctggtggggacgtggagaacttttgtgtctagctcagggattgtaaacgcaccaatcagtgccctgtcaaaacagaccactaggctctaccaatcagcaggatgtgggtggggccagataagagaataaaagcaggctgcccaagccagcagtggcaacccgcccgggtccccttccacagtttggaagctttgttctttcgctctttgcagtaaatcttgctgctgctaactctttgggtccacactgcctttatgagccgtaacaccgcgaaggtctgcagtttcactcctgagccagtgagaccacaaaccgaccagaaggaagaaactccgaacacatccgaacgtcaggaggaacaaactccagatgcaccaccttaagagctgtaacactcaccccgagggtccgtggcttcattcttgaagtcagtgagaccaagaacccaccaattccagacacactgtgacagaagtgaagaattcctttgatgagcttattagtagactggacacagctgaggaaagaatctctgagcctgaggctataacaataaaaaccttcaaaacaacaagtaatgaagatgatacaatagctaaaaagaaattatttaggcagtgagggtaagtgtattagtcagagttctctagagggactgactaataggaaatatatatatgtatatatatatatgtatatatatgtgtatatatatgtgtgtatatatatgtgtgtgtatatatatgtgtatatatatatgtgtgtgtatatatatatgggagtttattaagtgatattaactcacaccatcaccaggtaccacaataggccatctgcaagttgaggagcaaggaagccagtctgagtcccaaagctgcagaacttggagtccgatgtttgagggcagaagcatgcagcacaggagaaagatgtaggctgggaggctaaaccagtctaggcttttcacatttttctacctgctttacattctggctgcgctggcagcagattacatggtgcccacccagattaagggtgggtctgcctttcctagcccactgactcaaatgttaatctctttggcaacaccaacaccctcacagacatacccagaatcaatactttgcatgcttcaatccaatcaagttgacactcagtattaaccatcacagtaagaaagtcctctgtaaggcttcccttttaacaaaaagcagcctcaaatcatttttgtttctagcaaaatgcagcctgaaaaatcaaactgcagatgtagaaaagcaagctagaagctttcacgggtaaatgccagcagctttgacaatagaaaaaggctacctggaggccaggcatgttcaacatgggactccatcttccctttcctttgtcaactgtgtgaactgtaaggaacagatgtaatggcacaggccaggtagagaactcatttgcatgataaaaagattagggtggggtagccagcttcttcatgtgctatgtaaatgacacacctggtccaaccaaccaatcttttgggccccatgtaaatcaggcaccgccttctcaagcttgtctattaaaacctgtgcatttcatcacaaaactggaggacccgcttgggagcccctctctctctgcaggagagagagctattctctttcttttgcctattaaacttccactgttaaactcacttcttgtcctagatttctctggcatgagacaacgaaccttaggtatttaccccagacaatgatgctgcttcaagaacaaccaaaaaatagaaaaaaaaaaaacaaaaaaaaacagaacagaatattcagggagtgtgtgacaactataaaaggtgtaacataaacagaaacagaacactagaaggagaaaaaaagtgaaataaacaggagaaatatttaaaacaataatgctttagaatttttcccaaattaatgtcagacaccaaatcacagatccagaaggctaagggaaaatgaagcaggataagtgctaaaatcaaatattaaaaaaaattctgaaagaagtaagaggaaaaaagcaccttatttttagaggaacaaagataagaattatatccaacttctcctctgaaaccaggcaagcaagaggagagtagggtaaaatttttaatgtcttgagtgggaaaaaaaaataatctcgccaacctagaattctgtactctgtgaaattacactacaaaagtgaaggagaaatacagattttctcagataaacaaaaattacagtggtttattgctactagacctgctttgcaagaaaaggatagggaaggaaaataatatagctcaaaaacttggatcatgataaagaaagaaataacactggaaaaaataactaacagtaaaataaaaacatttttcttcttcttaatctaaaagataatagtttgttcgaaataatagcaatagtgtatttgcttatgtattctaatatatatatagatttttatatgcttatgtgtaattggaatgaataatagcaatgatacaaagaatggaaaagaagtatcaagattattttgttattatagggtactcatactacctgtgaagcagaatagtgttatttgaaagtggacttggatttgatgtatattgcaaactagggcaaccactaaaaagtgtaaaaagaaagaagtataactgatgtgctcagaaagaagagaaaatggaatcgtaaaatgctcaatgaaaaccacaaaaggcaaagagcagaaaacaaacataggaacaaagaacaaacgcagcaaaaggaaacagcaacaaatatggcaaatattaattcaagtatacaaataatcactttgaatatccatagtctaacacaacttaatacatttacactgttggatagtaaaataacacatcttattagaacatgtgggatatagcaaaagcagtgctcagggagatatttacagcattgaatgcatatattagaaaaaaggaaagatctaaactcgaacatctaagttcccactttagaaaacttgaaaaagaagagcaaattaaatccaaagtaagcagaaaaatagaaataaaaaagttagaggagtcattaatgaaattcaagacataaaatcaatagaagaaaaaaatttaaccaaaagctggttcttgaaaagatcaataaaatcactaagctctagtcaagataactaaaaacaaagagagaagacatcaattactattatcaaaaaggaataggggatatcactatatattgcttgaatattaaaaggataactaaagaatactatgaacagaccaagcgcggtggctcacgcctgtaatcccagcactttgggaggccgaggagggtggctcacaaggtcaggagatcaagaccatcctggctaacaccgtgaaaccccatctctactaaaaacacacacacacacacacacacacacacacacacacaaattagctgggtgtggtggcgggcccctgtagtcccagctactcaggaggctgaggcagaagaacggcgtgaacccaggaggtggagcttgcagtgacccgagactgggccactgcactccagcctggatgacagagtgagactccatctcaaaaaaaaaaaaaaagaagagtactatgagcaactttatatgcacaaatttgctaacttagatgaaatgaaccaattccttgaaagacatagtttgccaaaactcacacaagaagaaatagataatctgaatagtcccaggtctagcaaaacattgaatcaattaataaccttccaaaacagaaagcagtaggccagatgggttcactagtgagttctaccaaacatttaaagaagaaattatacaaattatctttaatatttttcagaagatattagcagaaggaatacagcctaattcttccaataagaccatcattaccagataagattattacaagaaaagaaaactaaagaacagaccaatatctttcataaacataaatgcaaaaatcctcaaaatacattagcaaatagaatccaacaatgtataaaaaattacacaccacaatcaagtgggatttattgcatgcaggcaagactggttcaacatctgaaaataaattatgcaatccatcacattgacaggctaaaaaagaaaaattgcatgatcatatcaatagactgggggaaaagcatttgacaaaaccaatataataaaaattctcagtaaaatagaaataaagggaaactttgtcaacttgataaaaacaatctacaaaaatcctacagctaacatcatacttaatgataagaaactgtaaactttttcactaatatcaaaaacaaaccaaggatcctctctcaccacttctttgcaatattgtgctggaattcctagctaatgcaataaaacatgaaaagcagataaaaagtctacaaattggaaagtaagaaataaaattgtcttcattcacagatgacatgatcatcaatgttgaaaatgcaaaataagagtaaaaaactctcctggaactaataagtgattataccaagattgcagaatatgaagaataagcttagtaaattgttttcctatatatagcaatgaacaagtgaaattttaatttaaccatataataccaaatctacatgcagaaaactacaaaactgatgaacatcaaagaactaagtaattaaatattttatgttcatggatagaaaaactcaagattgtcaagatgttagttcttcccaatttgatgaagttccaatgcaatctcaataaaaattccaggaaattatttcatggatattgaaaaactaattctaaaatgtatatagagagggaaaagaccctaaatacccaatgtaatattgaaggagaaaaacaaaattggaggacgaagacaagacccaacttaaagacttacaataaagctgcagtattctagataacatggtattggtaaaagaatagatgaatagatcagtgaaacagagcagggagtccagacgtagacccacacaaagacatcaactgacctttgacaaatgagcaaaggcaatacaatgaaaaaaagatagtcttttcaacaaataatgctgaaacaactagacattcacatgcaaataataataaaagacagataaaataaaagatgtagaccttacactcttcacaaaaattaactcaaaatagatcatggatctaaatgtaaaatgcaaaactataaaactccttgaagaaaacataggagaaaatctaaattgccttggctttggcaatcactttttagatacaacaacaaaacatcttccatgagagaaataattgataagctagactgtatgaaaattgaaattttctgctctacaaaaggcaatgtcaagagaatgagaagataagctaatactaaaataaaatatttgcaaaagatgtatctgattaaaaaacttatctaaaatatacaaaggacacttgaaagtcatcaataagcaaataaacaacccaattaaaaatggtttaaatatcttaagaagcacctcaccaaagaagatatacagatgaaaaatgaacatataaaaagatgcttcacatcatatctttagggaaacacaaattaaaacaacaatgaaataccactacgcacttattagaatggccaaatttcaaaacagtgattatatcaatagctgatgaggatgtggagctactggaactcttattcattgctggtgggaatgcaaaataatataggcactttgaaaaacaatttggtggtttcttacaaaactaagcatattcttaccacatgatccagcaataatcatccagtaataatgctcctttatatccaatcaaaggagctgaaaacttacacccacagaagaatctgcacatagatgtttactgctgctttacttataattaccaaaacttggaagcaatcgagatgtccttcaataggtgattatatcaatgaaccgtggtacatccaaacaatggaatattatacagccctaaaaagaaacgagctgcaagctataaaaaacatggaggaatcttaaatgcatattactaagtgacagaagccaatctgaaaaggctacatatcacatgattccaactatattatattatggaaaaggcaaaactgtggagatagtaaaaagatcagtgattggaacagagaggcagaacagaggattttcagaatagtgaaaatactctgtatgatattatgatggtggatacattgcattatatatttatcccaacccaaagtatgttcaacaccaagagtgaaccttgatgtaaactaaggactttgggtgaccataatgcatcaatgtaggtttatcaattgtaacaaacgtaccatactgttgggtaatgttgataataaggaagattatgtatgtgtgtatgtatgtatgtgtgacagcagggggtatatgggaaatctctgtaccttcctcgcaattttgctacaaaactaaaagtgctctaaaaaaataacacctaagaaaagtaacttgcacattttaaaataagcaatgagtcaaagaagaaatcatgagaaaaattagacaacactttcagaagagtctaaataagacccaattcaccaaaacttatgaaatgtagctatacagtgataaagagaaattatagctgccaatgcctgtagtaaaaaagaaaaaggattctacatcaatcaattcacttcccaccctgaaacactggagaaacaagatcaaactaaacctagaactagtagaaggatagcaataataaagattagtatagatggataataataaagtaaaaaacagaaaaacaacagagaaaatcaatgatagcaaaattacattgtttgaaaagatcagtaaaatgcaaaacctcaagttagatgtgtgtttaaaaactgggaagattcaaattactgaaatcaaaaatgaaaggacctctctactgaccatacagaacaaaaaagaggaaaaaggaatcctttgagcaattgtaggttaacaaattagataacagatgaacaaattactagaatgacatgaattactggaactaccttctcaagaaatagaaaatctgagaaattagtttctcagattagacatatcataagtagagattgggttaattattttaaaacttctcacaaaggaaaaccccggcccaaattgttttagtgaattataccaaatatttaaaaattaatataaattattcacaaatttctccaaaatatagaagaagagagaccacttcctacctcattccattaggccaaagttgccatgatacaaaataatacaaagatatcacaagaaaaaaagctacagactaatattttttataagtatagatgtaaaaatcttctacaaaatactaggaaactaaatctaacaacatatgcaaaggattaattatacactatggtcaggtggattttatctcaggaaaacacgttcattcaacatctgaaaacaatgtaatacaccatgtcaatagaataaaggacaaaaaccatatgatcatctcaatagatacagaaaaaagcacttgacaaaatccaacaaagtttcgtgataagatcactgaaaaaactagaaatataaaagaacttcctcacctggtaagggaatctattaaaaacccacagctcacatcacacttaattgtgaaataatcaaagctttccccctaaaatcaagaataagacaggatgtctgttcacatcacttctattcaacatagtactggaggttccagacagagcaatgagataagaaaataaaaagcatgtggctgggcagggtggctcatggctgtaatcccagcaatctgggagaccaaagtgcgtggctcacttgagaccaggagttcgagaccagtctgggcaacatgaagaaatctcatctctacaaaaaatacaaaaattagctgggcatggtgacacatgtctgtagtcctagcttctcaggaggctgaggtgggaggattacttgagccctgaagatagaggctgtggtgagccatgatcacaccactgaatttcagcctgggcaacagagtgagaccctgtgtcaaaataaacaaataaataaataaactaacaaatagcaggcatcattattgaaagaaacataaaatatctgtttgcagatgacatgattttgtgtatagaaaattcttaaaaatatacttttaaaaactattagaactaataaaaattcaacaaatttgcatgatacaagatgaacacaaaaattatattttaatatactagcatagagcatgcagaagtgaaattaagaaacaattccatttaccacagcatcaaaaagaaaaaaatgcataagaacaaatttaataagtgcaaaagtgatatactgaaaactaggaaacatttctgaagtaagaatctaaacaaatggaacgatatctcatgttcatagatcagacatcctattgtttaaatggcaatactccccaaattaatctgcagattcaactcaatccctctctatcaaaaaaagcaaggagtagaacaatgtatattgttctgtattacttatatttccataaagaatgtctagaaacattcacaagaaactaatgaaagcatttatgtatcataatagttgggttgaaactggataaatgtggggcaggttgactatatatattgtttttctttttacaccctgcattattttttaaaagtatgggagaggagcaggattggaaattatcttgccccactctagcagtctgtaagatagacaagcctggattcatagaatcagactagaatgactgacaaataagcagtgtgtggaggtaatcctcataggatgtgtggccgcccattactttgaacttccagagaatattactaacatccattgaaacaggaacaagtaaaggggagaaaggctagcttacttaatccaatgggattttaacttctttatcactatccccacagcagctgtagcgagggccctcacacatctctccagtcttccttttcctcacactgtcacctcttatccaaagtcagaggaaacctagagaaggtagtagattttatctatgaatgatcctgctgtgcaaaggagaaaagatagggaaagactgggaaaaagagcagaggagtcagaaggagttcctgctgactctttacctaacttgggtaccacagggcaggagataaactttggagaagagtgcaattaagcaaacgccacttcagctttgatctacatttaatttgttcacatttgagggttcagatccaaaatgaaaaagggttttatggctgaatattatttcattatatatgtaaaccacatttcctttgtctttttatccactgatagacacttagtttgattccataccttggctgttgtgaatagtgctgtaataaaagtgggaatactggtacctcttcagcatactgatttcctttttatgagtatgtatacccagcagtgggattgctggatcatatggcagttccattttcagtttattgaggaacttctacactgttttctatagttactgtactactttagattcctcccaacagtgtactggcattcccctatctccacatcctcactagtatttgttactttttgtctttttgataacagccattctaactggggtaggtaatatctcctagtgattttcatttgtatttccctcacaatcagtgatattgaatagtttttcatatacttcttggccatttgtatatcttcttttgagaaatgtccattcagatcttttgcccatttttaattgcattgattttttgtttttttttgctattgatttgttagttccttacacatgctggttattaatctcttgtcagaccaatagattgtaagtattttctcacattctgtaggttgtcttttcactttattgattgttttctttgctgtgcaaaagctttttagcttattgtaattccatttgtctattgttgtgttgtctgtgcttttgagatcttaccccccaaaatctttgctcagaccaaagtcctgtagcattttcctagtgttttagtagtttcatagtttcaagtcttgtaatgaagtctttaacccattgttagttgatttttgcatgtggtggaagataaagatctagtttcatttttctgcatatgaatatccagtttatccagcaccatttattaaagagactgtcctttcccccatgcatgttcttgatatctttgtcaaaaaccaactgagtgtaagtgtatggatttacttctggattctctattctgttgcattcgtctaggtgtctgttttatgccaatatcatgctgtttgggttattatagctgtgtagtataatttgaaatcagagcttgtgatgcttctagctttcttctttttgctcaggatgattttagctattcagggacatttgtggttctatacatattttatattttttttatttctgtgaagaatgtcattggaatcaagcttgagcttgtatacagattttaacaatattaagtctctcaactcatgagcataaatttccaccttatcatttgcagcaggatgtgtagaactggaggtcattatgttaagtgaaataagccaggctcacaacaacagatatcacatgttctcattcttatgtgggagctataaaagggggtcttatggaggtagagggtagactgggaagggaagagggatggggagatgaagagaagttggttacggagtacaaagacatggttggatagaaggaatacgttctagtgtaaaagagtacagtaggcaaattatagttagcaataatttattgcatttttaaaaatagctagaagaaaagaactttaatattcccaaaacaaataaaatataaatgtttgaggtgagggatatcccaattaccctgatttggttattattcattgtatacagttttcaaaatatcacatgtacccccaaaatatgtaaaactgttatatacaaataaataacaaaactaaaaataacagctgtgcaaacatttttaaaaggcttgctttaaatgggtttcacatgaaagtaggaaaggactctctggagtctttaccatctttatgtgagaaacacattggtcccagtggtctctttacctttcttagtccatcctttcactctgtacatctttctgaactcaatgaattatacactattgctgcttaattgctttcagaaatggacccctgcacaggtgggaatggatgtgttcacatatgtcagagtgagaatggcacggccaggtgtgcctgtcatgcagggtaccagctgcctgaagataaaaacatttgtgaaggtaggagactgaaactgaaggattaattgtgtaattgtttgaaattttgtggtaattcagttttgaatagtcagaacagctaggagaaaaggtgttttcgtttattcttaaaaaggaacatttaaattcttatttgatcatttgaaagctatttttataccataaaacttcagtgaaattcttagtaacattttaaaaaatgacataggatagttccagacttaatacgttttgtttctcattctgaagtgaattccagaattaatatttcaaaatcttctatagccacacaggaagttttttattataggctacagaaggtggggataacctttgaaaagcaagtatatgtaaatgagtgttttcagaagtcaggaataattaaaacaaaaaagaaagaactctataaatacaaaatcacacatttatctttcctagaactagcaaaacagacatactttaattcaaagatgaaagtgacaaattcttccctcacaagaactgatacattaagtaatttctctggggcagtcttgtcaaaagtctcattttaataacttttgagaaatcactttttttatcatgatattttcatgaaatgagaaaccatttttatcatgatattttcatgaaatgagaaactatttatttggagtaactacaaaagtaattatgacttatgggactgataaaaattacgaaaaataattagtaatggaaatttgtgttttcatttttttctttaggttgaaattaagatgatattttctgtggattttttaaacacacttttctaacagagaacatttctgctttggtcctctgtttccacagcacctatctagctcagcacctggcacagaataggatcatcttaaataaatatttgaggaaaactgacaaatgtttgcagacatagatatagttatgtatatttatctgtctactgactttcacactcctattttaacatctgatacattatttatagaaaatctatcctcagaattactgcctgcctattctattacaaatacattagaagaatgagtatttctcttaagcaccctggtggggatgatatgtagtatggaggaagaaccagtttaaaaaaatgtgagacctatccccttaaagggaggaaggagagatcgcctgagccacacaactgaagttacacacactgaatagaattgactactgatatcaggagagagagggtatcagtgtctaagtggcattcccttgtgacaatcacatgtataacagaaaccatggattgctaaatatgaaggccccttatctgccttgcccgtggccacacatactaatgtaaatcaaagagatagtcctaaagacaaattacaatgacttcttccctgcattataaggaatagattaggcccatttttgtttcattttctctttttttcttattaatagatactattaggttctaatagaagtgtttgagagcataagaccaacactagtggtaatgtcataagcagtcagcttattcacaaatactcctttatataaagaatatggaacctatgtggtacttactgttacagtggatgttgggggtgggggtcaagtgggagcaggtgcattggtccattattgtagtttgtcaaaaagtcatcattatagctcctaagacatagctgttgtgtctgtcttcctgcagatataaatgagtgtgctgaaggtctttcttactgtggccactgctgtgtaaactctatgggatctttcacttgtgcctgccaaactggctttgagctgggagctgatagaaaacaatgttacagtaattggcaacagtcacagcccaggtaatgtgtggcattttacaggtattaaacatgagtaatacataagagaattacattgtgtgtcttgctaaagcaggagctcctgagaaggatgtggatggaggcttaaaaatccaacccctttattttataggtgagaaaacagaggcccagagtcaatggagaatggtttgcaaaataatctgtagtgtcattagcaaggattaagcctcaggttttctgacttggggctttgttgggttcatagatctttgtgaaaattctgccttcctttatcagttctgccatgcaatatttattgaacactaataactccattgtaaaactcaagagaaaggaaagagcaggagtgaaggaaccaccgtacaagaagcagctctaagctgcaataccatgcctcatgcattggatgttctaatgagaatcttccacattggccctccccctccctccctcatttcctttcattatgcctattgagcagctgcttcctgctttgtcttttcttccactgattcatttccctatcccttctcttcaaaacattcatgatccatatcatataaccttagcatcttcctccctaggctcagttatacaactaaatatatccctttttaggaacatattaaaatgttaatatgctgagcgattagctatagttgctattacaactatgttctcctcacacgtcatccccactggtccactacttaatctgtagatgagcacactttctactttactaagctttaatctatctgatacaaatttcctcaagttcaatgttttctacctcaacatttgccatcctcatccatctctacttctgtccttttctaaatggcagatttttttttcttatttttatggctgatttctccatctctgtctcagtacatcaagagacagaggtcttggtacatcaacaattcatttttcttcttcatcttcttcttcatcttcagactctatctttctctcagtgacttcttccttctttttccagttcacgactatactttaccaggtaaattttactatgttgaaaacataaccatgctaactggttttgctttaaattcaggatcataaatcttaaatgattaagcagcattggtggacaaacatactgtcagaatatgtctacttttaccctcatcaaaataagtgtttaacatctcttccaaaactttatatcaccctccttttgacctttgtcctcatctcatctcttaggtcatcaaataataaatgcaaactgtcatccaaggtaacaattaaaccaaagtctcccatagattcacatggaaaggcttcagtcctattaatatgaagcaggtagccctattactatcaaaggtcatcttctccatggagctttgggttccattctctcttcacatctgaagatctttgcttttgcaattatttccctcttttctgaattatcagttctttcttctgcatcattttcatcagcataacaacatggccaagtatcttctgtctttaaagtactttcacatgagtccatatttcataaaagctaatgtctgactctatagccaatgtctcctctttctcatcttgcattctctcatcagcccatactaatcaagttttcatctctactctgccacttgtcacccatgacctctatgctaccagattggatggtagcttcttcaattttatcctaattgacctctcagtagttttcaacacttctgactaccctcaagtcaggcaaagttcctgcctttatggaacttaaattcctacagaggagatagaaaacaggaaattaatcaaagaaatgtatactattatcttatatagtgttaatatgcaatgagaagatccaagaaaaaggagcagtaataactaagaccctaaggtagggctgagcttgatgtttcaggaaacagaaaaccagtgtgggctggaaaagaatgaacaaggtgtagagacagtcaatgagagcagtaggcagggaaagggaacaatcagattatactagacttggccatcgcaagcggtttgaattttattccaaatgtgacaagaaggcattgggtagttttgaacaaacaaaagagttcaagaagagcaaaagagttcttctcaaaacactcttcacttctgtgttactacatttttctagtatttctttccatctctggcccttctctcaatgtaaaatttatccaactgctctccttttaactacatatgaatataccaaactattccgcatcactacctgcatgactggtaggcatttcccacttggtagaaccaaaacagaaatgctgattttgagtccgagtcccaaagagccttttctcagttcttcacatattaatcaatcatccatttagtgacaaagtcaagaactcagtgacagaaaattaataagtgactgaactaggatttgacctagagtcttcctgcctcagatataatatcctttcagcttcatcatgtgtttatatacgttatgtctctttattagttttaatgaaggaacaaataaagatggtgatatataaaataaatatttaagctttcttacctgagctctttcatgaagagatattattagagtaactaaattcctcattcttccttccgacataaaattctatgtgtctttaattctacgctccttaaggtctgttggtatatttttattgcttaaagactacatttttgctacagtgatatttgccttttaaagagcaaactaaataagatgggagagaaatttgactactaattaagatacaacttcctctgaagtcaggcttttttttttaatgccctaaggagtcctttcaggccgagaaaagtgtggaaggatttttctttgccttaagtattttggctttaatgtgaccagaggtttaggggatgagtatattttacaagtgtatgaaattaaacctcttgtaatctgactggtgcttcctcagttatcaggaaagagggggtcattattgataagttaggaggtacatacaagttttctgtagaatttacttgggaaagaaatttgctctcaagttgaatacatttggtagaagtttatttttacatttattttccttctgtgaatatttggctaagctctttctgcagtcctcaccagacctatatttactaactgaaatacaaacctttcctagtgaaaactggtcttttgacttgtttcaaaacctatagatggaataagtccttttagaccatgatgtcatatatatatatatatatatatatatatatatatatatatatatatatttttttttttttttttttttgagacggagtctcccactgttgcccaggctggagtgtggtggtacaatctctgctcactgcaagctccgcctcccgggttcacgccattctcctgcctcagcctccagagtagctgggactacaggcacccaccaccacgcccggctaattatttgtatttttagaagagacggggttttactgtgttagccaggatggtctcgatctcctgaccttgtgatccacccgccttggcctcccaaagtgctgggattacagacgtgagccactgcgcccagccgagtatgatgatatttaacaatgaattatgtgcccatcatctaaagtacgttttgaaatgatgcttttttcttttttagagaacagtgttttatatttatgtagttttttctcaacaggtctcaaaacactttgcagtataaccattgaatcttcatagtgtactatgaattagctatcattgtcttataattagaaattggaaaatttgacatacagaacacttccttcaaattaccaagcaatatgtaatatagtttaactatttcacacatatttaatgtacatcttatctagcaagcaaacaatatatttgctacttataaaaatgttttaagtatgatttctaaagtactataataaaaacattttttatcatctgaatcaaagaatcaaaatctcagcttgcatctggtaggtagttatggatctgagtttgcactttttttagttccatatatctttaaagaagtgaccatggtatcatttatattcaaatccaattaccaccagcagtctaaagctgtattgatgcaatatcactggaaaagagcatgaataagagaagcctatgtaaaaattgtcaaatggatactttcacctctcttcccccctgaaaaaatcaattaatattagaaatttattatagttttcagtattttaaatataacctaatccagggatcaaaactctaacaccaacacaagacaggcaataaatataaatgtgtaagacaggctaagcataaaagataggaaattgtaaggactgttttgaactggagagggagttttgggcctagagaggacagctattgcttgattgcttgcctccagctaactgtcacctagagggagtgtgatgccagtgtactagacccactgatttattcaacaagtgcttactgaatacctaccatgtgctaggtgctgttcctaacactatagatacaatgataaacaagtcaggaaaagttcctgcctttatggaacttaaattcctatagaggagatagaaaacaggaaattaatcaaagaaatgtatactatcaccttatatagtgttaatatacaatgagaagatccaagaaaaaggagcagtaataactaagaccctaaggtagggctgagcttgatgttttaggaaacagaaaaccagtgtaggctggaaaagagtgaacaaggtgtagagacagtcaatgagagcagtaggcagggaaagggaagaatcagacttggccgtcgcaaggggtttggattttattccaaatgtgacgagaaggcattgggtagttttgaacaaacagtaatatcatatgattttcactgtttaaggactactgtggctactccctagggaatggacagtagggagtgtctgtaaaagcaagattagagtcattcaggtgagctgtggtggtggctttaattaagctagtagcagtagatttgagatttattttgtagacacagctgagatgaattcctaatgtggatgtgaggaaaagaaaaatcaagaataattcttggtttggggctttaggaaacaggtgaatccgaatgtcttttaccaaaatgtggagtccaatagaagaacaggtttggaggtgagatatagggtatgtttaaatcataacttctatttctgctgtgtgaagtttaaggagccaagtagaaataacatgtaggtagtttctatctatttcctaactaaatagaaaattctagaagtttatggtggtcagagcttgagtgagcagcttgtcaagatgtaaatgtcagtatttaagccatgagcaagaatggggtcacttacaaagggagggtgtctggaggagtaagcaggaggaaactgagactgtagactccaacattaagtaactaaaatgtgacacagagacaggaaagactgaagaagaatgtccagtaaggtttaaggacaacttggataatgtgattttctgaagaataaaataaaaaaaagttgggagaagtaaatggtcaatggtatcaagtgctgctaaggattaggcaatgtggcagtaaatggagaacaatgtggaatctagggagggttatcttgcctcttaatttattttttacttagacagtaaaattaacatgttcagtatataatcatatcaattttaattgtaaatatatagatttctgtaaccaccattggaatcatgattaagaatagttttgtcaaccccagaaaactccctggtgctacccttggcttgtcacttattccccgtctctaacctttgacatctacttgatgtgttctccctcactggaattttcttttcttgggaatgtcatataaatggaattaaactgtgtgtatccttttattcaacataatgccattaagattcagccaagttgttgctcatatgaagagttctattctttgatgagtatggatatactatagttggtttattattcaccctttgaaggacatttaagttgtttccaggttttggcaattatgaagagagctgctataaacatttgtatacaggtttttatatgaacatagttttaaaaaagatttttctcttcagtaaaaacctagggctggaatcacaaggtcatatgataggtgtatatttaagtttataagaaactcccaagctatcttttggaatggatgcaacatgggttattggctttaaaaaaaaaataggagacctttaatttgtgatgaaatggtggaaatcctaatattttcttaacttttgtaacaccttgataatcaaatcccatataactgcaggccactagtttccaaaccttagtgcaactcaatccctctgttaacagtgggaaaaatactgaggatcagagatttaaaataattgaagattacacagctgtaaagtgtcagatcttccaactttaaatgttgtgcctttttctattatgtcacactaacttttcttaggaaaaatattacaccacatttcagtgaaatagattacatgcttgtcaaattattttctctttttctttccttttttttttttttttttttttttgataggggcttgttctgtcacccaggctagagtgcaatggcaagatcacagcttactgtagccttgatctccccagctccagcaaccctcccacctctcagcttgctgagtagctgggactacaagaacgtgccaccacgcccaactaattttttatatttttttctagagacagggtttcactatattacccaagcttgtctcaaactcctgggctctagtgatctgcacaccttggcctcccaaagtgctgggattagaggtgtgagccaccaggcctagctattttctctttacaaatgatattatataggaaaacatctctgaattagaaagctttgattcttaccagccctgctaccttaggcaagtcttttatcttttctgaacctcagttttctgatcctaagcaaaaatcatgttacttttatgacttataatatttagattaataagcacatatgataccttgcataatatagactggcttttacaaccaacagtgccgtaaatgttattgaagtgatttcatgtcaattgaccttacttttctctctaagcaatgatggagattaatttgatagactctaagataccacatatggttcataaataggtaaaaatgtctctttataagaatggcaatagcaagcatatgtcagaaaaaaacttcaattctgtatcagaaagatctgtgtgtccctgtcaccacaaccagagacatcatttgaaataggtttctctgaagagtatatgttaatgtatcaagaaaaatatcagttcccttcactaatctttcctttagctttctaattttgcttagtcctaaactagctgtttctaaacccaaaggggttcttatttttaacaataaattgattagcataatccttcttttgtttattcaatcattggaaacctattttgaacatctgttatgagctggggagtgcaagatgatgatggcgcagtgggctgggcacaatgacagggatgtgccctgggtgcttgggagcatctgaggctgctctgtgccctggactggctgctggggagtaggccggatgatttctggaactgtagtggatgtctaggcagtttatatggtgacatatgctttcaaggagtgttacaatcccaaagactcttgtcttgtttttttttttttttttcctccagctttttttcttctaaatgattcataagttaagacttagaggaaatgaatcaatgtagacactctcagtaagagggggtgtgttcaaacaacataaataaagacccatagaccttctgtggtaaaaatggcattcagagtatctaaagtccatattttaacatggattctaaacatttttataattcttattttgtcacttagaaaatgagagactataatgcctgtgtgctcaggacaattggcattcatctgctgaggctcaggcccaccaatatgcctgaaattagtagcatgtaccagccaaattgattttcacagtaataatttgtttatgtaataagtgattctcgtataaatcaaagctcattagtgcatcaacatgaccctagttacatatgatcaactaaatcattgggtttatgtttacacctttgctccaaggttattttttaacagtattttcatgtgcttatagaccgtaaaaaggacgcataataacatactattagctcaagaacaggaatgtcagctagcaaacaacctatttgatttctgattattgatttaatatatatgtatatatattacatctattatatcctgaaaatactgagaattcccaaaacatgtttcctttaaggtaagtgtttaataaccagtggtgtattcatcattacctttctgtatcactcaacattatttatatgtttattagtatataatgtggtatataggcatttacaatgcttaataaccctcagacttttacttttatgtgtatagagtgttgatggatttctaataaagtttgtcatcctctcaacagagagaatgtgtccgttactgacatatattcaggtttgtctgttatgctaataatcctcttttgctcattttggaaagggattgaattggaaattgtcaatagctgtgaaaagaacaatagtgtttgttcccatcaccgtgaacatgaaattggtgctccccgttgttcctgtaaccatggacaccagcttgattctgatgagaaaacatgcataggtaatgtttggtaaatgccatttcattcaaaagttgctctggattcatttagccctttaatctgtagtacttacggctgtactgtgagccacatctctcaaactgtaaagacaaataaattgaagagtgtctctggctactgaataaatgtaaaagaagggttacctgtcagaagacaacattacatttagatatttaccttgaagttaaaggagatttaaaacactttaatgaaatatatgcccttaatagatttatttcaggaaaatattccatgatctatccaactatgtgatgtaatgtgtaattccaacaacaaatgctgtcacatacctcagttctctacctcaagcagaaacgaaattatttgcactggttttcaacttgataatgtttgggatgtatgttcaactttgatatgacaagtagctatattctaaaagacaacttaaaaaaattcattctttggaattcccagctcaaatccatttttaattgctaattttctcaacatattattggagtttatatcatttgagacaatgaagaaactaaaattccaccctagttttgcttcataatgaaacattcctgagaaaaaggagtatctactataaataggaatagcaagtatcaaactacattactatgtgccctggttctgagaacacttccaagtccctaaggcagtgatttgtcatcattcaagaattatgacaccttatttgcttgttttcttttgttatgcttaatatttcctccgttaaaaattacaatacaaaatcttttgaccatttcatactactcaatatggttagatagagacaatttgaagtatgaaaaactcaatggtttaaatatttaggacattttactttggcagtatgatgacacagaatgaaactcaagaaattttgcagtattctggttttataaattcaaaacaatgccattgtatttatttatgcaacattgctttcaatattgttctcagaatctacagtgggtaacatattgaagccagttgctttcctcacctcttattatttaatgaaaaatatgcttacttttatttcctaccttgataagatttgtaaccatagaaaaaattaagggctttcttccttgattgcttcttttttccctccctcttttccttccttctatctctctgtttgttcctcttttgagtattgataagagaaactggaattttgccaaactgtttctttgcgacttaaatttggtgttttctttattttttgaaaaataccattcagtaaagttcttatttacagctagaaaaaaatagcatctgccagggtcaaaatgtagaaaagtgcatatttatgaaatttcagccgtcagtatgacaatgttatattgtttatggttcaagttaatttcatttttccgacaagaaaaagaaaatgcaagccaagcactgagtctcatgcctgtaatcctggcacttttgggggctgaagtgggaggattgcttgagtccaggagtttgggaccagcctgagcaacttcaagagactccatctctataaaatatttaaaaaataaccaggcatggtggtgcactcccagctacttgggagactgaagtgagaggatcgctctagcccaggatattgaggctgcagtgagctatgattgtaccactgcactccagcctggatgacagggcaagaccctgtctcaaaaataagtaaataaataattcaatttcatttcatctaaaacattattttttaggctttttaaaagtttttcagatttttaaaaagtcttctcagataccaccaaagacttcgagcatatcggtctcaagatgccctgttctcaaatagcaaggagcaacattgcattacacaattggaaaacaagtccctcagtctatcatttagtgatccattttggattctttttctattaacattcctctggggctatttctagtttgtcccatgtataccatcctcatttggaactcatctgaaaccccgttcttcctacatcacaagcctttcttaaaatgtcttgccacttcaactgttaaatcacctgttttctaaatttcttttcaaattttattttgttagatctttgcttgctactgtaaataggaatagcaagtattaaactacgttactatgtgtcctgattctgaaaatacttccaagttcctaaagcagtgatttgtcatcattcaggaattatgataccttatttgcttgtttttgttatgcttaatatttcctcaatattctttaatatttccttttcttttgttatgcttaattttcccttttaattgtcctcatctctgatgatcatatttttcctaaattggccaatatgccaaatattttaccattgtacccaaattaatccatacataaaaatttagccttaatcaaaagtagaggaccaattgcagccaggcaaaacactgaaacatttcagctctgatttcagaaaagcatcaaaagtgaaaaacttgatcttctgtatctcttccccatacatagtcactgaataaggttaaataataaatattttctaataactggccaattgttaaatttagtgacttcattgctagtcagacacttgcattttatatacctgtctttcaaattgtgttaacacatctctaggttttagccctaataagtttttgcctttggataggtttaattaactatgtgctaactggctgacttatttttacattttttgtacattcgcatatatattttttcaaagttgatactaatatatgataaaaagaaaatcctttgatttccttcatgcatgactgttttttatgaagcagctgtgacattaatctgttctcagacaaataagtaaaatatgtatatgtacattccaagtgaataattgcctttacactagtgaataattggtctttagaaatgagtagttttttttgttttttgagacagggtctcgccctgtcacccaggctggagtgcaggtggtacaatcacggctcactgcaacctcgaacttctcagctcaagcaatcctcccacctcagtctcccaaagtgctgggattataggcgtgagctattatgcccagccttgaaaatgaatttttttaaaagttttttattctctacatcatactatttaatcagtaggattaataaaaggaaggtttaatactagaaaggaaaaaatatcatttagaattttgtgagtagttctgcttttgacattttgtgggaaaaagaatgttttatgtctaaatgaccttcatttagatattttatggtgacccttcaccttgattgattgtattttctttcctttctttcttttgtcttcattttcttgagttgataccctttccagggttaattgagacattgaccctttttatctgtggctgcttacgtagttatggcatagtaggattttgtaaactcagcactgacaggccatccaccttaacagctcaacaacagaggggcttgaattgaaccaaggcctagagccaaaaaaaaccctgaccaaataattcccaggtgttcggcctaaggaaagcagggcaaagtgtccgttgctacttccttggccaattatgttagaaatgatcgcctcaaaactcaggtgaaataggttatcctttggctgaaaacttacaatttgacatcttctggtgcgtttctattttccccagggcagttatatcttaataagaagcactcaggattgtagaattctgaaataacagtgctaaagaaggcttacagatccttacttagaaaactgctcacctaacaggacatttcagggtaatgatgtcacagatggaataaaaaaccccagacctcactcatcccagtcacagtataatctaaatattcaaacaaatgctctgaaatggtctataatttaaaacataatacttaaaataagtcttctgccctctctcagaactgtagttgccacttgtcttcccagtcaggcagttgggaacacttgcttgcgaacactctttgatctgaagttctggaagaacaaacatgttatggagtctaagactgtctcctctttgcagctgtcaaatgttcaccaaatggaattttttggctcttttttcttaggctgtttttttgttcttcaacttctctgtttattcagtccaattactgtttaaactagaaaaatagcagagatcacttttcctatgcctataaatgcatttggagattatttacattcttttaaaataaataacaggcatagaagaagcatgaagaaacataaaccaaaagtaggtctccttatttttgtgttaaggtttcttcgctgtttgtattacatggcctgagaaatagaaaatgattagtaaaacagttttaatttagaagtgtagcttatcagtgcttctatagggtcgttaaattcctatctctgcaataacagcagtgttctttcccccttcagatcttgacgaatgtgagaatggagaagcctgctgtgcccagctctgcatcaactatttaggaggctacaaatgcagatgtcaggaaggctttcagatcacttccaatggttgtgaatgtgatggtaaattcctgagatttaacaagtaataattgatgtgacagggcaataaaggaagagaaatgtctgaggcagagggctagggtgggcaagggaaggctttcacactaaagagacttgactttctatgtggttctaccatttactatcgtataataaacttggacgactttaactgcaatgaaccttagctgctcatcagtaaagtgatgacaataataggattagtggggaaattaaggaaagtaataaatgtaaagtgcctagtgcaatggctgacatagaaaaataactaaaagtagctattattgttatcatatttattggtccataatcactttcacacaatttaatgtatattaaaggcaaatgagagattctgaaaggcacactgtcaaaggaaccacccatggcaaacttgactggaatgagaaagctggttactggaagacattttgaatgagttttttttgtttgtttgtttgtttttttttttagttagagagcaaaaggaccatcagttcacaagccacagtctaaatctgtaccagaatcccatacatatctgatattaatatagctaatgcaagttttaaaatgagtcatttacaatttcttaacttacatgttaaaattagttcacttacctttcaggtgattttttgcttgtatatatttttttttgatataagagtttgaatttagtgagtagagcttgttgactttgtttatacagttaggaatagctcatataaccattgctgtaatttaaaagtttaccttaaatatttaatctttaaattttcatttagtattattattaccattattttgaaccaaatttttcttaacatcaaagattagaagattgatatctattctaataacaatcaacttatataagactgtaatgcctcagagaaattagtttttctttgcttaaagaaacacatttcagaattctgtcaaagatgatagatagccaagctcccccaaccttgcaatgaagataacagcaatgaacacacaactatgatatctatatatactaaacacggtagcgtatattgccatttaccacattacatccaattaacagagccaaaaacatttttaaaatttcatgtaccatctgctcttaagcagaatgagccaagagatgattgtatggcatgaacatacatacttgcatacacgcatgcaaatggaaaaggcatcaacaatctgaggtaaagcttagaagctcatacatgaacttatagtattgtgaacatattgaccaaagtctggactcagacttggtcataaactagtaagttgcatgcaatcaaggcctaaaattctttcttctctaaaattgtccacaaagcttgtactgacttgtacctagaataagttttctatcatatatattgaataattcgagagtgaatgaacattctacaaaagggtacacagcctgagaccactgaattaattaattatttaattatttatttatttatttttgagaaggagtctcgctctgtcgccctggctggagtgcagtggcgggatctcggctcactgcaagctccgcctcctgggttcacgccattctcctgcctcagcctcccaagtagctgggactacaggcacctgctaccacgcccggctaattttttgtattttttagtagagacggggtttcaccgtgttagccaggatggtctcgatctcctgacctcgtgatctgcccgcctcggcctcccaaagtgctgggattacaggcgtgagccaccacacccggcctgaatttattttaagtttttcatctaaacctcacaaacaaggtctcagaaataccttgtctgtgtagatgaagtagagtaaacttgaaaatgagtgaaataaaaataattggccaagtgtacttgagaaagaatgtgggggctatgcttgctttctatgtggcagtacattgttattgtttaataaaggtcacaagaggaacaccaatatgtctattatttcataagatctatcttatctctcaatgcctaaaagcagatattgtttaaattttcttagatgtggatgagtgtctggatgtcagtatagtctgtgaccaactacattaattctgtgggaacatacgaatgtagttgtgaagaaggctacagaattggaaatgacagaaaaacttacccctgtaagtcactgaagaattttattgtattaatatattttctaaactacttccagcctcatcttgttcttcaggagcaatggaggccacatatttcttaactcaacctgccttcccctttctgtcttcacagactaagatctttccttattttcttttgttctctctgctacagttttaactttgtgctggcagcttctcaccttcatttacaatagacttttgaaatggccatctcaaagcattttacctttctgttaccccctgccttggctgtctagttcaaactctctcatttctctatcaacctttgcacagtacttccttcttttaaccaagttgaaacctcgcattttcttctatggccttagctttagatgatgatgagctagaggaagaagaagaggaatgagaagttgtgaggtttccaggtcttctattcaagagcccacctcaacagcttcattatgttgctacttttctgcctcccacctacaaagatgaagaagatgaggaggaagaggaaaaagatattcatagagaactgactgctttgcacaattttggtgtgtaaaagaatttaccttactatacttacttctatttttagataatttactacatttttgtagacaattttactatcaatatttaatgccatcatatgttttaacatgaagtttgcaagaaaagtagggccaaagtcacttcttcagagcttcctatgaaatccatcatcttttgtcttttttatttccttttgtacaataaaggagtgctgtgtaggtacttgtagaagtgggagtgcagtgtggaggggtgttcttgaagttaatacagggaaatggagcagaaaaatatctttaaattagcataatggggagaaagattgaaatcttataattctattaaaatttcactagaaatcaccttagatagttaaaatttaccttaaatagccctaaaatgtagttcctttctaggttttaaaatgcagagaactaattggttaatatgcttaaatggaccagaaaatcttcaaaatgtgagcagtttttcttatatatctaaacaacagaactcaagcgtcgacttctgatcaaagtaaatctctatcaaaagtaactgtttgcagccagtccactgcttcttttttttcctttgtaaaacagagctgttctttttattctccctctatttattgtattttaacaatatcaaagcttgatgattgctttagaatgtattcagaaaaatagaaatatttttacgcagtggtcaaatcataatatcatcaataagtgtctctatataaaaatagaagtactttaatgtttcttaattaaactcctgatgctttggctaatcaaagtcagaagagaaatagttgggggcggcaacaacaacagtcagaacttgagttgccaagatctgcaaagaagagaagaccagacaaggaggatggtctcagatgcttttctcctcaagccatttgccaattaatgggttgtgccaggaatctgaaagatagctgctaggagcttgaagagtgaagcacatttatcagcagtttcatgatgttggggaggcagaacatggagctcaggcctgccaaaggagagaagccttggtaaatatgccaagttttcaattagggcatcttaaagtccctaccctagaaacagggacaaaagttaaaatggaatgagccttaaacaactgaatacacatctctccacctttattctatatgataatttccctcaaaaacagaatggataaataaatacattgtggtacattaatacaatggaatactgtataaccataaaaaataaactctcgcatacacaatgtgtatgatctcacatacattatattgaatgaaagaagcttgacaccaaagagtacatacttttcaattctacctataaaaagttcaaaaaagggaaaataatctgtggtgatagagatcaccacgatgcttaatttatgaaattaatgattgaaaattattaagtcacttttgagattttggattgctagtaatattatgtaccttgatctgggtggcatttacatgagttatttacaatgtgaaaagaagtttgaagtatacagtttagatttgtgtacacttctctgtgtattaaattttaataaaaagatttactcagaaaacaaaaatacacataaaaaattctgaaagaaaaagcatcaaaatttcaggaacattgaattttttttggtctcaaatcaatgataatttcttttttaaaaaagaaattcctaaagattctaagtattcttagggacaatattctaatgtaataattggaaaaagtaaaataagctttattttaaaagctatatcttgctgttgtcctttttaaagattctttaggaactatgctcaaagatctttttttttttttttttttaggaaattaagggttttattttgatttttggttacgtagtcaattatggacgaactaagatggtatcacattacagtctgtttagatcacatctttggacacaattgcagcttgagctgcaaggactgcatgaatggaggaaagtgccaggaaggaaagagtgaatgctcctgcccagcaggttgccgtgtcattctttgtaatgaaagtaagtgacaccctgagaattgggtaagtgctccaaactactcctttacatatgttctccccaaaatgttttaataaagtaagcaattgataagtatgagaagacaatttatttgttgggcataaataatgcttatgaagtgctttaagttttaaactgaatatgtgatttaaaaaggagattttatgttccctaggaaactcaacatgctgtctcttgtttatccatggaatgtaaaagttaataaaggatcctaatattctaggcctataaaaatccctccatttaaataaatcattaggccctgacaagctattcccaatgaagaaaaaaggaaaggatttgtgctacaaagtgcaatttaaatggacttgcttgactgtttgctacttggttttgtgtacttttttgttctttttctttttaaaaacatgtaaacacagccaatgacactggtttaatttttttattcaagtctctcatgagtaagttcaaagatttaaaaatgatactgcccaaaattcctttcctctatattttaaatgaaggtatgctttcaggagttcaaacttccaagtgataaaatgtattgactatctttgtttcttctttctctttttaaattcattttatgagttctatttatataagtgttttgtcttagtttttgtgattggcttggaagatgatatgaacagattttcttttgaactctctacatatgggaggaacacagctgttgttactcttatatgatatagatgcaaaacttcagtcataacatagtgaaatggtttaaccaagattactagttagggttttgaggatcttcctcatgcatccctctgatcatgtttctctgctgctgaaaagctttgtgcctttcccttcacataaagtgtatacatcttacccagtcactagtggccatcagactctcataaatccttttggctttttgtcctagtcttaacgcttcacctaacctattatttcccgcatactaaaccactcactacttaatgtgctgcatttttcatctttgtgccttttgctaaactgtcatccttgaaggcctatttctgcctattgcatgaagctttatttgatggcctcagtctaacacagctatttatgtttttggtggattaaaaaaaaattctctctctctacattggattattttctatcttctttactagactgagagcttgctggccaggtcctattcatgcttattcattgtgaatttctccacactggaggtatccagtgcatgaatgaacacatgaataaaacttggtgttgaaactcccagctatattgacctgcaacttggcacactcaaatacataaaattgggatcaaataaatattattgcatgaccactagtaagtcaatatttaccttatattgtaagttttattgataaatatgcatctcccaatacttatccctaacatagtaaaaaaactaaaaaatctatctcaaacaaataagaataaaataaataaaaatttaaaaataaaaaataaaaatataaaaaatattttacacactagtaaatttaaaaactaaaaaataaaataatgaaaaaatctgtctctaacacgtaagaataaaatatctctgacataaaattaataccaaaatattgaaaatgagcttgctgataaaatagaaatgagatggcatcttctttggctttagaaaaccttggggatctctcaaatatttatatgttgcaataaaggggagtctacccctgaaagcagaacttctatcttctttgtactttctctatatccttctcttatttcttttacaacaatgaaaacagaacaatctatttaggagaaacaaaaaacaattgttcatatttttttaacaaaaagaaggagtgggaatattttctttaaaatccctattggccaggggtgctggctcatgcctgtaatctcaacactctgagaggctgaggcaggaagatcgcttgaggccaggagtttgagaccagcctgggcaacatagcaagtcctagtctctacaaaaataataataataagaagaagaataagaataaatccctttaaactacaataagcagagaccagttattcattggctatatttttaagattgccagcttttcaaatgcagcaaaataaatgaaaaaagaactttcaacagggatctagaagtcagttttcccgttgagtagatcttctagcccaatacatttattagtctataatgaaaatatctactttgatttcttagaggtttcttcaaataaatatattgaaacaattttaaaatgaccacatattatttaattttaaaagcacacttttagaaccccatttcttatgaaaggtttcatatcgagatcatttgttattgtgagactgtatctggtggaaaggaaagataggagtatttttcatatgtcaaatgagtagactaaaacatgggaggagagatttatgactttttttttacatcatccagctatggtttgggacgtgtttgttttacatttttcttccccagaatctctacactgtttgatctaatgaagtatttggcaaatctatagactatatgataatcacagtttactttgtgagggagtgtcaaattatagtgtcggtttgtctatattgatgactcgccataatccagacgctgtgcaagccatttaaacttccttagcttcattttacaggttaagtgtttaaaaattgccccttctgtagttgctgttaaaatgcaaacattaacaaaatgtaaattaataatataggccacaacaaatgcttgttgccagtctctcattttttgtttatcctttccttttttccctttcatagtaacctatggcttgaaagcaaagaaaagggtgaataagaagccaagttccatattagcatctggaatgggagcaggggatgaatggagcagattttataaatgtaattttataacatttagcctattatgataaaatgtcaattacagttattactgaaattatctcaacagctacatttgcttacattacaatataaagtcaccgacatttttcccaatttattgttttatagagcactaaacacaaaaataccaacaacctaatgaaaactgttgtttgcctgactttgtcttatctttggcaatgcaaactaccttgggacccccatgagaaccttagctgcattcattcctggttaaaaatacatgacattttaaaagcatttttccctcagttttcaaaatagaagatgcagtttgtttctcgttagggttggaattgtacagcaaagttgtctgggtagcttttaaagtgtgagggttagagtttaagaaatgagataaattttgcatttgaaacttgttagcaatttcttcagtcatcattattttaactagctgtatcagtaatcccctcgggagtgattatgctatacaaactaggaacatgccagaaaattttcctgggtctgtaagccactgagtttttaattacttggtatctatcctgatagaaagagaagctattttttccctccatttgtatcagaacacgtatgttccattgcttgttcatcttctctagtttcttcatagcttattccccagagaccagtgagaaagaatgtggcagcatcggtaattgtcagaatggaggcatctgtgatcttctgactgggcactgccagagccccccaggggttcatgggaaaacttgtgaagatagaaggaatgtctggtgccagtcagttaagttcttggggtttctaatgagaagtaaactaagtgaaagttgcatgtgtatttttcaaaatggcctttttctgaagaagtaaaagactgtgaaagctgtgtctgtatatataaaagagtacaattgttttgactgatgacatgtgtaacaacgaaataagtgatatttaaatctccaactgtgatctaagcaggacgaatcctcttacagagaaagcctttttcttctactgagcaaaaagttacaattatgtatataggtttagatgtaggagcttaggagaagttattttctctgcataacaaaatgaagaacaatagagctccttggggaaaccagggaggaagacagatgaaaattagagaagaaaagggaaggaggtagagagaaaaagaaaaaaagagatgatggataaaaatctcacaaaataccaatgagtactgtgcatagattttgtgtgtgtgtgtgtgtggaaaccagtgaagaggccacaattcctacatgggttaataaagcacaaaaaaaagaacctgcttgcacatgcacaaaagctgaaggcagagagtcagtgaggatgtaagtctctagggatggccagaaatcatgaggagtttattagcttctcacagttgatagaattggggagctggaaatgaagtttacttcactttctgagatgcagtaaggtccctgctggcatttcagttacttatctttgtgagcaatgttcatttatttatttaaaaactacattaaatggttgcaaggaatggcaccagacattatgatatgataacaaaaaagaaataaaagctattatgatgcttccatgtggaacttgcgattttgttcaaggcaaccataaattacaaatactggtagggattacctaccagtactaatatgtggttggaagtgagaccatgaggacaatgcagactgtatgagcctgagagagagacttatggagaagtcacatttaagcaaaagcctgcaaaatgtggagagataaaacaggagaagagtgaggaaagagctttcctgattaagaggcagtaggaaggcatgggatgctctatgaaacctgcagaggccagcggagcggagcacaggcagacagggagacggtagtgcaacatgaggtcagcaagctcaggggccccagtcttattaagtttggtgtttttgaccagacagcaatgacgagtcattgtaggatttttaagcagaggatacagaatcatcttggtggttttaaaaagatctctctagcctcagttcaaccagattggaaacatttcacctttctcagtctcctgacttcctataacaataactctagcaagttttacatgtggtttaatattttcttcatttgtcctctcaccttccaggatgcccaaaagggttctttgggaagaactgcaaaaggaaatgtaactgtgccaacaatggccattgccacaggatgtatggcgcccatatgtgtgagccagggcgccatgggaggttttgtcatctgagtaacttgcaggcacttaatttgctctgtgtgtaaagcgtgaagacacagaaaagtgcagagactactgtcagacaaaggaagagagtaaaaaatgttttctatagttttatatatatgacaaatatgttatagcctttagcctctttatagaatctagattttaatgaatgaaagaaaaatgtttctaattttgttttacatctgattaatgtttaccttaattaatgggagtggattgttaatagtctctttaagtagatgtttgatactttaccaaagttgaatacctcgggccagaacaagtttcttttatttctctgttccagaatgaagcagtctcattctctaagatttctaatattgcattttgactattaatcacatttttcaaaggatgcaagaaaacatgatcactaacaaatacttcaacccagcagtaacttttagaatttctcccagtgggataactctgaatgttctccatcccaccttgatgctatgtgcaagtatctatgagcctgcaaaaatcttcaccctgctcctctacctatttcacatcctcttctctttttgttaacagactaatgcctctgaaaatctttcctgattgaacttcagtgttttagtccatctgggctgctacaacagaataccataagccaggttgtacataatcaacaaatacttgtttctcacagtactggagactgggaagactgagatcaagacaccagatttggtatctggggagggcttacttgttggttcttagatggcatcttttcactgtgttctcatgcatggtggaagggacaaggcagttctctggggtctcttttaagatcactaattttattcatgaaagctccatcctcacaacataatcacttaatcactgctaataccatagccctgggagtcaggatttcaacatatgaattttgggaggacaaaaacattctaaccatagaaccacttaataccataaccatctcttgataacagacaccttttagagtcttatgttttattttaatgaatatccatgattctcgtctattttataaaagccatgtccataggaaagataaattataaatataccaataagagatccagtgaagtcatcatagaacactaaacctggagcatgaggaaacattaggcctagacaagcaacatagaagagaaggggaaaggtgtgggaaactatgagcaatagaggtgcagatggtatgttccagaatgttatatacctcctaggatatgccaagagaagaagattgacctagaaacaaggataatatttgtattattgttcctgtagtgtaacaagacacatcccacttttagtattaactttagaatatctaaaaaggttacatcagatgttatggcaaaaaaaaattgaatcattattgatctggtcaaaaatgtaaagggataacttttcagaaacatcaagttgaagtttttagggtttaatgatattggcatagcacatatttattcatttgcatgctgcgaggagttgaggcacaggaaaaaaatcagcaaacatgtttgttgtgttggtggtggtggtggtggttagcattttgaatatgactatctttagggaaaaatgatacattctagttctttgcaactcccttattgcttggacttgaagatttatttattaatgtcactttcctggtcttcaggaacttgagtttgcaactctatatattcgttttttagtcccaccataacaaagtaccacaaactgaatggcttaaacaacagaaatgcattgccttgtagttctgtaagctagacgtccaagatcaaggtgtccccaaccccctgaaggtgctagggacagatctgttccaggcctctctcctagtttctggtagttccttggcttgtggcaacttaacttcaatcttcgtatggtacatgtctctgcatacaaatactgcttatttataaggacagcagtcatattgaattagaggccatcctattccagtatgacctcatcttaactacttatgtctgcaatgattcaggttcaaataaatttacattctgaagtactgaaggattagaacttcaacatatgaatttttggtggacacatttcaatgcattacaaaccccacttttccgtatttccaaatatattccagtactgatatgttcttaatatacaaatggtcacatttaagcattcctctgtgtctgtgttgtcttctgaaccataattctatgtgctgaaccagaaagaatagggcatgaaggacaattttgagtgaggatttaggaatgagcaagaagaggcctacattaaggcaggcaacagcctgagagaccctgggacctggtgggtgtacgaaaggatccaaaacttggaagccatagaaaaggagatagaggatcatataagttattatctacattgggaaacctgaaaaggactctgttaactttagaggtagctctgtactatccctggcaattgggactaggatggccctacatggtggcatcataaccatcactttgaatgatctctactaatgtctctttccatccactggaaagtcaagtgttctctctaagcagctttctacagcaaagcgtatgtgggcacacaatgcaattaccttgagcctggaggccacttgaaggattttttacttggtatgtcacttggacatctgtaataggggagaaaataatgtcagagggatatttcagaaaaggaattgaattactgtaacactcctcaaagagaaaactatgggtatgttttcctgaatgcaaaggtgtgactttttcatattagaattcctgtgctgccttccatccctaacactcaatggcaaagagaaaataatgaaaggaaggcaagtaccatttgccaaagatgtggccaagataacgctgttgtcaccatgaaacctttatgttatcctacatgatgtaaaattatttctgattaccatagaatggaagggaatgaaaacaacggccagccttctcataagtgcttgtccgtcatctccatgctgcagcaggatgaatatggggcctggcaggccttagcattctttggagaatattaactataggcaccaatggagcacattgagaagcaatttctctcccggaagcaccaaagccttttaagtagttcaggcttcactgttcacgtccagttgccaaaaagcaaatgaattgcctgatttaaaagacatttgtttcctcatttttttggcagtcaggatgatcctcttgttttccccataatcaggctccacagaactacatgcctgtgcactaacaatttaaaataaacaaagcgtggttttcaggtgaccgctttgcctctatttgcttatagactgtctcgaggatgcctacggagctggctgcacttcagaatgtcagtgtgtggaggagaataccctggaatgcagtgccaaaaatggtagttgcacctgcaaatctggttaccaaggcaacagatgccagaaaggtatgctctgatgatagattttctttcttctttaataataatcctcagcctttgttcagcatcatatgattattaattagttaatccaccagtgccctcagaagatgggtaagctctattaatcccctatatgcaggtgaggaaactgagacatagggcaatagagttatttaatgcagtcttcttagcctctgctgcttcctgtccccttgttagcttgagcaagagaagaaagatcacactgcagataattatattcagaaagactaaagctagacaactgcttctttaaactgaactaatcaacccaaggcactactaacttccagaattagaattgttttctttatatctaaggattgatcattcaaacaaatgtaattcaaagatgctaatgcttaaccatagaaaaactttgaaaagttttaatatggttattggtgttttggtttttcaaatttgtatgtattacattttttataaatataaaagttattgtatagtatgattacaattacaagtaacatatataggtatatatgtgtgtgtgtgtagatgcatataccatttggaaaaaggtattccaagatgccagtattgactatctctggcttgtgcattcatgggatgctctttcctaggtacctacataactctttcacatttcaaaaagtctcatgttccttttttactgaatcttgtcagtactaccctacttaaaactgtaacttgtaagtttccaaacttttttctttttttatactgctgatcattttctaatacagcacatactctaattatgatgtcaaatatttattgcctgtcttttcctgctataagcagaaccccatgagtgaagggtatctaaaaattttgttcagccaagtatccccaaacttctgaaacagtcctgatatacagatattgctcaataaatattttcttaaatcaatacataaatttgcatttttattctttatacatttttcttgtattatcatgtattttgcattaagcacttattattatatttcagaggaaaatatcacagcatttttttctctttagtacaaccttgtgtaaaatcagaaggagataataggttcgaaaggaaaccatcatgtctttggggccacttacagaggcaggcactaggattgaaaatggtctttgacactcacgtatcctcactttctccttgcaatgccatcttcagaggatctgcagggcttttctggagctggatggacaggggagtttctctgttccaggttgtctagtggttatagaactggagagggtgaacagtgatgtccatctagatttcatggacagagtttacttaggtagctggattgtgactttctagacattagggaaaggaagttggggaaatagaatcctaacatgacactaacgggtttaatgtggtatgagagtaggtcccatgccaatttctaaacatcttcctgcttcaaatgatttttaagcccagagtcaaccccttattcattttcctcctggagaagtcatgccctggaagtcaatgtatgaggagacaatgccatataacaaacctgggtaaacttaatttattctgataacattttcttaaagcagctgctgaatatactttattggaaaatgcttctgagattcccactgtgaaggaaaatgagttgaaagtatatgtaaatcagcaaaatagagaggtcaccataatctctggaaaacatattatttttcaatcagataactttgtccaattctgatatttttgtctaaccacaaaatgaaattatgaatcagactgcagcaggtgaatggggttgctatgattggcagttgaaatcaaggcaaaaagagctctccaagagttgtgcatgatgaaaatcaggcctgttgtttttctttctcttttttaaaagagtgaagtagcccaagtgctcctagagacagacatatctttaaaaatcttaactccagacctgtgtctagattgcagatgaatagttaattaaagactggaaattgtttcaatggcactaatgaacagtattttccgcaatcagcaccaggccttatttagcttatcagcaatgacttctaagaacagaagagctggtttctacaactaacctgtgaaatagcaaaaaaaaaaaaaaaaaaaaaaaaaaaaaaaagaaagaaaaagtaaagcagccggtgtctttgccttgtttagattagtttgtagcctagagtattttgcacactcactgcaggcagacctcagaatgtagaggactctggcccagctggccccttgacactatacaacccctggatcatgataagaaagaaagattttttttagaagagttccacatcagatgaacttcgaattttgaacccggtgaatctttaagagcagattaattggcctgaaagatgctgagtacctagtattgtagagtaaattcgggtgtagtggctgagcgcaccagtttcagaggccaggagatctgggttcaagctttgtgatatagagtaagtcacttaacttgtgggagcctctgtttctcatataaaatggaaataaatttgcttatgccatagggttctcttttggaagtatgagctaatttacataaagtgcttaacagagttagtaatcaacagatcgggtatgaatatcccagaaaatattataattctgtaggacaagaagatacttcacagcccaacttgatttgatgtaacttttcataagtgttatatttttaagaaagttccacctttttccttgggttaaaaaaaaatgctttccaccgggtttctaattccagtggtttatatggaagaacacacactgaaacctctcactgagccctcagtggtccctgcagcatcaactgtcctttgctagttcaaagaacagtcaacaaagcagatcactctttctcttctcccaccttatgcactgtacactctcataaagtacacagttcataaacctctggtgtgattattttagctcacaaaagaagcagtcttagagaacaggatttaggcaacaatttgagggcaacttcctgagtgccacgcctcctgagcttcctttacaaattacatctcattttcaggttttgttctgtgcaactgctgctaaagatatatatcaaaattgcttccattgttactgtctgaaaaaccacattttcagcaaaaagccaacctctgtatctgtgttttcaaagtgacaagatatagtatcatgttgatttcttcagggaatacttttggaagtgttataaatccttggaggctactaggatatttctttctttgcagctctgtcacacacacacacacacacacacacacacacttttccaacttggttaggcaacagtagaaatcttggaccattttgagacttcttacaagtctacgtttctttctctctctctctttttattttatgtctgcccagatggcctctggggaccagagggctggttctcctctgcaccctgtgaaaatggaggtcagtgcaacaaaaaaactggaaattgtgactgcactcctgattacacaagaaaatcctgtaccatatgtaagtcataaacctagacgaaataaccaacaaagttaataaaactgttaactttaaaaatgcttttttttcctgctatacaagatattgctatgttaggatgcatgttcccaccatttattgttgtgtaacaaactaccccaatactttgtggcttaaaacaatgatttaatatttcccttaattctatggtttgatgaggcgattatactgctggtgtcccctggggtcactcatgtgactgcttgggctggtagatatttgagaacagactgggcatggctgggctgctcaaccagggaacttgccctttcctttacaaaacatttccacaaggttaacttggactttcctatagcgtgacagttttaagacaataaagaaggagcattccaaaagtgtgcaagcaaaagctatgtgaggtggaaaagccttgcctcagaagccacacattgtcactttcaccacattctattggttaaagcaagtcatgggcaagccaagttcaggggaaggagaaagagattctaccttctgaagagaagagtagcagaagcttattgcaaaagaccttcaagttgagagatatggttgcagccatttttggaagcaatctaccatagtatgctattcaaatttatactgaaaggcactttaagaacctattagactagaattatcattcttgtcagatgggagcagattagagagtgatagaaagtgattagctacatcgaactagtttcaaggagccagtagaactactatcccgctgtacccttttctggttgtgattatttgtaagttgtgctaaccctgcctgtatcaccttctctactccattgacaatgaaacacagtgacttgagaatgtgaggaaaactatgggctggatagtaattatacttttttttttacattactatttatttgtctaataaagattagcaaacatttgtgattatcattttatgaagtgtgaacagtgatttgaattagctttcagtgcttaggcctttccattaaccaacaaatatataaaatcagaaacaccatatataaaatgtaagcagatagtatttagcactgagctaatcatatgatcactttgggaaatattgctgcccctagggagaaccctcaggcaaaagttacaggactagatctttgatgactttctgtatatagcaagatactttattttagaaccattattctggcacttttgacaagcatttcaaacagtagaatagtttactggagaagcagttggctatccctaacctacttgtttgcttcaaaaaaaaaaaaatacctcttaaaggtaagaatttacatattcaaaaggtagttacttgctatttccacagtgaagtgacattttctcttgtctaactcaactttaatggaataattattaagcagatagtgataaagtttacactgttccagttgtcaagtgatataaatagaccatttaagaacaagtgaagaaaaagataaactcctcattctttaagatattaattttcatagttatgttacagttctttccttttatgacttcaaatcccagaaaaacatttcatgatagtcctgagagatttgttagtgataagtaatactatttacattttattggcaacttgataatgatacatgtattgaattcaatatgcaaaaatattccctgactcctagtccagtccaattttagtattacatgctattatctgattttacacacacagacacaaacacaaattatataatcaccataataagatatttaggaaaatgaatggagccaaatgatagaattcattaaaaatgcttcacgcgtacctcacaaaaaatgtgtgtggcattttaaaagtggcatgtatttgaagaaaagcatacaacatttctctaaatatcccgttatggtgctcacagaattttaaaacctagttactctgcataatgaactgtaaaaatactcataggctatataagtaatatattttagaggcaggaaagaccaaaaagctacgtttaaatatattggctttttaataaatcctgttgtttggaagttataaatacaaatacttggggaaaatctttttaaatcttttatttcactgtatttaaaaaatcctctggattatggtagattggactttgttgctgttttttgtttttgcttcctaaacagtatgtgtatggtgtggcatggccatgggggtggaatcacaggcactctcacacccttgataagaatgcatcatctatgtgaagggcagttaaatcttacatgtcaggccttttagcaaataatcagagaagggctcccagccttttctttatcccagcattatttataacaacaaaaaaagcttaaagtagaaacaacctaaatacccactagaaggagaatgattgagcaaattatacagcatatcactggactcttctgaggccattaagtttcatgttttagaagaatatgtcatgtcagaaaaattgacattgagttgatgttaaaagctatatgtacagaatgattcaaatttgtaagaacatgtagctatgtatgtatatgggaaattgtagaagaaaggacagcagtttttaaacagtgtccatctctagatggtgggactatgggtgaatatttttctcctttatacatttctgtctttttcatatttactagtttactactttttccttaggaatcagagaaaaaaatggcatcatctttagaccaattggtgactaaatatccaagaaaaatagttatctattcttaaagtattctctgttggcctaaactgttcccataatagtgaagatatttttttccttcagtcatatttaacttattgctattttaattttagaccattttctcctttttctcctattgtgaatattaaccatagctcatcagcactaccaaaactcttgaaaaataaacacctaaaagaacatagtaacgtttcctcctaatattttatttccctttcgtcagaaacctcattttctattccttagtcatttagtgattacttttatttttcaggagcacttacaaaacaggccccttcactattaaaggagagaaaatcagaaaggagaaaagacatgggaagggagatactaattccaaatacatccatgcttcaaatattatttgatcaaacttcataaaaaccataatgaacacaggtgtaagccttcctcagtgctaagctggcaaatgtttaacaggctctgtgaaagataaaagcactgagttttagtgtttgccgatttccaaggtataatactcctaccgtggtgatttcaagcaatcaatgtgatttcaaatggcttgcaaaattcctgaaaatgtagcagttggctttcccgagccggtagttatggctccagcataccattggctggcaaatatttgtattctgaacacaccaaacaatttcttaacttttactttctctattgatatgaagaaattattacttttcaggtatcagttttattttactgtttctaaacagataacccgattgacctttttggttgaattaaccaataaatagttccaaccaacaaaaatttgctatttagataggctattttattttcaagacaaaaatcaattgtttggctaaatggattcaagattcaaaaaacagacaaaagaaggtattgagttgctttatgtgtaaacacagtctcctcagtcttttactctagaattcatatagctggggttttgactcaatctagagaatcctttaacaacctctaagctgttttccaacttcctctaccacacccagcacgaatgagggctggtatttccttagtgacacacttttgttaaaaaaaaaaaaaaaaaaagaagaagaagaagaagaaaaagaaaagacagttaccagttatccaaggtagaagtaaaagagtatgtgtaaagcaaggcaaaacagcaaacaagttttaaaaattagaaaaacaattaaaatctgaaatattaccaaacataaagagctaaggtacaacaagatacttcctcctctctgaaacaattgtaaatcagatttttaaagttgctgtaaaataaattgtatttaaataatacatctcctatcctttcccacagtgagatgcatttcccttaccaatctggctctcagcaggcggtccagcccgatgaagtatcagcaaaatgtcagctcccacagagaagtgcgacagaggcaacagtgcagcagtgacaggcctttcaaaaagctattgtgcaaattcagttttaaaatagggatgtagttgaggactgatgggtatttcattaccaatgcgttcatctcccccatcgtccaagagaatgagagggggtcatggtgcagctgatataaagccattaagttgagtagcggttgatttggtctgtagaagatttgtcttcctatctgtatttttgaaaagttaatattcaaattagctgtcatttttagtacatacctgctaaaggggggccaagaattgttctgttttctacttgatcaccttccagtgtctcaattagatcattaaaaacaaagttaatcatgtcattactttataaacctcattgagctactgatactgttcataatgaagttcgtagcactaaagacccatcatcaacctgtctctagccagcttttgaccatgcttacgtataccctacatattttagtcattcccccaacatcatgtacatttaaaacatggtgccattgttcattgctctttcctgtaatacatgttttcttcttccatttttattccctcaagcatttattcctcaagcatttttattttccagtatatgtaaacaaaatactagagcccttctttccatagcagcaccaatcatattgtattataattagttgcctgctattaagactgcttatcattaatttttgtacaccccacttttcaatatacaaggggtactcaataaagatttgctagattcaattaaagaacatttttgacaacttaaaattccatcgaaataatttactgagtaaaaaaaaaaaaaacttgcaaaacacagcgtttatgatactgaaaaatacccagtaaccaatactcgttaaactggattgaattactcagccttttaatatagcaagaggaaatcaagaaagctgtagcaccacagctttattggtctgtactccatttctgaaaacacttttcatgagaagatttttcaatggattagaagactaacatcagacaatgatgattccttagcttcatctcaagagtccagattatttccttctatactcactttcaatgtatgcaatcattccttttaaatacaacagagttaccttagaaaagtaaacaaatgtaggctggacgccgtggctcacacctgtaatcccagcactttgggaagccgaggcgggaggatcacttgaggtcgggagttcaagaccagcctggccaaccccatctctactgaaaatacaaaaattagcctggagtggtggcacacgcctgtaatcccagctactcaggaggctgaggcaggagaatcacttgaacccgggaggcagaggttgcagtgagctgagattgcgccattgcactccagcctgggcgacaa

SEQ ID NO: 1608 - DNA, 577003 bp, Homo sapiens
actctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtgtgagtacccgcgccccctgctatgcccgctgcaggggaccactgtccctggccccctggggcgtgctccgcgctcgcgcccttgggcccccgcgcgcgtgcacacgtggtggcttttatttcttcgcacgtgttcgtggtcttccttctggagcctctcccctcccccagccccacttctctcatctctacagcttgaaccttttccccgaggacacccaatgaactgcccggtagcttcaggctcccggggcgagagccaggcagacgcgggacttaggctgcgcggataattgggagcaattaggtcccaagatacgtaaacttcaaccgaacggggcgcccgggagctagggaatgcaaagggaggacaggcgcccgtgtgaggcttgagagtatactggagaggttaggaggtgatggcggggtaggacggggagaagtgagggggcatcgagggctaggtcctcagtcctaggggcggagtaggggaagctgctacttggagagagctgctaggttttaagcgcgcccggaaacacgcctcgccaccacccagccaccaccaacggaaaatctgtcagtgcatgtagcccttcctgccacggagaaggtggccaaggtctagaggaggccagcaggccaggcgaagcaacgctcccgcgctgcagggggcggggaggcagcggggaacctggggcgcaggaacgcgggcggaggtgcgatagcagaagcgcaaatgggtcgcctctgacagagatcgggcagtgggttaagtccccgtttgtggcgcggagtcaaagagtgtgtgtgtgtgtgtgtgtgtgtgtgtgtgtgtgtagtaagccttctccatctagcagagaatgcttaatgagaaaatgattggaagcaaatgtttatttttcccttaggcatttaaaacctttcagtggctttaaagtttactactgtttttcccacaaagtccattcattcagtctcctattagagttacgtttatctgggcattttaaggttgtttttataatgttacctcgtgtctaattctttttttcttcctcttctccttttgcttcctctttttttagtattattatttctgcttcttttttgttaagatgaaatataaagacatcaaccttagaagaccagtagagaaagttgcagatactcgctgatacattccttgtttcctagtaaaataagttttgagcacacggactaggtttcttttagaaataagttatgtcatccatacatagctctctcctgggatgcagaattagcatcaacaccagaaacgtgttttgaaataacatggaagaagggctggttttgtaactaggtgaacctggaattcaaccacataggagtcaggaaattggtggagtctacaatctgtggggctctggtgtctggaaaattttacagtcccagattgacgtgaacatgtagcattaggcagaatattccagccaactttccgttttacaatgcacacaaggagaacggttgtgttgcatcatcattacatcaaaaagtataacttttatgtaaaattcacatttatttaaatgtggttaggataatgatagagaaatgcaactgacacttttctcgttaatctcctctgacctgatatgtaattaaacatattacttaataagcctggtaaattattttgacctgtcagaatatactaaaataatttagcaattataatgctcaatttggtagcaaatatatatactgtataggttatgattttttctttacaacagtatgctcaaaacatttctagcctttcttttttttatattatgcattgtatattcagagagagttaaagaaagccttggttggtgcacatactttgcatctcctaacttgttcttgaacatgaatgagaacttgcaacacaacattttcttttccatgtgttggtgttaacaggtttgtatgggcttacagaattttaaaacattaataaatgatttttccaaaggttcaaggttggatacttctctgtctaccaggctttatcagtctagcagtatctttagtagtagacaggaaataaattgtgtacttaatagatgtagcaaatgtgaagttttgattatacattttagagtctgaaactgcaatgcctcagcaattagataggggtgctatatccacattagcacaaagagggaatggatagtatcatcttttgggaggattgtgcacaactaagcagaccctgaggaaagaggccatctttggcagttgctgcttgtgattttaaatgagctttagaatagccagactttacacattacattcatttatcgaagttgctttatgctgtaagtttaactagaccccaataaaataatttcgagagaggtgtaactaactaattccctgccagcttgggaatccccaaatcttattttaataacagtatttgtagcatattaaggttcttgccaagaacaagtgcaccgtgattaatgaggtacttcaggggtgaatttacttggtcaaccagtgttttcactgccaagaaacaagaaaagcatgtttaaagttatgcttgaggtaaatataaatttctattatttatgcaaaaataattattataatggtattttagggttataaaatgtcttttcaagagtacatatcctagcctattgataggatggctggacagagcaagggatgacctacttcaaatattttcccttaaactttataaattagtggagattaggagatccttgcccttactattctttaggatttacctgacagccatatttcctatcttcaacttttcttcattttattagtgtgctattcaaacatgaggtggctcatttccctgaatgttgtttgtccctttttaattcctccttgtttaaggaaaattttgaagaataatgagggtagtagggggacacaggatgaggcttcatatataaatttgcgttgatgcagcaaatgtggttctgagaagttacatgggaaacggtgttgcagatacatgtaattgatcactttgcctaatgtatctttgcctgacttaatgctatggatgtgaattatagatattaaacaaggagacaagaagaagtcacccaagctaggagctctgaagtcatcctttttctcatacttactccttctggtcaggcaaaaggtcattaactattgtttgtttactttataggtatttttcaaatacattcccttttcttctttaccacttctattccattctgtttcttacctctccattagatgatttgtaatattctcctgcctgatcatctggtttctgttctcagccttctctctgctctaacatcatagtattgttcgtaaaatgcaaatcttatcatatcatccccttgcctaaaatatttccatgactcttatcatctactccttcatctatgtatccatctacaattattagagtgtgtaatatgtgctaattcccaaattaacaaggcaaaggcctccactctggaggaaggaaaagacgccagcaagggactactacaagcctgtgaacaagtgtgaaacaatgttattggtgtgcttagagagagaggttacaaagtgacatgagaaaagaaaaagaagtgaagcccgggcagaaaagtcagcacaggcttcaaaggggaagtgaggtgtaagctgagtttccacaaatgagtagttaattttcaggtgggcatagcaggagggaatgaacaatcttgacagagaaaacagcttgagtaaagatatggagttgtgaatcagcacagtaattctaggtactgttaagtattttcagggtgaggaaagccacaagaaagggtggtagagcaaaaggcaaatcaccaatctgttggatagattctgatgctgaccatagaatcttgtatttatcctgtaggcagtagtggtcattgaatggtgataatcaggggaatgatataatcagatataaattttggaaagatctgcctttcattagttcagcaaataaattggagtgcaaaatggagtcaatatggcctataaggagatgataccaattgtgagaattttccattcattgttgcattcatttattcataaacttattctgtgaaatgtctgttgactatcgactatatgctgtggatcatactagaaaggtgagagatgattgcctaaggaactaaggcagtaactgtggagatgagaaggaggagtttaaccaaagaaatgttaaggagataaaatttgcagattgttttcaccagtctgacatgtggtatgaggaagatgattctgacttggttgatttgaggaatggaagtgccattcactaatatatgggacaaagagtgaagggcacatattctggtgaatataatgggttcggatttgaacatgttgggctttttgagtcattcaggtggagattttaagtggtgggaacatagcagtgaacaaggcacagtctatttccaaccacgttagatcagcaaccagaactgtttctggcacatagataacactcaataaaatatttttgaatgaatggaatcatttacaaatctggagtttaatctaaatatgtaaccagatatttagctttgaaagcctctgtcagttttgtggtaattaaagcaataagtagaaaaaatgagatagtccaaagaatatatagagtgagtgagggcatagtggaggctagagactggggaacaccaacaccaagcagtggatgaaaaagtaagagccaatggaagaacctgggaaaagctttacagcaacccaaaggccgagggaaagcctgggagatcttattttcatgaaagcaaaggaagatgcatacggaaaaaaggttatggccagcagtttccaatgctgcagaaaggactagaaaagttaggtaagatttcattggatttcttatgaaggaggccactggtggcctttgctgctgcagcttcagtggagtgctaagagtcataaatatgattcaagtggactgaggagtggttaagacttgggaaaatggacccagtagtgtaggttagactccagattccttggaagagttcacacaagaccctcagggcatagactactatatagctactcccctctaatatgcactctaagccccacccttactgcactgctccaccctgtgtctcaccaccatgtgtttgctcatgctgttctcttggcttctccccacatcttgcacccttgctattaaactcctaatgtttcttcaaagtacagttcaaagatcacttcctcttgggcatatttccaaacagttcccttccctctgccaggatgagttaggtgccccttctttcaggttccatggcactctaccaatgtcattataatggtgcttcccccattgtactgtcatcgtgggctacttggtctgtctctcccacatgacagcaagcttccatacagtgaaatttctacttatttctaaatattaagtgcctaacaaggtgccttgtgtctagtagaccctccataaatgcatgcttaactgagtaagtaaataatttttcttataagccttccacagaggagcttcagggtgagccgaagctgaaagaactaccaagtcttttcagttttcttagacgtaagatactgacgattcatttaaaagaaaaaagatatgggactagaagtaggagattagtgctttgcttgtagctttgccactaattaattctgtaagtcatttcacacatctgggtctccaaatcttcatctgtgatatgggcacaatcgtgtctgtgatccgagatggtggaggatactgtagagagtctaaaatgctatcattaaagagaaagagtatttggaataagaagcaatctgatccttttatcatttcctttcctcttctctgagcttgagggttgcctcttaactagttgctttaacttaattcctaaatccccaaggtctctgtgctacatagtagccaaagttatctttctttctttctttttgttagtttgagatggagcctcactccgttgcccaggctggagtgcagtggtgtgatctcagctcactccaacctcagcttcccaagttcaagcgattttgctgcctcagcctcctgagtagctgggattacagacgtgcgccaccatacctggctaattgtttttgtatttttagtagagatggggtttcgctatgttggccaggctggtctcattctcctgacctcaagtggtctgcccacctcagcctcccaaagtgctgggattacaggcatgagccaccacacctggcccaaagtgatcttcctaaagacttaacagaacacatcactcctcctctgcttggaggaggatctgtttattgcttgtctctcccctcaaccccaattctttaaaggcaggggtttctgtcttattattatatcaccagcacccagaacactgcctgtcacataaaagatgctccatgcatacatactgattcatttactgacaccccagatctccaaaatacactattagttcccttgtggcagatggaattttactctgttggccattctatgtgtcagactcaattagacctaatgaattactttactacctacatatatattctattctgaattaagtttatgtctgtagagactgatgtttacatattctttttgctcctgcattcctttaaaaaatcactgatttctcttaagtctacagaggccttgtagaagttatactgctttatactgtgctgatatataaaatgtttcatactcttctaatcagtctttagaaatctaaacaatgctattgtacttgaagaccatattacaattagaaatgttgaaaagtgttacaatattagtactgggaatatgatagcctaaaaggaaagaaatgaaaagggtatttcaaaatgaaacgaaggactgatacaaaaaaacactataaacaagaaagatagccagcagccttctgaaaattgcttgcaaagaagtagcgccagttttaatttttaattgcaaatggctattttggcagatgaaaatgccagcagagcatgttttatcctagcccaatggtgtgaaactacttgaagcccaattgttgaacagtcacagctcatagttatctttaatatgtatgtgttttcattttaatttcctttttcttcagccatttatgagtgcgttatttgaagttttatttggttgcaacctgggagaaagattggccacacatctgcactttttttcataattaaagaaattctttgatggtctcagagtttcaggtgatcttttaatcctttgcaatcagtgtgtctgaagagtgagcttcccaaatgttattaaagtcatcaatttctaaacttaaaaatagcttgaagtttttcatcatatacatttgtgtattgtgcatatatatttcatactcatacaaatacacatgcaacataagcacatacatactgttatcttttagcagagaatttgtgttagtgtaaatatttctatttccctttgttttgatcctctaaaagtaaaaaacacttgaataaaatgcaatttagaaataaaaagaacattaaatttactcttgataatatagagcttatctcttaatttgaaagataattaaatttttacatgatgaagagatatacaccttttacaaactcagtcatagtggtcattgttctcatttattgtacctgtgaggtaattctagaatccctattccttcttcagtcagtggctggataatctaattataatgttataatccatcatttctctttttgaacagtcaatttagtttaacatttgcttaacagccattatgtatgccaggtaatgtgctagatgctggtggttcaaagaaaggaacgatgtggacctgacctcaaagaaatccattggagaatatgacagatttagatttaatgatcaactttacttttcctatacaggtaccagtttcttaatctataaaatatcagtaccagtttcttaatctataaaatagaaataaaatattacttcaaggtgttatatgtatagtatatgtgtacataatgtttaatatatacatattaacagttagcatggtggctctcgctgaaactagagggaaaaatagagacaatgtgctggaaggctgtatttatatgataaaggtctaggattttatcctatatgtgatgggcaatctttgaggaagataggatttaggcaaataataatgtcattggatttccattttagattggtgattctactagctctatcagtgatggcttgagggagacaaaactggaggtagaggataaattttaaaactgttgttccaacttaagcaagagataattaggacttagactggggcagtggtaggaaggatgggggaaaggtgtgacaatagagttgaaatgtattagtgaatgattgaatgtggaagattaagagatacagatttgttatttccagattattggattgggtgcttgggtaaatagtggtgctattaactgaaatcaatagaggtggaacaacaggttggcgaattgcaggggtgataaaatgagtttagctttggaaatgctgagcttttggtgcctgtgggaattccaactataaatgtacagcagctcttggatgatgatttaaaagacataaaatacagacaggagttataatcacgaggaaggcaaataaagataaagggtaggaggtcaaggatggaaatctggagaataccaacatttaattgataagcaaaggaaacaaggaatgaaatggagtagacaggaggctataaggaaacactagacaaaaagatggtcagggttgtggaaacaaagggtattgagagagtttcaaaaaaaaataaaagtaaccaattctgaaatgtagagagtggtttagtaagataaagatccatcagaaattaccattggatctggcaatgtggaattcttcagtgatgttataaactcatcagtgttaaccttcagtgaagcagtgagggcagaggcagattgctgttagctgagaaatgaatcagaagtgaggagaggaaacagcatatttaggccatatgttcacttagtttggcaagaataaaagggagattggacactagctacaaggaaatacaaggctaaaaggaaaatcaagagagaataaagttatagagaagaagtttttttatcacaaataatagtcattttaatgattatgtgctggacattgttctaaattctttatgcacattaattcttttattcctccgaataaccctaataagtaatattagtgttatcatcttcctttcagcaaaccagaataccaaagtagggggaggtttagtaacctgtccaaagtcagcttctgagttaatggcagaacagggctttgaaccaaggcaggttggctgagagccacacatgcttagccactatattttatttcctttactttgcctgttagagttttagattttttctttctttctttctttttttttttttttttgagacggagtctcactctattgcccaggctggagttcggtggcgcgatccccgctcactgcaagctccgcctcctgggttcacaccattctcccgcctcagcctcccaagtagcagggactacaggcgcccgcgaccacccctggctaattttgtttttgtatttttagtagagacggggtttcaccgtgttagccaggatggtctccatctcctgacctcgtgatccgcccgcctcagcctcccaaagtgctgggattacaggcgtgagccaccgcgcctggccagtttttttttctttttttaaaaaatcaacttttattttagagacgggggtacttgtgcaggtttgttacatgggtatattgcatccaggtagtgagcatagtacccaattgttagtttttcaacccatggctcttctcttcctcccgcttctagtagtcccaagtgtatattgttcccatgtttacatctttatgtgcttagtatttatcttcacacttctaagtgagaatatgtggtacttggttttcttttcttacattaattcacttaggattatcgcttccagctacatccatgttgcggcaaaggacatgatttcattcttttttatggctgcatagaattctatggtgtatatgtaccattttttttttttatccaaaccaccattgatgggcacctaggttgattccatgtccttgctattgtgagtagcatggcaatgaacatatgagtgtgtgtgtctttttggtatgatgatctatttcctttgggtatatacccagtaatgggattgctgggtgaaatggtagttctgttttaatttatttgagaaatctccaaattgctttccacagtgactcaactaatttacattcccactaacagtgtataggtggtcccttttctctgcagtctcaccagcatctgttgttttttggctttttaataataatcattctgatggtatgaggtggtatctcattgtggttttgatttgaacttctctgaggattagtgatgatgagcattttttcatatgcttgggggccactcgtatgtcttcttttgagaagtgtctgttcatgttctttgcccactttttaatggggttgttttttgcttgttgatttgtttaagttcatagacttcggatattagagctttgtcagatgcatagattgtgaatattttctcccattttgtaagttgtctgtttataaatcggagacgacacaaataaatggaaaaacattccatgctcatggattggaagaatcaatattgttaacatggccacactgcccaaagcaatttacagattcaatgttattcctgtcaaactacaatgccattcttcacagaattagataaaactattctaacattcatatggaaccaaaaaagaacccgaatagccaaagcaatcctaagcaaaaagaacaaagctggaggcatcactatctgacttcaaactataaggctataccaaacaaaacagtgtggtactcatacaaaaacagacacatagatcaatggaacagaatagaaaattcagaaataaagtggcacacttacgatctgatcttcaataaggccaacaaaaacaagtaatggggagagggctccccagttcaataaatggtgctgggataactggctagccatatgcagaagaattaaactggacccctacctttcaccatatacaaaaattatctcaagatggattaaagatttaaatataagacctcaaactagaaaaatcctagaagagaacctaagaaatagttttctcaacatcagccttggcaaagaatttttgactaagtccccaaaagcaactgaagcaaaaccaagaattgacaagtgggacctaattaaactaaagagcttaggctgctataatcttgattgtggatggtacgtgtgggcccagggctcctcatatcagatgggtagagtaattataaaaactactttggggtctagtatagctctcagcaaaatagtgtatgcacaataaatgtttgttgaataaatgaattatagttaaaatgccttattacctagaatcaaggaattacttttaactttgtactaagcatgtttgtttctctgccttcacattctaaccagcttaagttctaatttttctttaaatatttttctgacgtgctagcttattttcttatcattatgcacctcccatagcctttattatttggattatgtattttattccttaattacattattacattgtattctaatttggtttttatctaattctttgcaaatagtttgtgtatgtaaagaaaccaaagtaccctctttttttgtatcctatatagggcattatgcccaggttttcattcttttggttttgtttgtttgcttttgtttgtttgtttgttttagagacagagagtcactctgttgcccaggctggagtgcagtggtgtgatttcggctcactgcaacctccacctcccaggttcaagcaattctcctgcctcagcctcccgagtagctgggattataggctcccgccaccacgcctggctaatatttttgtatttttagtagagatggggttttgttatgttgaccaggctggtctcgaactcctgacctcaggtgatccacctgcctcagcctcccaaagtgctgggattacaggcgtgagccactgcgcccggccttcattctttatttttaatcaaaattcacctagcttattaccactagtggaactatttgaatgttttaactttatatttccaaacaggaatttccttaaattctactagttcgtattgcgtagcaacttatattgattatctgaataataatttgttcccctcacccttttttttttttttgagacagagtctctgtcacccaggctagagtgcagttgtacaatcacagctcactgcagcctccatcacccacactcaagcaattctcccacctcagcctcttgagtagctgagaccacaggcacagaccaccatgcccagctaattttttttttattatttgtagagacagggtctcactatgttgctcaggctggttttgaactcctgggctcaagcaatcctcccgccttggcctcacaaagtgctgggattataggaatgagctgctgtgcttggccctgaataataatttcttaatgtaatttcctataaacattaaattcccaatttatacagtcatcatggaatacctaagattcactacaaaatagcatcattgctttgtttaagtctcataatggctgaatatagaacatgtttactccaaactgattttttgatttttttcttctctttaaaataataaatactcattttctttacactagtgtgaatacatttcattcagcttccatgcttttctctctccccttccacatttacattttccctggatgtttcttactttccctttccccttggtcttattgtatttttcttccagttaaattgctcctagttttttttttttttttttttttttcctttctctctgtgcttctacctttctggaatggtgtttctccccatttctttgtacaaaatgttgctttcttttcctctgaaagctgtctgttcttaagagatgcattgaatttctaattacatgctctaagagtgtactgcctacgtagactgggtacctaatttacatattgctctatggtaattaatagagacttctagaaaatgtggattttagaaatataaggggagaaccctatttttcttagggttttagttatgctcaaatttcttagaaaataaggagtgaagccttaaaatcgctgaagttttctaatatctatatattatttctgaaatttgggaatagtcagatattcagtgaataattttaaaagtttttaccttctgttttggaagttgactactttgaaagttgactatatactttggaagtatatagttaagaaataaattagaaattagtttttatgccatgtggaattattatataaaaatgcacaataaagaagtccaaatatatttgtaacatagttaaatatcagttaaaaatatttaccccagtggctgttataatcattaggagtttctttactcagtgagccaagaatagatctataatctggcatcacagagctgtactttttctgttttattgagaggttaaagcatggtctcaaaatgcaaatgtatcataggagtacataggagatagaaaaccacctgcatttttttctggttgaaaatgtttccaaagcatagaccttgtgaaagcgattctcataaccttttctagaatgaaaaacaagtttaaggcttctatttctctaaacctgttttctctcacacctgaatgaatctaggaggattgaatggagttgagaatttagattcttctccccgtgttttgagtcattggctacatttctcagctttctggtttgtaaaattaggatataattcttcaatgtttgtttaataacctgacctcttgctaagtgtaagaccctagagtaggaactatagggcttaacataaataagacatagcatattccctcaagaaattttcatctagaaagatattcatttactgtttactgagcctcaaaaaccatctctctgaattgacttaggataaaagcaaagtttggcctttctccagtggcatttagctattgctccttttgaagggatttacaaggtaaactccaggatcaccatgtacagaactgctgattgccagttctcttgaccccttgggaaactttggagctcggcgttcagctgcctgtgcaagtgggcgttctgctcagggcattcccacactgagaccaacacaggagttcccactcatcatagtaatttctaaacagtagtaattaaactagttaaactaaatgttctagttaataaaacattctgagtatgtttaatttgctccaaagtattttaaaaaataagaaagaaaccaatgctgtttcataatactttgtttggagatgttatttttttctccctaaatgggttaagaacaacagtataaaccaaaagttgtgtttttttttaacaaaatgaagtgtctgtttattttcagtatacactttaagcttctaatattgttcacttaattctattacatgaaaggaaaatattatacctagccttccaagaacacaatatgcagtggacactcaaatattgaatgagtgagtgcccactgcatattgtgttattggaacactttggaaacacttcttccatttgttcaactttctccagtcatgtggaaaatggcttttttcttcaactaagagtggtacttcccagtgcagctaaggtcaaaaagtgttagaaatgtgtgttcattgcaatctctaaagtgctttttatccatcttttaaagactacatacttcaaatggatttcagacctagatcagcagtcagattaaagaattgcaaagtgagattaaactagttttaaatttatcatgcctgatgataaaattctatagttctgttttggtatgtcaaatggaaaaggcagagaaattgattggcaatccaaatgacatttgggaactcacttagaaccttcaagataggatcctgaacccaaggagcacctactcttattcatctagtccttgacatagaagaaattacagtttgttttggggaaacagttttaacaagctcgaacattcaaatttgccttcaagtatttttctctagaagaaacccgggtaagttcccttagcttcagatccatcaaggaataaacaaaatgagatgggttaggatcttcccaaacgaagcagctaccctagttatgtaggtcctactttagttgtgcactgagatcgtcctgcaatccttccaaaggtaggacaggaagcataataggaaagaaaactatgtagtcatcatatttgtgccaatcgtgtggactcctatacagtagttcaggctaccagtttggttgggccatgcttcagtagcccattattcctttcactcagtagaatggctccagttattcctctgaaattggaagttagagtttcacagtatctctagcaggaaagattgccttacatggttccagatcttttacatctagtattggacttgatgagctactttacaattacatttcctaaactagttgggtcatgctgctgagagctgttttccagagctagtgggtatggagttttcttccaggcttcagggcaggaagtggataataaaaatacatttatagatggcgctaagtgaggtagcctagacaaccataaataagaataatcaaaccatcacgttgtactggagaagacagaatattcctctaattgaagggtagctatcataatttaaaattgtcatcatgaaggattgtactttttttctccaaaacaggttaaaggcaaatacctattttttttttggtttcttgttgattcaaattccctttccacactgcaatcttagtatagatttctggagcacatgataatatatttaaaagagctattcacaataaatctgttatgtttttgtacttgtttcaagggtgacatgtaaagttagtggttgctctacagtaagcatctggtagtggagcggcagtgcagcatgacaaggacctggactgcagtgtcagccctgggaatgtgcagaaacggagaataggagaaaattcaaagggaggactggagttcttagctctccattggcttctggttggcaaaagagatgaaagaatcaaaatgttcttggttccaagcaagtgtgactgtgaccacgcagaagttactcaattctgttttaggtaaagaacaagcacaagtagacatgtggcctgtttgggctttgggaaagacaggggatcatcagttaccaatgtagagtgatggagaagaaataaggtccttggagaagagtgtatggaaaaagatttagggaatactggcatcttgggaaatgagaagagaaagatttgcaaaagggacaaagaagagaaaaactaggaaaatacaacatccacaggaagactgtctctcaaaggattgcaatgggataaaagtattacaaagaaaagaagtgaaaatgtgtgatgatgtagaaagccaggatagaaggcgaggggccagaacctagaagaaaactttgccatctaggagtggacagcatgtgcagtgccatgtgttaggaggacatccaatttcacaggaaacatgatgtcctggaaaaaaaggccagaacaacccagcaactaggtggtgtgcagacatagcaatcagtttttcaaaagggaccatgcagggtgaggggtgtccctgaaagtatcactgtataactaggatggggactccagaagagagggtgatatttagagagcctcgaatgaaaccagggatatctggttggaaagcaatcttgcagtctctaagagagatgctgataagtgcaaagcagttctaaagagcttgagataatgcaccaaacggtgcttgcaggggagaagggagacagattagggtgcataattgataaataaatgggtaaagagagagggagaatggtagattaggaatcaacaaagtaaagctaaacttttatttctccaagcagctggaggtctgtacaaataaaaaagcctcaggaacccccttccctgagaagtggaaagattaaagtaattgagaataacaagatcctggagttatggtaaataaaagtttaggttggttaaaaaaaaagtttggaatggcaacattgggagctatgataaggcaacattaagagataaataacgcgatgtcttgacaactgcaaaggccctgatagagttcaggcatgatcacgtagaaggctacctggtgtgtgagattgtgagaatttctctaacagtagtgtgcagggtaaattttaaaaagcagatggagccctaacccaaggctggcaactttgtagccaaagtaaagggaatgagaaattttctagaagtcacacacactgaacatgtgtgaccttgaccttgggcaaatcgtaaacccctccaagcaccaaccatctgataaatgtggaaataaggagacaaagtgttaaagctccttatataattgctgggcaaaaaaaaaaaaagtaatttttatactttgtaaccatatatagtctatagcctcttcagaggaggaaatgctgcaataatagacacatgtgaaaaaacatgtgttcaacgaataaataagtgaataagtgaattagcataacacttatttaacaacaacattgtatttggtgccaagattatagagccagatatttcctgttgtgtgtacaagttctgtgagcttgaacaaaaagatttttcttcagaaatcaagccatattttataatctctttatttttgagtgtatagataaaaacacactcttaaagcaggaactactgctttgacacatttaagtaataggattagagagctggaaggacctttggtgaccaactctagtgctatcttttttagatgggaaaacagcctgcaaaaatgttaagtagcttcctcaggatcaagtactattggagccagcattggtggtcaatcctgtatagaaatgacttcagttgtagatctgtgaccttccttacttaccttcctctaccaaaggtactctataattcttaataaatgaatattgacattcattttaaatactattgtttgttcaactgttccatgaagaatattctttaaataagcattgtagtgctaacagggaaaatatttttcccttttataaacttctaatagctggcaaaagatagtaatttccatgacttttctttcttctaaggaagttaaattctgaagacggtgtttttcttggagttaaaccatatattgacttgttctttaaaggatctaataagtgaatagatcaagtaagaaacaaattagtatttagcccattcagttgcagcactgtggtttctttccagatatgaaaatgtgagaaatatttcctgaaatcaagcaagtgggagtgggaaagagtatgtataaatgttacatgaggaatccaaaatcatcatcagcatcacacacacacacaaaaatacatttattatttcacacacaatttcattacacttggtaaattcattagggcaaggcaaatgtattcatccagacattcaaataagcagaaacatctgtgcagtctttaaatctgccatgttaaacaggcctaccactctgtttatatgccccaaagagcctgaaccaagacagacgtaagtaggagcagctggatttgaccctaactcttgaaaatcctgccctgcttgagaggtaaggcatatcttcagctttgcaagcacactattttgtgtgtgtgtgtgtgagagagagaaaatggttaaaattaatgtgaatttggttctccctcctcatatttgtctatattaatatactttttaattgttaatattatcattagaaaggtgatggtttcatgaatgaattatgaaggagaaaagaattttggtatctaaaattgttggccaataattgaccattttctgcctgggtcatgtacgtgcactgagaggttgaagtgtactgtgtgtgcttcttcaggcatttcctatttatctgagacacttttgagacagagaggtgactggagaaaatgaagggttctcctttatttttatgaacaattctctacgcctcattactctcacaatttttgaatatctacaatcttttctctcagttttcttaacctccacgctgatggtcctgattcagagctacttcgtttattacccaaacacagcttggggaagggaagggggatgtaaggcagtagaggcttaattccccttgttattatacatggctattgctatttgtcctagggaagagggttagcttggccctactagataaagagcgtgttaaaaaggcctcccaaatttacaagtgaaaaacaaacattttgcgagtaaaaaacaaacacacatatcctttgcccattaaacattttgttttgttttttaaaatgagcaagggatatgaacagacacttttctttttaaattcttatttatttatttatcaacttttattttaagttctggggtacatgtgcaggatgtgcaggtttgttacataggtaaacgtgtgccacagtggtttgctgcacagatcaaccctatcacccaggcattaagtccagcaaacagatacttttcaaaagaaaatatatatgtggccaacaaacatatgaaaaaaatgctaaatgtcactgatcattagagaaatgcaaatcaaaaccacaatgagataccatctcacaccagtcagaatggctattgttaaaatgtctaaaaataacagatgctggcaatgttgtggagaaaagggaactctcataacctgttggtgggagtgtaaattagtgcaatcattgtggaaagcagtatgatgatttctcaaagaactaaacatagagctgccattcaacccagaaatcccattactggatatgtacccaaaggaatataaatggttctgccataaagacacatgtacacgtatgttcattgtaacactattgacaatagcaaagacatggagtcaaactaaatgcccatcagtggtagactggataaagaaaatgtggtacatgtattctatggactactacacagacataaaaaagaatgagcttatatcctttgcaggaacatggatggacctggaggccatcaaccttagcaaactaacacaataatagaaaaccaaatattgcatgttctcacttataagtgggagctaaatgatgaaaacacgtggatgcaaagaagggaacaacagacactggagtctacttgagggtggaagttgggaggagggagaggaacagaaaaaataactattgggtcctaggcttagtacctgggtaacaaaataaatctgtacaacaaacccctgtgacaagagtttacctaaataacaaacctgcacatgtacccctgaacttaaaagttattttaaaaaaggcctcctttggtcatggagatttgtacacaaacacagagcattttccattgatcctcagttaaaggcaccctgcagttatttaaccctgacttcacataccaaaggaagtctaattatttgatgtgtgctaaacatcctcagtgtggtgctgctgttcagccacattaaattcacaggacaagtctgcaccctatgtagtacagattgagtatccttaatccaaaagtctgaaatccaaaatactccaaaatatgtaactttttgagtgctggcatgattctcaaaggaaatgctcatcggagcatttcagattttggattttggattagggatgctcaaacagtaagtgtctgcaaatatttcaaattttcaaaaaaaacctggagaggccaaaacacttctggtcacaagcatttcagataagggatactcaaacctatcaatctgttaaactttttgatgtctcctaaagacagccacagctgttatgtatttgtcacagaaaccagaattttctttaatttagagatttctttaatttagatagtttgcaaagatgtaagcataagaatgttccctgaaacattgttttctaattttaaaagtctagaaaaaacataaaactatgttattagcatctagttaaatcaatgatggcaaaactgtccaagggaatactgcatcctttgaaaagaatgaggtggatatgtatgacatggtatagcatgatttctaaaatgaaaaaaaaacacacaaggtataaaccagtatgtacagcacataacaggtatacactttgtaaattaaaaaatacacacatagtaggttgttctcattctgttccataaggtcactgcaaatactgaattagcaaataccgactcattgctcctagtggaaatacagggttaggtcctatgagcctttggtcataacattttcatcaatggatcaatacataaccttattttatgtgtgtttctgtttaaagatacattatttaatatatattgttgattcattaacactgaactcacagtttgtaagtcatacctgaatgttgtttatcttacacatattttctccgtaaggcacatcacagccttcctgtgcttaggaatgctagatcacccttcagtctggttcagtgttagctgggaacatatgtgagaggagaggttcaaatttttggctggtctgcacatgtctgcaaatgacctcaaaagtgctgtattaacttagaggttacaaatcaattttgagtagataaattctcaaatatgaaatccacaaataatgaggatcagcaatacatagacagcatgtatgcatgtatataaatggaaagtttctggaaggattaaactactagatgaaagttatctttagcgaatagggctgtggggaaggaatgagacaaggtgcaccttttatcataaccctctttgccctacatgacttttttactgtgtgcatcccgtagtccttcttattctctgtctcctccttttctcccaccatcactatcatcgtcattctctcagcaagccagtgcattttctgaagaactctagggacaaggttttatttgagccaaattgctcatagtgaatattctctgaatcaggctcctggaaaagttggtctacataattttgcaaattaggagtattttacaaatgctaagtatgacacttagaacatgagttctcagggtaatttgtgtcacataatattaccccatatcccagcatgctgggatggcctggactttgggtaccttttgtctgtcaaatactcttacttaggggtcatgcacagtggctcatgcctgtaatcttagcactgtgagaggctgaggtgagtggattgtgttggagcctggattttaagatcaatctgggctatatagtgagaccttgtcaccaaaaaaaaacaaaaaaaaacaaaaaaaacatagtagctgcgtatggtgggtgcatgccctagtcctagctacttgggaggctgtggagggaggatcacctgagctcaggagtttgcagctgcagtgaacaatgatgatgccactgcactccagcctgggtgatacagcaagaccttgtctcaaggaaaaaaaaaaaacacacatacacacaaaacaaatcaataaaaaaccccaccaaatactcttacttacattcttattgcaggttgccagaatggaagtttaataagtaggaaatgaataatattaataatataacaataagtattaagtcagcatatgacatatggtatggaaattctcttcaggttgaattcccgtttttagtctacctgcatctccctcatagaaaggagaggaagggaagaggtagtgagtctctgggtttggtcctcactggctttgcgctgggcccactcagagttcttggatctcaccttcctcaggatgtccagactcaagagcattcagttgtggtttgtccttatcatgcttggcttcttgaatgagtttgaaatcttgctatttttaacttgtaatttagaagattggaaaaggttttaatttttgtttgtttctttctttgcatatgtcatggtgagtcctttaatgaaagaaaagcctgaagagaatgtaactacttacctccctgaaaggcattttttcttaatgaatgtagagatttccacttccccccaggtacttcatgtgatgtactgtgcccctagttaattgcaagctgaagccaagctgactgacagtaaatcaagaaaatgatgtataaggcatgcccaattatagatggaatacattcatattaatggtatcccatggactatcaccctatgtccattgttaatctgtaatctgaaataattcaaatctctgtataattgggtttctgacagcaggatcccatccatcatactacatcttctcaaatattgagaatattgtcttttaaatatgtttgtatacatatacacatatatatatacatatataatgaaactgtgaaaaatacatcttcatttgataaaaaaaagtcaacaggcttataaagaataactttagcagcaaatgatgagtttattttaaaaataaattttgtaaatgtatggacctctaaaaataaaaatactaaaatttcttatatgtttattttccttaccaaatatgacagttatccacaagtggaacagattgtagttattgctgatcttatgtctgaaaaaccacatggatttgggggaaaaaaaagcatatggttatctattggtctacatagtttactgttgcatgggtagacagaagctttcagtaaaactaaagggaccttttctgatcaaaccctgtgtatggctgatatatgttctgccaatccagccttgtttgagtttaagggtgccttctggcctggggtcaatttctctgtgattggtttaatgtcatttgcccataagcatacattgcagggtgctgcccaagggcaagtgcacagcttaggtacatcatctcatttacaaatcaccatccggccatgtctatgagcactgagatatgaatcatcattatttatacactttagtcatatttgaagttcttcttactaaccctataaaactctcaaatgaattagaatcctcaaattcacataactatcctatccatttcctgtaggcagagccatatgcaaaactaacccattattgagaggtgcttggtaaacataggcacagaacagactctaatcacgtcttgtaaatctggggtccattataaataataaataaagttttattgaaacaccattatgcatattcattcatttactgtctgtgactattcttacattacaacaatagagttgagtggtaacaacagtgatctacagctgaaaaagctgaaaatgtttactatctggcctaggccagaaaactatactttctatcatgtgtccttgccgtgtaggcaggtgacttatggagaaatgggatgaaaaaaatggacatggtgagtcaatcatcagtagagttgaattgaaagaatgccattagttggagtcagagtcatggcaagagagagagagtgtaaggtaaagttgtgaggaagaagaaaccatgcattaagaagagaaacctggtcaggagacagaaggctgtacaacaacccagaaaaaacaaaacaaaacaaaacgaaaaaaaaagaaaaaaaaaaagagatgccataagatgagagaaagaaagagagaggcagagacagagactgagagactgatcatctggcatatggccctgaggcagagattagcttgttcctcaacttccctaggtttctgatagctgttcagttcacagacacatgcatgtaatgcccctgacctccaggacccccatctatggacagcaaggagctctttttgcaatcaaaagagagggaccaaaacagatcattatgtattgcgccataatgaggcaaatttatttctcttatttgtaagttcctatgggaatgactcccccattagatcacagtattgacgataagcatgaataagctaatttgggtagaaaagtcacttcatgtagtagaatgtaatgttgactgttaagatatctcatacatcatgaaattaaataagatttcccttttatttcatttgttcagccactcagtaaatattgaagacctattaagtataaagaagtgcaagacagcttgatggattagaacatgtatgtaacaaacccactcccagggaacatgtacaatcttgtatgaaagttgagacagatacactgatgactaccacacagagaaacctatggtaattaagtttgataattatttatagcagtcacattatgtactaaaacataaagaacataaggccattcaccatggctattgagatggatgaggctgagcctttgacgttggaagaacagtagcactgtacacaagaactgaggatcacttcttgccatcaagaccagggaagccatcatggaacatcgtgcagtgggcacaagagatagaatgcccattgcaacatcattggtaatagaaaaaaatgaaaatgtccataaggataataatgagtaaataactggcagtgtcattgtataggaaaataccatacagtaattgaaaggaatgaattagagctacatgaatctatattgatatatctaaagcctaatgttgagccaaaaataaaggtgcaaaaacatttttatagtgtgagacgaactatgcaatattttaaaacatggcaaccaatacttttatattacttagaccagcatacatatgttgtatagatttttttttaatgtttagacttggtagatactaggatagcttttaaatatggagggggaaaaagagaggaaaatgatattaaggaggcatatgcaggagtttctactgtatgtgaatatttaaatttttttaaaacctaagcctgcagaaatatagcaaaatgggagatgaatacatgggccttcattttttttttttttttaattctcagaggtcttctgtttgaaatatctcagaagaaaaaaaaagaaaagcctacgtgtgtttatgtggagacacattccaaagaagggacatgtggctggttatactcaaggtggttatgttcagttaatctaccaaactggatgatacgggtcaggacccagttttagttcagagatcctcagttttattgtgtgcttagtcgtattactcaaatgagtgaaattagcttttgatagagtcagggtaccacttcatgtgaccaaacaaatgcacgaagcctggagatggctgtgtttgagcacaggctttgtcctgctcgcagatgtgcaactgtgcatctatggacagcagtagagggcttctaagaacactggtggcaaatatgtcaggagtccctggccaatactgttgatgcgaagctaaggttctaaacagttttggatcacagcctctttcagaatctctacgtattttaaaaacctgtgaagcatgtccttaaacagacatgcacgtgtatgtgcacatatgcatgattacataaatttccacaagttcataaaccaaggggtttaagaaccttagttaggaaactcgtgtataggcacattaccttagataaatttggtcaaatcctccagtgaagataactaatggtgcagtttctgtgaaaacacacaggactctgaaaatggagctacggacccagtaaagagtttgtacaactcagtgagacttcctaaattcattgatttacatactctactaaccaccatcaatcttggcacacaaatgaccagaatatacagaatctatctttgctttatttgttttgtaatggttcttgaatgcttctttaaagaataaaactactggacatagaaaattcttcagcttgtacaatcatttaggatggtgtaattcagatgaagcattacacgtgaaaaggaaactcagtcagatgacaagcaaattcttggcatccaaccctgaccaccaatgcagaatatgactaaggaataacatttttagtaaaaggtcacagacaacatgaacttaacacattttattcacctggtggcaaatagaaatgaaatcccagaagcttggttccttgaataaatattgcagcaactgacacatccaaatatatttaatacaaacagtctctcattgcaagtgctatgttttttctgaccattacatatttttactcattatttacacagctaatgactgttttataatgttaaactcaaccttccatttttctgaaattatgtttatatagttattggtttgatggaataattaaaatgcacttatgtgagatataaactaagtttccttttcctgtcttgtttcttataatttaatctgtattaggtcattcaactagtaattgttattctaataatttcccctattttcttttctttgaactggctgactagctaaagtgtataaaaacagtgactcatagacatgcattttgaagtaaccaatataaataggtacattctggttatatcacattttagacaactgcttagtcaaatgaaatgcaaaaagaaaaacggaaagaaaactatttcaaataccttgaaatgtgtgcttcaagctgactttcagaataggtgcacatttatatagctatgtaaaaaagaaggggaaaaacacagaaattccaaaatattttcaaactggcttagacatcttgacactttactgttttcctctgccaggagagtaaatgagtggtttgccctctggggaaaaatccatttaaaagcgaaactattttaaatgcatacctttttacaagaaagaaaagaatagttcttagtagtgggggagtgggtaggatatatgtatatggaagggcacagtgaaatgtattagtatagggtcttgtttacttgtaagtattttcttcctttttgtcattcctcacacatttacatggttagcactggtgatacaaagaagaaagaaatattcctagccttcacgtggttttagtctaaagggagaacactcaggaaaaacagtgtgcatcaacctagagatgccatgagaatgaaatgtgcagtaactaatccatggaggagaggatggtcagagggggtcgtgtttaaattgggtcgattaaggttgcaaagggtcagcctattttaagagggcaggtgggaaggaataggaacagaggccaaatgcaggagataatattttgtaaactgttttgtaaatgataaattgtaccttctgtgtggaggtaaagtatgaggggagatttctgccttcttcctatcttgttcttatatatttgttcatatatttaacatagctacccccttatggtattataattacctgattaccttttaatctcatctgtgaagtccctaagtgtaggagcagtactttatccatctcttttccctagtgcctaacaggtccagacagctggtagatacaaaatgaagactcttttagttgaactgagtgaatgaaaggatggacagatggatgcatagatagatactctgtaattacaaagaaatgtacttgggctatgactccttcagtggaaaaaacaacatagcagaaaaaatgcaatacatggggtgtggtagaattgtaaaaatatttttactagaaatactcttggactttatgacaaattagaaattatttccttctatgcctggcccttccaaaatttcacattcatgcatacactagtatacttgttaaattgttggacaaaaatctccttcgatttagaagtctattatttcgttgagatgacagtttttaactagtaatgaaagttttccaatgaaaacactctaattttgcaatgtgtacctcaattttgtgaaaataaacggctgagtatactggaacaatcttaattctgttgaactccttaaaatgatattacatatcaaagagtacacctttaaactactaatggaggaaaatagaataactcaaggagagcaagcagacagctggaatttttgggaaatgtctgtggtatttgggtttatttttaagggaaagaaaaatttcccattaaattttataacacaataacacttttaaaacttatactcaaaaagaatctttataatgctgttgtaaaactcagattatattttattcatgaattacagatttcttttttgatgacggtggttagggtaagaagcggcttttataagctttatttatctcttttaattacctccttctcctgtctcaatgctcacacttacactcactttaaaaaatttttatctttcatgggatctatatctaaataacaccacatcatatgtaaattaagaaacattccaaatattctccgggacattgaaaggaaatcaagcaaaacattctgtaatgtgtaggcaactttaaaagtgcttgaggcagaagcaaaaaaaaaaaaaaaaagtgagagaaagaggctttctagcctgtgtcttttttagttagatgtttcagaagatgaagaaattttaattatgtgcttccttagagtgagatattaattcctctgaatcattctctccaattttgagtcccactctcatttttctctccctcttcttttctcctggtttttccccctccctctttaccttttctcctccctctttttcctccctcccctttccttctcccacaaaaagccagaattgcttggtggtaattccctagaattgagcaggattgaactgggggtcactctggctttgtactgttccctttcttatctaacctgaatatccttggatctgtaagactttttctgatccatatcacagcctttttctctcctcaccgttgccagtgggatttctcgtgggcttttggagaggtagaaggcatacttgtgaatgtcaaaagagctgtattcctgtatcctgtttcaaccctgaggagaggcactgtgctagtgaggaaagaacacccaatcctagtcaaaggactgagttcaattcagcctcacaagaggctctaagtatgatcttagacaaggaaacttcaggccccagttttcccatctagaaaatgagagtggttagaactatatcacactgaggattatgtgaatttatatatacgtatataaagccgtgcacccaaatgctgtttacagcattctgtgatgaattccctatttcagttggtaccatttattcacagacaatcacaggtattcagagattgtaagaattatggtagcaattgcttactatagtttgtttattccataagagtggctttcatttttttttaaaaaagagacctctcccttggattttcgttataatatgtttcacttgccacattttctgaatttttccatgtcttgaagcctttgtgatggtgtttcataatcaacctgcaggttgtcagaatcagtggagcatgccatttactgcttgtcttagatacactcaatgattctttctttcctgagtgcttcaagttttggctttaaagatcctcctttgttttaatagattttccattagtgtctgcttatgtaattttatctccatttctaattgtgaaatttgttgcatagatgtaaattttctttcagtattattcagagagaagataatggttgatacccaaaagaggaagctaaaaatgccttttaaaattcttactatattttggtgatttttaccaatgacattattgtatagttgtggtcattataccgttcattaaaaatatttatttgaaattactgcatgaatgccaatctctgaataacatctttgcaaatatagcatgttattttgtcagtccaaatgtgtgctaaatactaattcatgttgttaaatgtggatataaaaatagttaattctcttgctaaggatactcatttatcaaagtaaagtaacattttaatatttttcaagacaactatttttaaatatttattagagaaactgttctaggagaaaaattaagataaggtattatgtattttactctgttatggacacatacatatttggatatcagatagtttcatatcaaattacatatctttgtactcaataaatattagaaaaactgtttactcatctgtaaaatataaataatagcatcttctcattgagttactttgaaaataaataaaaataatacctatgtacaggacttaacctagtgtctaccataatgtaagcacataatgaatacttgatactgtgattgagtacatgctatgactataacccagaataagacaataggaacataaaaatagaaatgatcatcattttagataggggaaaacagaagggaaatacagagaaatgacatcattgtgtttgagaccatatggtatcagaattggaatagaaggaaactggagttgggggagggaactggaagagtgttgggggtttgggaatgaagaggtgatactaagttgtgtttgggaatatattggatttaaagtgatagaaagtaattgtagtgaagatggactgtagtcatctcatgaattggaccagaactttaacattgttcatttagttttccaagagatatttactgtgggccgatactatgtgctagatactgtgcattggtacagtaaccaaggtacagtaaaccaaggatggaaatacataaatttgtgagtcggttttctgagtgaaagttagaaataaggaacaatgtactaggcatgaagtgttggttagtgattacaaataggagaggagaaaagaaaagtccccaatgacacaagactagaggctgaagacatatcaagagagtgctgcacgaggggagaagacaactttaagacattgtgatttccagaagaatcacttttatataaattgaatgctttctagagcttaagatcattcttatatgtttcagtaacagaaaatgaagataaagatagattattcttggctttttacctatttacacatgaaaatgattacatacatctacttattctagtgtgatattattttcattaaaataaaggtattgaaggaattgttcaatgaacaaagaaaactgtacttttgactaaattgtaattaagtatgcttgaacatttttaaatgcttagttctgtaattttctgcacaacatgtagtaaaccagacatatttccaataaacactgcttaccttctttttgtttccatgtttaatagccaaggtctgtctgtctttctttctttctttctttctttctttctttctttctttctttctttctttctttctttctttctttctgtttttctttctttctctcagaaaagaaaaaacaagccttggattcttgtttcagtagctatgtgcaaacaaaatggaaaaaaaaaaaacagagaaaaatcctccacaataaatcgtaatggacatataatctgtataacacaaaacttagtcaccaaaggatacttgaaatgctgctagatcagttcaaatcagcaaatatgtattgacttcccattttttagcactatgttaggtgctacagaccacaagctcacagtcttcaaattaaggagacagttatataaatgatataaaggagaatctgtccatcacagtgagacatccaaatggctatgaagattccaaggagagacagagcatctggttgagagagagcaagaagaaattcctagagaaagtggaattagagaggaacggggagtaagaaatgagagtaatgccaggctccggatgaggaacaacatgggcaaagacatggagacaagcttggtgtgtggtgttcctaggaaattattgtcctgttgactgaagaaaaagggacataaaagtggaagactgataggagatttggatagagaggaatatgtcgggacatactgtgagtgctatcatgaggaaattcggattgattcaataggcaatgaagagccattaatggattttgagtaggggaataacattactggagcagcaatttagaagactgatttgacaccaatgcatagtatattctggaatgaagacaaatggcaattggagaaactggctgggaacttattgttatagtttagcagttaatgaaagtctgaaccagcatggaatgaaaatgaaagaatctatatatgggtcttccaagatgcagatattcaggaacattccatacatccaaagtttacatctgtatagtattttaaatttccatttgccctcagatatttggcacagatctgagagtaaccttattggcacaggtgattctcagctgcagagtaccacttttgtctgtattaatggtgtcttctcttctttacaaggccaccaaagtggatgcataattaaaatttgttgctgtttctactctacttgtcctggacgctcatgcagccaaatttcactggggacccaggaccacacaaaacagtatggtgttatgaactggttgccccaggagttttagaaagtcttcttaattactttaaaaaggcagcagctctcctcacccactgtaacttgaacgttgcatgtttggcctctaggatcagtcctcaaatgcatctctacctagtattccatcaggagcaattggtatatttgaaaatgtattgctttatttaattttcatgaagctcagtttcccacatagtaaagacaataatctctgagcaaaaataatttcagttattcttatcacattgtctattcatctattatatctttgcaatattaaaatgcatttaattataataaaacatttaacacaagtaactggaaaacaaaaatctttctcaactgattattcttagtcttgcttttatctcccttttacctaataaaagcaaatttagttttcttcatttatgaatccaataaacatcatagactcaacttcctgatatttatgctctatgagggtttctccaccacacaaatttatgtccactgagagcatcttatctctggctctgacacttttggcctggaactaatcactgccattgaccattgcatctgggatgcattagactctgtccctaggtgcttcaagattttattgtacaacaccatttaacaaattattttattaataacccaaaccctgtgaatcaaggtacattttaaagcctaataaaattatggtttgggaggccaaggtgggaggatcacttgaagccaggagtttgagaccaatctgagcagcacagtgagactccatctctgcaaaaataaaaaatagaaaacattagttgggcgtggtggtgaatgtctatagtcgtagctactcaagagattgaggcaagaggatagtttgagcccaggagcttgaggttatggtgaattatgattgcaccactgcactccagcctgaatggcagagcaagaccctgcctctaaaactaaaataaatggaaataaaataagatagaaaataaaattaaaatgatggcatgggagaccactcacatttcacaaatttgttttagcctctacacaaatactagtaattaaatcatattttttaaattgtaagatttagaaatgtggatatgattttccatatgtaagagaatcacaattttttctcatcctctataaaaattcatcccctgattaattcacccagttgacaaatagatactttttcaatgaaatatatttaagtattatagtgcactttctcagaccgcaagaggttatttattttacttctgaaggttttgaagtttgcctcatagactgtaagtgcctaaggaaagaaacagggtcttgttcacctgcagtggttcctgggagatgctcagaagtttactcagagttgcataatgtgccaagactataaaatttttttcctcaaactaaagcctttgtagatagaaatctatagcttatttgcaaatgatgctatgctatgttatagttacagcttttatatttgtcgaacttgtataattgttacaattttataagagaatttaatgcagcctataaagcaacattagtttatctttgatattcccaaatctacctattctcacttgttattcgtactttgtgacttctccaacctcacttttcttgggaaggtccacagaatctgatgcattgaggccacattaagatgtaaatgattaccagacttctgaaatatttgcatttttatccacaacttagattcaagtgagtcatagctatgttttgtattctgggcatctgcaggccaggaagtatgatgggcagcccaagaagttctcctgaaactcttgaaatccttcccttttgggcttagaacattgataaagattcagtctgaattccaaaatgtctgttttgagagaataaatgcccaggaagaccctttgaaaataaaatgggtttgttctacaaattagatatttatgtatgtcaagttaaatagttaattacttcatttttggtgatgtgtaaagaatttaattttatttattttttatttatttttttgagacggggtcttgctctgtcacccaggctggagtgcagtggcatggtcttggctcactgcaacctctgcctcccagattcaagcgattctcttgcctcagcctcccaagtagctgggattacaggcgcccaccaccatgcccagctaatttttatattttttgtagagatggggtttcatcatgttggccaggctggtcccaaactcctgacctcaagtgatccacctgcctcagcctcccaaagtgctgggattaaaggatatatatatatatatatattttttttttttttttttttgagacagggtcttgctctgtcagccaggctggagtgcagtggcacgatctcaccttactgcaacctccgtctctcgggctcaagcaattctcctgactcagcctcccaagtagctgggattataggcatgtgccaccatgcccggtaacttttgtatttttcgtagagacggggtttcaccatgttaaccaggctgatctcgaactcctgaactcaggtaatccacctgcctcagccttccaaagtgctgggattacaggcatgagccacctcgcccagcctacccaaatatatttcatgatacacatttcttagaatcatgaatttttttacagttgttcatggctttaaaaattaatgtgagatttctaagcatatttagaatccagacatttccaaagtgtgctatacatacagcttagcagttaggcggatattgtaaggattttttaaacgtctccattaatgggaaagattagtttacctacatttaagattgccttcttgcaactttccatctctcatttgagccttattctgcacaatataatttaatcaatagtaatccacttttaaatttccacccatatctctcctcttgtttatccaactgtcttattaatatttccaaggatggctatagacatttctgcctgaatatgcacaaagccaacttcctgtttgtcctcatcccctcattccaaacttgctcctgtataatcatcctcatctatgtatcttgccacacccaactccatttttctagccactcagacaaaaacaacccaacaaaaaggcaaacaaacaaccatctatcttagttcattcgtgctgtcataacaaaataccatagactggataatttataaataatacaaatttatttctcagatttctggaagctgggaagtccaagatcagaacaccagcaaatttggtgtctggtgagggctactctttgcttccaagatggtgccttgttacagcgtcctctgaagggaactaatgctgtgtcctcacgtggaagaaggaatggaagggcaaaaaagggattagggtgctcctttcaacctctttcataaggtcactgaatcttttcttgagggctttgccctcatgacttaattacctccaaaaggccttgccacttggtattatcacttaggagacggattgtcaatatataaatttggagggatacatttagaacataacatcccctcggtcccccataaaaagcaaaattttgaattatcttgtccatttttttcttttcgaaaatgccatgtccaattgataaaataatccttcatgatatctctatagctgttccacttctaaccaccttctccactttcatcttagtagtttctgcagtggctgcttacggagtttcctacttccgttcttgtcccttgtgggctgttttcaacactgaagccagggcaaaccttttaaaacctaagccaggtcatatatttcctctgttgaggatgtttatgcagtattactgaagtgttatgaatattattaataatagtataagctaatgtgtgttgatcacttactgtgtagcggagcctgtgctaaaatagtacaagccaattctcattttatccccaccacaacctcttattattcctattttacgcatgagaaactgagctatagaaagattgaacaatttctcaagatcacttaaattatgaggtggcagagctatctttgagcttaagctgtcagattctagagcgcggacatgaaaaaactaagctcaacgttctctcctttctttgtaactgtttaacctcttaacatggtatactcaaagtctgtctgataatccctttttatcaatgaaaaggccaacaataacatgtgccatattttgaaggacagctttgtaatgaagtttcttagcatcctgtttcttaagaagtagttagcagtacactgagtaaataccaaatatttctcttgacattgatggtcccagcagcatttcagtgtcccggagcaactcctactaagttttaaagtttatcttgcacttcactcctcattaaaattctactattgatgtcctattttgacttttaatcataatttgtccttttaaaatcgttgctcattcaggcaataagtgagtataagtaataaatgctgttttcagaaaattgcattaataaattctgttcttcatgagaactaacaggtactaaaatgaatgtaattgtagataaagaagaatttgttcagttgtgaagtggtactgtgttttatcagactagtaatgatggccggaaccaaagttattataacctaaatattggcatataataaaaagtactcttttaaaatttatagaggtctcgtgtgtaggtgacaaaatttttaaaatcatactttttttcataaagtttaaacaaatataaatttcatccactacccagttttaaaatatttattattttccaatatttcagatattcatgtctaaatcattttccaaaggaaactcattttatatatatatagatatttaaccctcttgtcgagaactgagccactaatgtgttatttaatacttattttcttagaaatgtaatattctatgtaattattatttatatgtaagttataataacacattgagaatttaccaaatggagtacaacataatattgacatgagtttctatcttaaagtatttctaaaactatctccatagtttttctttagtcctatcatgcaggcttatcagcttacttagcatgatgactgtttcacaattatacaattaataaaaagtgaatgccttccttgaggtacaggaggtactctagaaaaatatgttaacccaccatccataatattctccaattactgtaacataattgagaatacatagaagattttttttccccataggagtaagtttcttaccatatgttttccatttattcagcctgacttttttagtattgatgtaggcttggaaatgtttttactattgccctgcattttccatgacacacacccaatatgtatcactagagtgtagtgattagatgagatttagagacatgaagattggtatttaaaggctgcctgtgacttaactagtttcgttggcttgttatttggtcagtttatttaatctccctatgcttgttcttcatgggttcatatatgtaaagcatttagcatacaatggtgcataatggaccatttttctgcatttacagcatctcatcaatgggctagaataagcttctttaaatgaaaaactggactgtttccaaattatttatttatgtttagccatcacagcacccaatagagtgtcacattcaaaatgaacttatgtgatagaggtggcgcagtgctcatgctttcccatacaacccatcttttttcatgcagtgcttggttcatattttcttccttctcctaaacctctttttggcataatctttcttcttatttctttcctcatctgatgcataactgtttccctatttagaaagcaatctttattattacttcttttcctctcagcacatttatatcttaaaccttattttttggtgcagctgaggagaataaattctattgccatgtaagcacatttacttcagtcacaatttatccttaatatttttaatgatcaaaagtactagccatgaaaaataggtattttatgtcctaggaataagaggaaaaataaataaaattttgtactttccttgtatagtaaaatatctgtggcttgtttctttttaattctctctagccaatcagaaatgtggtgatgatatgataacataaataacttttgtctggaatgtttttattgaaaagcagatgtgaatcagctactagacagatatcattacaccatgcccatgagagacaaaaaagaaattaaaaattaaataatattcacaaatagctaaactaaagcaagtaaaacatcaaaaactcaggttaacttggaaataacttttttttttttacaatacctaagtaatatttttcttttccctttagaaaggctcctgacattgtttagcaaatacaatattgtggccaacttaagaactaaatcactgttcatctttttaggagattgctttgttgtgttactgttttgttttgtttaagctgccctaattattagtaagagaaaaacaaggctattttgagagctacaaatatgcatcatacaaatataatgatctagaataattgctgattaataaataaaccgcatttattgcttatactcactgatactactttctatgcatatcagtgagtgtatgttgctcttttaaaaaccttccaagataaaatattttaaaggtcttccagaaaactcattcctgatacaatagtatttgcttgagaattaaaataatcctgtttctcaagaacagaaaaccgaacactgcatgttctctcttgtaagtgggagtagaacaatgagaacacgtggacatagggaggggaacattacacaccggggactgtcagggggttgggggctagggaagggatagcattagtagaaatacctaatgtaggtgatgggtgcagcaaaccaccatggcacgggtatacctatgtaacaaacctgcacgttctgcacatgtatcccagaacttaaatataattttaaaaaatcgtgtttctaaggaggcctaaagtttcattttattaaggtctgtcaaggatgtaaagcattaaatactgcaattataattatatttggtaatcatatttggtattttgccccctacaaggttgactgagactaaactagtcttcctaagagtgagtacaccaaaaatttaggtaacaacctggttaccttaattgctgcttaaaattagttcttaggaagtcacacttctctaaaattaaatgaagttttttaaaaagtaatattcagattttggttataagtataaagctgtaagtcgagaataaatctgaaattggcataatttatgctatgtccaaaagatcccaaatacaagttcccaaaaaaggaaattaaagtttaggaacatgacctaagtatagtgctttcccattaaagtttggagcttttaaaatgcattcttcaattccaaaataagactctttcaaaggcacttctttttcaaattttatggtgtgaaacacaaaatatattctttaaaaaaaaaagtacttctagtgttctcaaccattctttatatgtgcgttgacagtgtgtcctccgctttaaatcttcaagtatattatctgtactcactttggctacctattttcagaccatccagtttcagattttgtttggaaatacttctctggaccatcaccctactccccagagtttctaattctaactcatgaccttgtttccttcctccctcttcaacctgttacaatttcctaaatactttgcacatttacctgtaaaagctactgacttcaaaaggactttaaacattattccaaagtgctagtggacatggaatacaggagtgaacagaaagtgttaggaggggatgtagataatgaatcctatgtgatagggaagtgcaagaaaggagtgagagttggagtctaaagttaatacaaaaaaggaaaagttcacacagttaaatttattcctgaaatctctcaaaacgtcgggttccttgacaaataacaaaatgtattctaacaacacagtttgtattaatgaaatataattttagtaaatattatttggaaatcaggccgggtgcggtggctcatccctgtaatcccagcacgttgggaggctgaggcaggcaggtcacttgaggtcaggagtttgaaaccagcctggccaacatggtaaagccctgtctctactagaaaaaacaaaaattaactgggtatggtggcacatgtctgaaatcccagctactcaggaggctgaggcaggagagtcccttgaacctgggaggcagagcttgcaatgagctgagatcgtacccactgcactccagcctgggcaacagagcaagactctgtctcaagaaaaacaaacaaacaaacaaacaaacaaacaaaaaacacaaaagctatataagagaagcagggaaaataaactgagctcatgaaatgacagtttgagaaagtaatatcatcaaatgactcgaggtaaggccatcactcaaaggaatttcattgggataatgtgagttaaataaatacaaaagaaataggacattattcaaaactgttactgtcatttttaccattaaatgtaattgtcattaatctcataaatctcccctattgaattcccgataacaaagtaattagctacatagacattttatcaactacgtaggcagactgtagtttacaagtacaaatatatttttgcgtaaaagcattgtttttgagaataaaataaagccttcaaaattatgtaactgcctgggtgtggtgtctcacgcctgtaatcccagcactttgggaggccacggtaggtgtatcacttgaggttcagagttggagaccagcctggccaacgtggtgaaaccctgtctctgctaaaaatacaaaaattagccaggcatggtggtgcacgcctgtagtcccagctactcagtagtctgaggcaagaaaatcacttgaacctgggagacagaggctgcagtgagccaagatcatgccacctccagcctggacgacagagtaataccctgtcaaaaaaaaaaaaaaaaaaatctcagttttaagactgtgagttgaggataaaacccatttgtgtaatatggcgttttaaaagtaagtaccagagtctaaatctattgtcatcatttaaatccacccaagatttgccaagaatttctgaaaagaaaatcaaaagcatcctggtaaacttctaactagttctgtatggattattcacgttatagattggccattacataagaaacaacttcccaaatcaggactcacatgggggcattagaagcacagtctctgcccaaagcaaccagactacttcctttctttccatataactatatttttcatggatagtctctgttttcaaatttccacttgtttaccctcgttggcacagatcataaagagttgccgcatgagggtgattatagggtgccagaagttatataacgcacactctgttgtctttgaggtaatagccttaggaggccacaccactgctatattatattacagggtggctatttcttaacctctttggaattgactcagaatctcttaatgaactacataggaattttagtcattatttggcttctggtcatgaataaaattaccccaaacctgttacccaccttactcactactcttggcttctcatgacctcatatttgtttccgtaatcagaataataggaaacaattctaaaccaggagttctataaacgggttcagctgtgggagtaaaataggagtaatttcatagcttctccgtataattgcactgtatctgtaagagtagaagacgtcaatcttaaaagatttgaggaggttatttccacacattaaaaggtaaagttaaatatcattcatttttcagaggtaaataatgataaataaagagagatatacatcacgatattaaaaaggactttaatgttataatttaaaaagtctctaaacttgtattcattttagtggtgtataaaaggaaaataacaactggaataaatttacatattgatttgtggagaagtcacatcttatcccaaaatcatgacattatcgattaatcaatatcactatcgtaaaactgaatgacttaaaaatgaaagagcatttaatatttttcgccaaatttaataggctaagtggtttactttaaactctgttttgaatcaatttagattcgtaagtttgaatctcatctgtgcctttaaaaaattatttaatttctttttaaatgacttaatgtattgaaattatacctaatggctaatttgtaatgaaattattcaaaatacttacaaaatttactctaaagtgatctgaaatacagatttatttattgaatgttaacatgaagttttgagaaatatgttaataatgtactaaagtaaaatgctagtattttattatgaacgtttacacttaaaaaccttgagagtgcattatcataaaattcacaataaagtgtaaagtccagtaagaaacttattaagtatattcatgatataatggtgaactaactcctagggttccaactaaatgtgcaattagtaggttatggtttccatcttttacaattacatgttccattgtttatagatatactacaataaacattcctaaaatactggtcatgataaattagcaaagaaatcaattgaacaacttttaaaagatgtgtgctactataactttagcaaatattcattaggaaataaatgaaatatttttttttttcaaagaagatgtgagaaacagcttctgataagaaatgtctggtgtctgctgctactctcctaccactctgtcctcacatctgttttcagttgcctttacaacaaatctttaggctagctcagctcaaaaattggatctcatcaagcaaggggagtggaatgggcttgatctattaaattaaggcagccaccaaagatgacttaagcctcacctctgtctctgctctagagttaggcaccattaagcctcctattgtacttgtgttgatcactcagattcgtatcccgacttcaccctgcattgccctatccaggggaattcaggcctttgcctttttttgttttgaaagctgacagttcaggaataagaaaattgaaaatcaccattagataaatattatagaaatagttattgatagcaagatctacccgtgggtattaaaataagtggataagagatgaaggagacataggatatttatattgtctcaaagtatttcacccaagatatttattaattacgaagaaaaagatagtcactttacagtgaaaaaatcaagcaggtaccagttgatgattcggttaatgtcaacagtaacaggatacatgtatatcaaatggttgaggttaatatcaacagtaataaaatatatccatattatgtttcctaatgtaatagtaatagggcatattgaaatgatgtatccctatatgatggtattcatgttaacaatgcataatcttaatctaatgagaaaatatcagatgagtgcaagctgagaaacattttacaaaataactgaccaataatcttcaaaaatttcaaggtcatgaaaggcaaggaaagaccaagagactatcacacactggaggagattaaggagatatgacgaacaattacaatgtgggatcttggtttggatcttggaacagaataaggactttattgaaaaaaccttgaaattcaaataaaatttgtagttagttaatactataataatattaattccttggttttgataaatgtactatgattatataagaagttgatattgggaaggctggggaaagtgtatagaaactctcctatacacgatagtacagggtgtacaatttttgcctctttttctataattcttaataagttcaaaattttaaaagttatttcttaaaaaaggaaagttgacagcccaaatcaatataattcaactgcattgactaaacataattactgagcatcaactctgtgttaagcattgcagaggatacaatgatgagaaaacggaatttctgccttcaaacaatttacagtttggtgagagcaatgaaataaattaaggtagctatatgagagttggcacaaagaggacagaaatgacctcctgttgggactctgtgtgtgtgtgtgtgttttgggtgaggtggtagatttagaaaagtttttttgtgagcataacatgaactagaacttgattactccaggtgtaaccagaacttggttactccaggtgattcattagtagatgtcttggtcaggtcaggctgccataacaaaattccatagactggatggcttaaacaatggaaacctcacagttctggaggctggaagtttcagatcttggtgctggctgatgtggttactggggaggccctctttctgggagctcatgtgctctctccccaccatgtgagaacatggcaagaaggcagccacctacaaaccagaaagagggcctcctcagtaaccacatcagccagcaccaagatctgaaacttccagccttcttagaaggacattagtcctattggattatggccaggccctaaagaccttctttaaccttaattaccttcatacaggccctgttttcaaatatacttattggggatatggacttcaatgtatgaattatggagggacacacacatttagtctgtgacattccacccctggccccccaaaatgtatgtccttttttagtgcaaaatgcattcattccatcctatcgccccaaaagtcttaatgcatcaagcatcaactctaaagtctaaattctaaaatctcatctaaatattatttaagtcagatggatgagactcaaggtatgattcatcatgaggcaaaattcctctccagctgtgaacctgtgaaacccgacaagctaatgggcttccaaaatacaatgatgagacagttataggatagacgttcccatcacaaaagggaaaaatcggaaggaatgaaggggtgatggatcccgaacaagtcaaacttagcaaggcaaatttccattcaatcttaaggttggagaataattgtctttggcttgaataatcctctttgccttgaataatcctcattgactttccaggcctggggttggcagcatcactgccacagctctgcagggtggccccaccttgtgggtctctgaggcagctccactctctgaaaccaagcaggaaagagccttacccacctgtcttcccctccccttgggcctgtggtgggagtggcagttctgatcatctctgaattgctttcagagtcattcttccctttctttgaagactagttcgtgttcatagacaaagagctctatggtctggtcctgtagaacccaagaagttcgacagccttctgttattccatcccattttctgtctcccctatttttcaaactggcagagtctctgctggtgtaatcctactcctggctgtgctgagatggctgattacattcatgaattgcacctatgctctctatcaagcagttgttcagccatacccttaatgcttagttgcttagtgttctcttcaaaacaaactttctttccttttttttttttttttggaatgtggatgggctgagaaatttccaaatctctcagttctggttcctttatacttaacagttccttcttccattcatctctttcctcttgaatttgactataagcagtgagaaccaaagctacacgtttaatactctgctgagtgtccagttttattgctcacaattcctgctttctacaaaacactaaaggacaattcaggcaaggtctttgccactttataacaaggatcaactttcctctaagttttaatcagctgttcctcatttccatctgggccctcatcagaatgacctttaacgtccatatttttgctaacattcagtttataattatgtatgtattcactaagaagatgaaagccttctctccagctctcctcttttctttgtgagctttcaccagtgttgcctttaatgttcatatttctacctatgctctcttaatggcaatcttagctttttctagcatgtacctccagctcttgcagcctctacccatcactgagttccaaaaccactttagaacttttagggtttttgttttttttgtttttaggtacttttttacagctttaccccacttcttaatcccaaaatctgtcataatcagttcaggctgccataataaaatgccatagtggtattaaacaacagaataagtaacttaaacgacatgaatttattttctcacagttctggatgctagaagtcccagagtgaggtgccagccagttcggttcttggctttcttcctggctgtagacagacaccttcttgctgtgtgctcctgtggtggagagagacagtatgagatctctcgtgtctcttcttataaggacatgaatcttataggatcagagcccaactcttacattcttgtttaaccttacttacctcaataggtaaggacataagacataaacaaggacataagagtggggttctgatcctataggtcagatcctgtagacccggtagggtcttcaaaggccctatctctaaatagttatattgggggttggatattcaatattcaaaacactagagcacaattcaggcaagttctttgccaccttataacaaggatcaccttttctccaagtttttataacctgctgctcatttccatctgggtcctcatccaaatgacctttaacgcccgtatttctaccaacattcagttcacgattgtttagtattcactaagaagatgaaagcgttctctcaggccttctcccttttcttttggagctctcagatttgagggattttgaggggatacaacattaagttaataagagtagacagcctttactttgggaaaactgaatgagtcacttgctcaggagaaaggaatagggatactgatgagtttcatggggagtctacagtgagggcttatagggctgtgtggaaggcgtagatgtgtttattgtcagaatagccagaaggatttctcatagttatgctactagcattttgataaagtctcagtaattgcaactactgaggttttcataaactttattccaaaccacatacctttgtggtttttacttgagtcttgttttctagagagacaagataatgacaatgaacacatttttattcatcactttaaacttgtgctgcctcttgggcttaaattttctaatattatttatttaagaaaaagcaccaattttatacagaatgtaatactttcatctttatacatgacaaagtattaggattatcaaaaatgtaaccatgacaacaggcttccttgcaacctagttcatgatagcagagtacatgggcatgcagattcttggcaggaaatattttttggtggtatatgtatacacatagatatacataaatatacacatatatatcaccagaaatttttttttttcttttttgagatggagtctcgctctgtcacccaggctggagtgcagtggcacgatctcggctcactgcgagctccacctcccaggttcacaccattctcctgcctcagcctcccaagtagccaggactacaggcacccgccaccacgcctggctaattttttgtatttttagtagagacagggtttcaccgtgttagccaggatggtctcaatcttctgacctcatgatccgcccgcctcggcctcccaaagtgctgggattacaggcatgagccacgacgcctggcctaattttttttttttttttgagacagagtctactctatcaccctggctggagtgcagtgacatgatctcagctcattgcaacctctgcctcccaagttcaaggtatcctcatgcctcagcctcccaagtccaggaccacgcctggctaatttttgtaatttttgtagagacggagtttcgccatgttgggcagacttgtctcaaactcctgacctcgagtgatccacgcatctctgcctcccaaagtgatgggattacaggggtgagccactgcgcccagccttcaccagaaaattttatatgtatataaacatagagtaagcattttttaatagaagaaagttaaaaagacacactaagatccactaagattatttcatagacataagtagacagcctagtgtttttaaaaataaaagtatataagttttggtgtcagaagtcctagtttccgatacagtctttggcactttctggctatatatgctttggaaagtgacaacctcctggggcttcaatttcctcatctgaggaaaatggaagctttatcccctgccgtacctaccttacaaaattgtcagaatcagaagacgtcatgcccaagaaaggactttgtaaagtattgatttcactcattatttcattactataatagtggtaattttctaatatttatcactttcatttcataactaaagatgataggaaaaatctagaagtatcagagttagcataaaaaatgataggaatgataaaaagcacttgtgaaaagatttgagtgatttgtagtgattatgcatgagaaagagaaggctagtaggtaatccaataattgtcttaaagcacttgaaaactactccagtgagctaatactgatgaccagactaggagagttcagcatgagttatttaggctaactaaaccaaataactttccagtagtgaggttactacaaagtagaattggcctctggggaggctgtggaatcccatttgtgacagctgtcccattgcctggggatagctaacctccagtcttgcctggagtcaaggactgttaactccatagactcagggctcccaccccttcagctttgtgctctgtgcctccgtatggatctagggtgttgggttagtgggcaagggaacttcttattttcctggtcataattgtttacttacagaagaagaagcaagcagttgaaagacacaccctaaatatataatgcatcaagtgtattttcttccttgaaatacactttacttttccttggaaagtaaaatgtccaatttttattttaaaatattggaaacaatattgtttactgagtatagtaaacaacagaacatacttctttccaaggttattttcatttaaagtgattgagatgtgaaagaagacaagaaaaaagaggtagactaggaagagaggggcaaagggaaggagtctggagtgtagggattcagacaggcaaaggcagtgacccatggggaggagtggaggaggcgaagaggtaaggcaaggaaggaggacgtggagtgggaatattttaggtttagtaaagggtacaccccactcttcctttggactgtggaaattggcattgttatcctttatcctctgctttcaaagagttagttagctggttaatcactatgttcacatcttcaactatctgatacctttactttggtccattacttgagagggtcaccagattggacaatagaagttattttctatgctttggtagcagtgacaaagccgttttattcagattaaattgaaccaaatgttctcaaactagaagttctccacttcaactgtatggagaggataacgtgaatcaacttttttatttctagaatttcaaccagtattagtataatacgttactctaaaagcattgcttcattatttgttatattataataaaaaattgtcttataagctacatttctagccttaaagacttaaaaattgagactgtaccgtgaatagtaagtgtcactgtggatcctttttggaaacaggagaagaaaatatctatctgtatgtctgcctatctgtctatctatctgtccatcatccaatgttttgatttttttttttggagaaattatttcccatttttccaaagccttggtaatacttagagttaaatttcttaactagattaattgcagaatggattcaagagatgctaaatggagatccttaagaaagtgggctatatattgtgtacagtgcacattgctcaggtgacaggtacaacaaaacctcagaaatcaccactaaagaacttactgtacccctaaaactgttgaaataaaaatttaaaattaaaaaaatatttttaagttaaaaaaaagagaccgggtatggcggctcacacgtgtaatcccagcactttgggaggccgaggcaggcagatcacttgagctcagggctcgtgaccagcctggccaacgtggtgaaaccccgtctctactaaaaatacaaaaattagccagttgctgtagcatgtgcctgtagccccagccactcgggaggctgaggcacgagaattgcttgaacctgggaggcagaggttgcagtgagctgagatcgcgtcactgcattccagcctgagtgacagggtgagatcctgtctctaaataaataaataaataaataaagtttaaaaacaaagaaagtgggagtaagtgtggcaaattatctttgatcatctaactaaggctttgctatcaactaattttgatcttccacttcagagaatagttctattttattattcagtgaataagtatgtgtgtgggcctaactgcatggatgctatagatctcttactttaagtaatgtagttattacataaagactgctttgtagaaagttatttgctaagttgcactttagatttttcattacgtaaggcactgtagttcagtctttaaaaaattcagtagttattttttgctttgctcaggtctttttgaggcaaacaaaaccaaccaaccataaaacaaacaaaaaaattttctctggttgtatttcccaaaagacttatatattggtacctggggaccactcagttttcaaaactgagtatccaaagctgtcttgaggacacataaggcttagtagtcatgaacatatttgttatcaagttaattatactttctatccaagggacttctaaggaactgcaaaattgtcatctattgtaaaggaaattttaattcccagggaaaattagagaaagaggtttaaattgttctaatttatcttggaattgaagtaatatttaaattaaaacattgtgcttctgaattctattgtggaaaaccagtctttgcctagggcccactgatttcaattttcagttctgcccctggtgtctgcccctactttgtcttgcagtcttgcatcttaccagacaaacaatctgagattaaccatcagtagttaagattgagtgactggacaatagcgataactgccagtgagataataactgaactttcttggcatgcttctcataccagctttctgaaggtatgtgtgacagttttccagaatgactcccagtgaaactttgtttttgtggaattcatggcccttatttcactctagattcttttaaactaagccttagggttttatattcctgtagccttataccattaatatttagaaggattttccagtgatttatgagatgggagcattggcttagaaaaattgatccattttagaattgagggagtaaatcactgaacattttaacctagtttactagacagtctctttcttttgtttttaaatatatccattctgaatcttatattgattttgaaactggttattgctcctatgtaactgtttaagtaaattcagagcactgtatctttggagatacaattattataggatttaatttcattaactcttgcaaagacctttggacttttgaggttacaaaagcagtgtttttggataatgggaggtaactaacctgacttgatctactgcacatcctatttcgtacttcatgaaaaagactgggtattctctactcttatcttgaacacaaagacacatcagcatgcacatcagcatgtgagctaggaatgggagaagtgtgtgggaatgtaatgtatctgaaagaatggaaaattttgtctttctctccctttttcttggattatttaaattttttatgtcacaaagcagcagaataaaatttccatcataaagtattttactctattataacctcaattttactgagtcagaatatgctcagggctgacacaggagggagaagatgtttccgttgtatggtaagtctgagaagaagcagattggtgtctctgttcccagtttttgaagtgaatttctggagtaagcatcctaaattgagaaagaacataaatatttctgtatggaaatgttagaaaacaagattctggtaattagtatgaaattttactattcatccctttagattgtcgtggttgcattaattgaccaacattgctttttaaaaatgctgtcacttctccttgtttatatctatttttgcttttttccatacatttgacattttctttaaaatctgggcatataaaatgctgattaaaaatatttttatgtggagttgaaatcaatgtgtcaagattcttcattgtattttccttcaaaaaaggctgctgtaacataggaccaaatgttaagggtgcttgctggcataactccaaagcagtgtttttggataacaggagtctttaattcttaggtataattgatatttttagttagtacttttttcagctttgtttttggtttgatttggggtatatgtatgtatgtatgtttctataacaagttttgaatttttttgaagacttatcttcttaggccaccaaagcaaattagttcagtaattatagtctcagtttaccttgtttccctctcagtgggtcaaccaaaaccgcatggcgtactactctctgaagcctctactaccctgctcctccgtgttgacatgtggtcaggcaagccaggacttactcacatcagctacatcagttactggggtaagaaactctgggcttttcagatactgtcctccagaaacaccagcaccagcctttgggtttaagatcacctggtgagattgattatctttagggaatggtgcagatgggatagtttctagacaatttgggaacctcagaaatgggagtacttatattagaatgacataaaataactttttgccccagggatcttgcagtaaagattatcatcacagttggccataccatgaacttttctaagttatttaaatttaccttgaaatgttatcagtgtctgctgtcacagagaataaatgtatctggtattaacattttactcatgcttgccttgcctttactaaatcttatcttgtaattgaagaacttgactatttttaattctgaatacaatatgcctcagaataaggttttaagctttaggtaaggtaaagtttaactttagtttgtatctgtgacacctaacacaatactaaggaattcaactgaatgagaaatttattctaggcatccaccatgttcaaaacatactaagtacctaggaattacttatagaatagatgtaactctattgaactataaatcaaatatcaacatacaaagttgagtgagcagacttgtttgcctcttttcattttttgttacactgatggataccacatgtcttaggtgattgggggtgcggtggctagtaattactgccattattgtctgtgatacagcagtgttcagatagcagctattctgcttataatcagatgaacaagatattatgtttggctttgtttatggaaaaaaagaaattttattaaattgtggttagaggcctgttagcataaaggatgaatggtttcttggaattacaacttgaatattttgagagaaacaaatgaaaagtatctcactgtagggctgaattggtttgtgaccttgcttctctagctgaaatctattgactctctcagaagtattgctaggagaagaaataatcctataaaaggacattaagcaatgctaagaaaaagatgatgataataataatgctttcagctcaccatgtgccaaacatcatattaaacactttaagtgcattattacattgaattctcacaaccctacaccatatcctcattttacagatggagaaaattgaagcctagaaagatcaagaaactttctccaggccataaatagaggaatcaggattcaaatcagatagaccccagggcttgttctcttcaacaccacattaccctacattattattcaattattaaataaaaccttgcattagtggcatttccaaatgcataacaaaaaaataaaaaaaagtaacactggtcatatgtatcgtattttttataaaaattacattattccatttgtttttctggaaatttttattgcattgagttgctagaataccataatataaaacttggcattttctcaataaatgtgtatgatgctgtagtaggtgtttaagatgtctttggaacaacatttaatttgtaagatcttttttattaatgtgctgaattaagtaattatttctttcccactttgggtatgttccatatttgattttctgctgctttcaagaagccatacaatagaattcttaatcccgttttgactcaacttctttccaaaaactaaaataaaaataaaagacatgaagcacttcttttatcttattagaaaagccaataaaatgaaagaatcttcaaagcaattttttcaaaatataaaattggcagagtattttgtttatgaaactatggaaaccaagttgagatttataaacaaggacttcaaaacttgttttgctaatgcagtgtcactcaagaattcactgaacctcacaaggtaaacttgcagagaatgtttgttttgggaaatgatgatgatgacaggcaagaattttctaggtagaaaattgaattttaattcagctaccatacaattcactcttttaaagtatgaaagtcagccatcccattacagggtatatacccaaaggactataaatcatgctgctataaagacacatgcacacgtatgtttattgcgacactattcacaatagcaaagacttggaaccaacccaaatgtccaacaaagatagactggattaagaaaatgtggcacatatacaccatggaatactatacagccataaaaaatgatgagttcatgtcctttgcatggacatggatgaaattggaaatcatcattctcagtaaagtatcgcaagaacaaaaaaccaaacaccgcatattctcactcataggtgggaattgaacaatgagaacacatggacacaggaaggggaacatcacactctggggactgttgtggggtggggggaggggagagggatagttttaggagatatacctaatgctaaatgatgagttaatgggtgcagcacaccagcatggcacatgtatacacatgtaactaacctgcacattgtacacatgcaccctaaaacttaaagtataataataataaaataaaaataataaagtatgaaagtcagccaggcatggtggctcacgtctgtaatccccactttgggaggctgaggtgggcagatcgccctaggtcaggagttcgagaccagcctgggcaacatgatgaaaccctgtctctactaaaattacaaaaattagctggatgtagtagtgcatgcctgcaatcccagctactcgggaggctgaggcaggagaatagcttgaacacaggagacagaggttgcagtgagccaagatcgtgccactgcactccagcctgggctgggtgacagagcaaggctccatctcaaaaataaaaaaaattttaaaaagtataaaattcagtgggttttaggatatccacagagctaaacaaccattatcactatgggattccgaaatatttttattattctaaaaaagaagcctccttgtccataagcagtactctccatcccctaccaccacccctttcctaggtaaccttctatccattttttatctctatgtatttgcctattctggacatttggtataaatggaatcatgtaatatgtggccctttgtgccttttctttcacttaatgttttcaaggtacattcatggtgtagcatgtatgaatatttcatttctttttactgctaaataatattcagttgtgtggatataccacagtttgtttatccaccaatcagttaatgtgtgtttggatcagcttattttgtttatactaaaattctgaagagtaggagcaggaataccatccatgctagtttccaactggagaatgataacactcttgccttctctctcaaattaaacaaaatcacagccaatgaaatgaagataccttcagaaagaaaaaccttgacttatttaggcaatagataaccatttttttactcgttaaaatgcttcagtaagttaattttgcttctcattactttgcctagcatttgctagtgtaaattcattgtctagaactccccccaaaatccacatttacaaaaatataagaggaaatatcccctttcaattaagtataaaaataaccaaggtagtgctatgaaactaaaagtataaattagcattatgtttcctcattggctttgttggattagtcctaaataacccaaaaggaaacataaatttcaatttgtagggagttttgtgatctgatacttttaagtgggtgtttagcaagtggcaacagaagaaagagcactagactgcaattacttactgcaaatcagaagctgctggaaacactgcttactaattgtataccaaagcacttgagtaaaaaagtgtggaagggctatgaaagccctgcttctcctgttacttacttctgtaaaccaggacacaagttgagtgagctgtgcatttattggagctctcttatagagcacgcagatcctgcatgtttggaagttacaacattgaggacgtgagaagaaagcaatgggggctttctgtgtatgtgagaataaagcaacgggggcttgctgtgtgatgatgctagtttgtaactactattatgataacaataacaatgatgataagagataataatagcttttattcattgagtaattattctctgttgggctctttgcatctacacgttacctcttagcatcacaaccctcctggataagttttattatctctattttacaggcaagagaagtatgccactgaagaatgaagtgacttttccttgtgtcagctagctaataagtaacagaactgaaattcaaacccagatccaaagtctctctctttgaactagtcaaggatggataattaatgtttgacattaaaaccatagatgcttcaaatccataatattgatgataatatgacttatgtggcccaaaagatgcagcctctgcatgcatgccctaagtaaacctgttttgccagcttttgttccggatcttgcgccttcacagttgcccctttaagcttatccccacagcttatcatcatcatgctgtgatcccaggacattcagaagatgtgatagagttttcatgggataaacctgtgaaccattccctttcaatatcttcagtgcccctttctgacttatagaatatggagtcagtctaaattatttaaattttcccttgaggattctctagccctatcctagatttgctcctgggttgccttggagaatcaaatgagttcttccctgagggggaactggaaaaatcctggagttccccaggacttgaggatttcctggagtgacctccttcttgtgagatccttcagatccatggtcccagctttcaagtatgtggagaaaagagcctcagtagagttatctctgtccaaagccacttcataaaatacttccttagatattttaatgcttggcagtcccatctgtaacattacagggattggacaattcctcacatggttatgttctttggccagcacagtattaaaaaaacaaaacaaaacaaaaaacgctctatattgtttttaggaacaaaatgcttgctctagttctccacggtcttctccaatatctattgtatcacaaccagccaacttccctgattaacactccctgcctgacccttaaaggtgtttgtttctgaaggtactggaagtgataatattctaaatttcttccagctctactatcctctgattctctccttattttcagtttacaaaaaggatttgtaccttttttttcctttggccccacacttatgtcttccttgcttcctttcattctgcttttctgaccttcccttcagtgctcagacatcaagtgcttcaacccactcttagctgtccaagttctctgccatggcctctttccctgtctcaggaatccagccctcaaagtactcctcttatacccctactttactcttaataaattttctatctctatgaagaatcatgaaagtaagctctttaaattgattcataatgaaaatagattattcctggtatcttctattttaccattaggaacaagggtgggactgggatggagaggtgcttaggagctccaatgagtctttaattggtcaaggccagggtggcgaggatgaaagggttgtggaagggaaagacctaatctgctgattttttcacacttaccaaagaaagaggagaaaggctcctccaggagcctctttacgtttttatgttgaaaagaggagctgatcgctgccccacttagaaatgtctcactaccttctctggagaggacagcttctttaaggatggctctgccctcagccatacgtgattttttaactcagtgtgtcttccttggcctggatgcagaggatggaagatggcgtccttactgcttcacctgttttaccacaattttgttaagtggagaaattatgggtaattaactcaagttcacacaaatgctaagtgttaaaactagttctcaagctaaagtgtgtctgaaccccaaagccaagcctttgctgtcagactttctgaggctctcagaatcccccattttcaggtacctgtggtcagaggagggagaaatcagcacacacattctcacttactcttggattctggtctttggtgggagcttgaagcaagtgcttgttagccacatatacttttttttttttttttttttttgagacagagtctcgctctgtcgcccaggctggagtgcagtggcgcaatctcggctcactgtaagctctgcctcccgggttcacgccattctcctgcctcagccttccgagtagctgggactacaggtatgtgccaccacacccggctaattttttgtatttttagaagagacggggtttcaccatgttagccaggatggtcttgatttcctgaactcatgatccacctgcctcggcctcccaaagggctgggattacaggcgtgagctactgcgcctggcccacatatactttttctcttgcccagctggtcttaattgtatatggtttagatgtctcttaggaatgcctgggtttgtatgtttggtgtggtaaaaaaaaaaaaatgccatttgtgtaactgcttaccaacttaccaagttatgatgaataaagtaattatgtcaaaatgtttaggtttacattgtctggagcttataattttataattgctgctaacagctagtttttcttttatgttttcacatcattttctgtcctcatggaaagtcttaacctgtgagaaagccatcggtatcttcattttagtaataatgaaactgagacttagcttaccaacccacatggtcaatatcaacacacaggtcttttgatttcaaaacctacaagaaaactctgttcatgtatgtataatcattacctattatgcacatggcatgatcacctggtctctataaagcaaaaacaaaaagcccgacatgattctcttagccttccaattccgaatgagtatgggttccaccatccatagtcaccaaggtccttattcattcaagatccttccttagtcagatcctgaggcttttgtgtgcactggcagcaatggcatcccacgcttccctgacactggaggatacctacagaaaagatcctagctgcttgccaattttaaggcacatccatgtagtagagtgagagcctacaccgacaaagtattgtggtttcttcccaagaaactatttcttaactattttgcctggaaatctccatccacagaggcagacagtaaaagtttccaaaaatctttcatcagtgtctttgagatagacttgcctctgccacctgggcattagtatcaggccttgatattgattattacacattgtatacatgtatcaaaatatcacactgtatctccaaaataggtacaatggtctgtcaatcaaaaattataatgcaagaaaaagtgttgttttcatgcacttggaatgggcctttgcatatgttatctgtgtaatgctatgcattgtcatttggaaagttttagttcactagttatgaaaaccttccaaatattgacatattaatttatgaaataacaaaatgttacatttgttaatatgaattaataatgctggcatatgataaagaatgtgtgtgtatgcatttgtgtctgtgtgtgtgtatgtgtgtatttctgtgtgtgtgtatgcgtgtgtgtctgtctgtgtatttctgaggcccctaggcattgctccatctctcctctatataattcttaagaaacattccactgggctgcatttcttggcctacaccattgtccctccctctatattgtttgtttgtacttcaggccaaaaacaaaacaagcacaaataagcacactgaacaagaaagagaaaagggcccttaaaatgagatgaagagagagggtgtagggctatgtgttgtgcagaatgattgaatgaatccaggcaaactctgatttggtttgtaagttctattttatctattttagtaacctgtattgaaagcctggacccaaagagctgaggtcctaattcaatggtttctgtctgtgatacaaaaagtttctggctactcactaagaggtttgcttagagtaaatccctcagtcaagagaaacatattgttttgaattgaagctcagtttttagttaacaaaactatatgcattccaacatacactggttttgttccttttcttttgagctggatatacatgcatataatacaaaatcaaaagatatatggtggttaacagtgagaattcttccatcccgttcctggccccctgacaaccaatttcttactccagagtcaactactatccttgcattttttatatccttcagagatgttgtatgcattatcactatggatgtaagtttttgtttttttcataaatgttatcatatcatacacactgtatattatgccttagcagtttatacaatactgccttactcattttcatagtatacagaattccatcaaatggatgtgaactaatttatttaactgccttcaattatttctaatattgtctatcatatttcaaggaaaatgcttatatgaatgtcattttacttgtatgttagtatatcaagaggataacttcctagaaatgtatcttgggctcctctaagaaaataccattgctgagtggcttaaacaatagacatttatttctcacagttctagagcaggaaagtcctagatcaagatgccaacagattcaattcttagtgagggtcctcttcttagcttgcagatagttgccacctagccgcgtgatcatgtgacctcttctttgtgcatgtttagagagagagctgtggtatctcttctttttcaaggatgttgacccccttatggggcttcatcttcatgacctcatcgaaacctgatttacctcccaaatgtctcacctcctaataatatcacattggggattagagcttcaacatatgaactttaatatgttgaaaattcagctcataacatgactgggtcaaactgtgtaaaattttggcagatttgctattgcttcacatagggtcctacccgtttccaatataagaaagagtaagactttgaaccttgccaacaaactgtattatcaaattttgtgatgttccctcgagctgataggtcaaaatgatagctcagtatagtttcaatttacatttcttttgttaatatatgaggctgatgaacatttcatatgttcatcatttagcactttagcactattagcactttatttttctaagaagtaggtattcacagtctacccacttttctgttggattgatgatccttttcttatgtgtatgtgaaaattgtcatttttctttgatataagctgtaaatacttttgccagtttgtcttgtgtcttgacttttgttaagggtgtttttatttttcataataactttttaaaaatttgtcttctattgcatctgtaagatgaaattataaattacttcactgcccatctttagtttgagaatctttatgggttgttttttttttttttttttttacttttaagtctttgatacatctgggactactgtggtacaggttatgagataagaatccaatatctttgtttgattttattgttttgttccttcttttaatgttactcaggtgttctgtatctgtttatttcttcagaaaaaaataggttaatctatcaaataagggaacatatctcaaaaagtcataaaagggctaaattatatgattctatatgattatctactgatttttgtcactgtaaacataatctggataattcagatttagaatgtgtgtgtgtaagtaaatatattttaggacagttcttaacttatcagttaattgtgtaactcttgtatttaatttacagaatctataaattacatttatatagtgaagatgagttaccttgagcagccagaagtagcatcaataccaagatcctccaaggctgtatatgaagcgttactgaatacttaagccaatattgattgctctctgctctgtttccactgacattgattgtctggaccatatatttgagtggaaaatcatctttcttaggatgttatgtctattgtatatgtcttatctaccttccccagaaaagctgtgaactccttagcagagagatcatgacctatacttctatttaatctgttcagcaaatattgagtgtctaccatgctccaaacactatcctgaggacaagagagacaaagagaaccgtaggccctgccttcaaggagcacatggctagtggaaacagacagtaagtcgacaatgacaatacatgtgaccatatttacagtgctccaagaagttcagaaaaaagccatctgatttggactgggaagaacattatggggatttaaggagataaaaagtgaaagcatacttgaagtgctaggcaaatgatggatgtaaagtaagtttaggaaagtcctgagtcacattttacttctgtttatattataagcattgtgtctcaaactgtagaatgatgtttcatttatttggctttttctaggaaaaagaaatgaaatatttttcctaagaagtgaaaagaacccataagagctccagtttgcaaaatgctagtctttttattgatccctttttttttttttttttgacatggagtgagtctctctctgtcgcccaggctggagtgcagtggcgtgatgtcggctcattgcaacctccgcctcccaggttcaagcgattcttctgcctcagcctcccaagtagctgggactacaggtgcgcatcaccatgcccagctaatttttgtatttttagtagagacggggtttcaccatattggccagggtggtctcaatttcttgaccttgtgatccacctgcctcggcctcccaatactgatcactttttaaagtgttctaaatgcatgttacattgctttcttaatctaactatactgagcagagtttacactttatactgagcagagtttacactttatttgaagtttcagaaatagcattcagaacatcttcttttgtacaacacagcaacttcaggggctcttcaagatttcccaggttactaggttcttaaggttcactcttttaagagagtttctttctttcccattgtctaagtctagactaagatccaagtttacttccagcatttctttatctttatccttcttcatttgcagcttcttcttgtttatgctttgggaaaccagatgaagaaactggtccaaattacagtatacctaaaaggagaatttacagggtctctgtggcagaatggagttcccgcttgtaaataaatataaaagttttagtgcaaaaagatatgcaatcaatttttactgtcatcatatctgttaaaattattgttgatttctctcagcaatgttcaatacagttgaggtttctggataagttatctaagtatatacggagtatggtcatacattaaaaaaatacaaaaggtttcagacagcatttaatgtcattcttcaaattcttattaaaattgcatcgtatttatctatagacaataattatccacctaacttgtttgaatgttctataataatgcaaaatgtctatgattgcaagaaaagtgagtttttaaaatttttggtcttttggtgtgtttttttctcattgtaactgaattgcccaaaaatataagcttggtaaaagcttattacctcaagaaatatttcatgtcaaaacagagcacatgttaaagtaaaaacaattctttagagtgagaaaaacattatagctataaaaataattaaagagttttgactattaaaaatgtaaccttaagtcattaaatgttcattactcattcaaagttcttgcagttgggaatttactgatggcctatttgcagttaattttgaggtttaaagtaaatgaacttaccagatataaccctttggagtcctggttagaaaacaaaaaccatgcagctactcccatagctctacaaacctgtggtgctttcaagcgtcaatggcggaacagaatgagtaagagcagagacaagggggcagtgactaagggactttaagtcatgagtctaattcccctgggacatagctagccttcacacagaaaaaacaaaacagaaaatctccaccaaaaagaagcattcttcgatctcaagcaacatccctaactcatccaaagtggtcatttgtccaagggggactagatgagacagcatcaacccagaaaaattaaggagcatctggcagatggggaatcccaaacggcagcctcgctaacagagtaaaacacatttgtgagagacccacaatggaacatttcagtccctttagaaagtttcagaggtggcagactttgtagtagctgagaatttgtgtttaactaaaaattggaagattatatatacttatacccacaaagtattaggcaaatggtaaaagttttaaaattattgatactgtggtaaaatttacatacctgaaatgcattacaattcagtgacattgcatgcagttttaaaataacttagctatatttagtttttctagttgaaaacaagcgtttttttttttttcaacctcagtgcaacaggaaagtgaaaaacaaaacaaaaacccatagtaagttgacagtaatctgattgggtaactgatttttcttctgtttcgagagttatttagttatttaagagttacttaaagagtacaagattgaatttgtaacttgaatttccagatttagctagagtggcttacaaaagcatgaaaatggccaggcgcggttgcttacgtctataattccagcactttgggagctgaggtgggtggatcacttgagaccaggagttggagaccagcctggctaacatggtgaaaccccgtctctactaaaaatataaaaattagctgggtatgatggcggatgctctagtcctagctactcaggaggctgaggcaagagaatcgcctgaacccagaagccagaggttgcagtgagccgtgatcccgtctccaaaaaaacaaaaaagaaaagaaaaagaaaacatgctgtttccacagaattaatttgttacaatcaaacatagttgctgtcctatgtttattaatataatttcatcatcatcatattttcaagttactcttcctaaattttttttacctgcttctgaatctctgttctttggttcccactcttctctttgcctcatctccctcactgaattgtgtgtttcatgaaaggaaagtttgtttcctatttagggttgtggacagaagattggtaaaatttcttgacacctactattgaatcaagtttacttaatgtaaaacattggtgttcccagttatttgtaaatctacaaaagatttacagtagaagaggcaaagcctgtgaagtgtcaacataaaggctgctgctgctgtcaacatctgttcccccaactgcatacagaactctaatggggcagcccatgcctcctgaaatctgttaccaagaaaaaaaaaaaaaagcctaatagtacaatactttttatttcttaagccacaacaatagtgaaactgtatgtgttcttttgcagttttttttccattcttcataggaaagatgctaaagtataatttcatttagaataccatatataaattatatatagatgtcctttaagaattataaaaataatgaaaattatatttatcctttatgtcttatgttttccttaatatttcctaaagaattgttatatatcagaaaacaattcaaaatattcagaattattagcctcttaaccactgtgtttattagcttaaactagtaatagagagcaaactggcttttcttcttagcataggtttttggaaacttgaactcaaaaatcagtaaattcaaaaggagttatagtttcagagtatttggcataatatatttgaaaagaatattcccttcacttatctttgtttgcattagacttgtgttaattatgtgattcctctccatagcctcaataataaagagatctcaagttggaatgtatagttctatttttcataagtatcatttaaaaaccgatttataaaccctatgacttatgaaatatttgtgaacaaaacacccaatgccactggaataattcaaatgaaagagggtcttacattgagcaatttgtcagtttaatacctgccctttacaattgctctgcggttgaccctttagtcgtattttgagttagcagatgaaaataaggtttcccttgaagtagtggttgctaagggcaactggtactgacgccgaagacgaatactctatctccttagtataatgcctactttgtgagctaaataaagagctaaattgtagagaagaaagttgtacaaatgtgaaatatcaagaaaggaatagaaacaggaatattagagatgggaaaataagaaaaagaattactataatcacttttttggtaactgcctggcattttggacagatgtccttatctcctgggcactctgcatttccacctttcatagctggaaaattaacattgttcactggggcaagactttcttttgtaatatgaattcatgtcattagttcttagtggattttgacaaaatggaggtgagactgtgatagaaatatttgtcaactttttaggcttggattttcaagcataaatattttgtgtcagtagaattgctttatgctatttggacaacttgtagtgtgcagggtcagttatctctaactccatgtcagtacagattgttttatgaacatgttggtttaatgagagagtcttcatatagaatgtgttataacagtgttcataatttcttcgaccaaattgcacttaatgtattcattgctgtgatttcagaaaggtttttaaaaacttcattgtatcctaggcaatgctgtttctaaagggtgagttcattactcctttatgagcatctgctcgatgccaggtgttttgcctgtctacaagaagcccacagactgggaagatggacataaaatcaagtaattacagatgagtacactgtaagctataatcaaggcataaatttgatgctataggagcacagagtgagaaacattcactgagtaagtcacatttagcttgcaggatggtttggagtttgcaggttgtgcgagaaacatctgcctgcagcagcattccttccatgattatcaaggttcatgcaactgatctgtttcattgcatgtatttgaatgtctctttccttcctctacacttctagaattaatttgttggttaaggaagataactcagctagaggaatcagtgggttttttaatatgagactctgcaaatacatttcttgtaagtgtgaacattttgaaattttctaaggtgatgaagaacaaaatgaaactctgtaggcacagctaggaatgggctctgcaggaaaagtgtcaactttatgttccagatttctcaggacagtctagactccaagtgagtccttttaccctggtagaagtttgcttatcagaccttatgtactgatgctcttgatcatagaaatatggtcaatgtagcaaagagacaaagtaatgaaggagggctagtgaggccctgctgtaatatggtgtaggatttatgagactggaaaagtatgtaaagacatactgtagaaggttttgtatgcaacaccaagaaatttggactttgtcctccaggcaaaggagccatcacatttttcaaaaaggaatgaggaggtggaattatttttataatttattttctgtaaattgttgggaaatggattattttttaaaaagaatatttctaatagcaatatagagaatggattgggcttaagttttcaggaaaaagactaactttgaagtatagatttatgtgttactaacttatagataataattaaagccataggaaatgggtgggagaacccaaaggaagcatgtggaataagaagacaagcaggaagaaggaaggaatcattaaaagcatatatgaatatgaaaaagaggagaaacgtgcacacgagacttggaaggagtgtttagagagttagaagataatcaggagagtgtgtttgggagcaagatgtggagagattttaagagagaagagttgataaggagtgccaaatcctgttagggctgtaggatgagacttgaaaaagtggatttggcaattaggccatttgaaccttagcgctggtaggttcacttcataaggtcttctttgttagaaaacaaaacataacaaagctgttagtgatgggattcaggattctttagcagggcaagggagtaaaagtttttctctggaggaaaaaaagggtaagattgcaggaaaatgaaataaatgttagggcccagtaaaggaagccctaatcatagaattgtaggactagctattactggttgtttaaattgtaccaccataggtcaaaactccacctaaaactattccggagaggtgaatattgtaattgcttatacagaatcctaattatgagctaataagaagaggcattaaaactagcaccccactgatttaatttggagagagacacttatattagctgtttctaagacttatcttttaattcttcccaaaaccagttatttcacagttggctcacagttttgaaagtagaactgctagagtaaagaaagaaatttacagcttcagatgtttagtttctgaaggtgtcagaatcccatatttctcttttatttatttttcactgaattttggagaacactgattaacttaaagttttagatttaattttttcctatgggccattacacatgaatgccagctgtcttctgtcaagtaaaaactaggacagtcccattccagcccaccctgttttaagctacagggtcactgagaatgtagtaagaaattatacattttttgatcatgtaaaatatggatccttttttttctagtaattactctcttccatatttcacaatttatcatttctgtgaggaatagcagcacaagaaatatacaacatctgtgacccttagaaggggccctcagagaggccttgcataaagttgtgcccccctgtggctgggcaggaagacttggtctgcagataaactagctagataatggatggtttctgttattttggtctgaaggcttgatatgtaagagatgcatccttactttgtgcctgtcctttcttctcatggattgagagatgcagaggggttatgtgacagagttaggagaaaaaacattggcctgggtaggagttctggcctctagtgttgacctgggcccatataaactctatagctgatggtgggcaagtcaatgaagctcactgagccagaatttcctcatctataagataaaggtggttgtgccaccctgactacttcatagaatggcagtgaggacccaaggtaagaatacctggacagactacctcaagaaatgtgttattgtcacgatactggaactacacctttttttaaaataatttcaacttttcttttagatgcaggacatacatatgtgactttgttacatgagtatattgcatgatgctgaagtttgggatgcaaataattccaccacccaggtactgagcatagtacccaacagttttaaaacctttccccgctctattagttccctatgactgttgatgccatctttatggccatcagtacccaatgtttagctcccacttataagtctcacggagagcttttgtggtattggttttttatttctgagttaattcacttaggataatggcctccagctgcatctatattgctgcaaaggatatggtttcattcatttttatggctgtgtagcattccatgatatatatacatataccacattttctttatccagtccaccaatgatgggcacctaggtcaattctatgtctttgctattacggttagtgctgcattgtacatatacctctctatatatattctaggacaactgccgtcaagatatttgtacacataaatgaccgttgttgtaaaacatagcattgtgtgtctatatttcatgacttcaatgctgtttcaaaaggaccttagtttttacctaaactcaataacatttttatttctattttttctttatgattttttaagcttactgaaaagtacagaaaacaataaatattcccgtactttcctcttatataaaatggttccaccatcttgtcacatttccttcaaattttcttacaacaaaacaaagcttacagaggttgctgaaaccccacctctccatcccattcacctcttttcctctctgaatgttattatctttaaatgttcacacaatgacaaaaatcatgtaacaacacttctcagaacatatacatgccatttagctatgcatgactgtgtttataatatataatattacgtatattggattataaatattatgtatgattttatataaatatatatgtgcaaacatacacatatacacacatacacttgttttgggaagatttaaacttgtacttaaattgtttcattcaaaaataaggttttcaagagctgggcgaggtggctcatgtatctaatcccagctattcaggaagctaagatgggaggatagcttgtgcccagaagctcaaggccagcctgggcaacatagcaagtctctgtctctaaaaaataaaaaataaagaaaaggtaacaatttttttaaaagtgagccaaaagtaatgttttgagagattcagccatattgatgcatgcagttttagtttattttaacatgagaagagaatgtggctattaaattgctggtaagaaggtacaaatatctagtagaccaatttggaaaaaacaagtaaatttgggagaatgtatatcctgtgacccagcaatttcacttctccgcatgagaaactcttacacatgtgcacaaagatatctaaaaggttgttcgcagcaatggttttaatcatgaaaacctggaagtaatttaagaggccctcattagtaacatgggcaaacagtggaatattatacagcagtgaaaatagcattttaataaaatgaattatggtaatcagaaaaattgtcaaactattaaccacatataaatctacaaacaatacttgataaaatacgggtgtgaaaaaatttttaatattaggcactttatgaagcaagatgttttctcctattcatcataatttttacacaatctgtttcctttttaaatgagtgtattaggcttgcatgagataattacagaagaataataagacattttcaaaaaagatgcaggttaataaatgggcaagatctattttgcaatttttctccaacatttttgtgtgatgctgagtggcaactctttatctcttagtgggccacaatcaaagaactccataaattagtgttatttataggttatctgctttaagaaaatcttgcatattaaaacatagacttaaaaatatatagtaagctggggatttttttaaatagaggcatacttggatttataattggaaacacctttgcataggaacactcccagtatcttaaatatggcttactatatgaaatttattttttcaaagcttcaagaatacatatcttgcataaagaagaaatatatatagtgatagtagtaattttagcactaaataatggttgacacttcagtgccacatattagtagctctagtgataaaactctatcaaagatgaagataatcagtttactgctaccccttacaaagtctgatatttatttgaggtcaatcgcggtatcattctttaatttcatatcttgtcatgttcatcaccgtgaagttgaggtaaaattcttttaactcattctgtaaaactgttaagctataaatcagatgttcattaaagtcaaatagagtttagttttgtgatttcattctcctcaagaatcattgagcgatcttttccctgtgaaacggtacttcagtgaggattgattttgtagctcagataggatggttgtttttactggtcattccccatgttcatttatcctaatcttaccaattatgcacttctgggtaccaattgaactgtggaaggagcaagtgggatgcaagggaagaggaaagggccatatagaagttataggacacaataactcatggtgggtcacaactttatttcaagcagcttcttctctgaaatctggtatgcaaattctagatttattcctagatttaaaccttaaattctagatttaaaccttaaactatatacagtgaaagcagctgatggtggtaaaacaaactgtaatccaagatgaatttcagaatgagaaaatttagaagaaattaggatataattccttaggtttctgtgaaaaataagcaaggcaggagtgatgaagaaatatttggtaatgaaagtcaagagaattacaataaaataaattacttaggacatgagtttagttactgcagttttatgtggatgtttacatttttaactatttcacctgttatattgttttattaaaagggttccttttttcagctttattgaggtgtaattggtaaatggatatgttaattagcttgattatggcgattatttcacaatgtatacatagatctaaatatcaatttatataccttaaacatatacaatttttactaaggaagttcttggttaaacaaaataccttttcaaagtgtatcaactggggacggtggctcatgcctgtaatcccagtactttgggaggctgaggtgggaggattacttgagtccactagttcaataccagcctgggcagcatagtgagaccctttctctacaaaaataaacaaataaataataaaagtgtgtccgttgatgtttgtaattgatttctactcaagtaatcaagtcagtagcttcagaataaagttattctttattttaaaacccaaataggtaaagcaccagtaaaaatgaatgtatttagacttttttttttctttttgagacagagtttcactcttgttgcccaggttggagtgcaatggcgtgatcttggctcaccggtaacctccgcctcccaggctcaagcgactctcctgcctcagcctcctgagtaggtgggattacaggcgtgtgccaccacgcctggctaattttgtgttttgagtagagatggggtttctccatattggtcaggctggtctcgaactcccaacctcagatgatccacctgcttcggcctcccaaaatgctgggattacaggtgtgagccaccgcacctggcttgttttgtttgtttgtttgaatgttgcaattatggggggattttctggtcattatatgaacatgttgaaaggtttttaaatagggaaaagagaataaatgttccatgataatttggaagtaaatctgtgtttttttcttcttcttcttttttttttttttttttttttggagagataagatatcactctgttgcccaggcagtagtgctggagtgcagtggcatgatcataactcactgcaacctgggctcaggcaatcctcctgtctcagcatcctgagtagctaggactgcaggcatgcacttccatgcctggctatttttttatttttattgttgtagagatggggtcttgctgtgttgcccaggctggtctcaaacttattgcctcaagctgtcatcctgccttggcgtccgacagtgctgggattacaggtgtaagtcaccatgcccagccgacttaagttttcttaaggatttattatactttaaaaggcagaatagagttaaccgtaacacagtctcgtaattagagattatattgatttcttgttggaagtgccagaaggtacccattctaacactgttttggctgaatcttatagataaggatggcactttggaaaaactaagggtaagatggtacatgaatggttaaaaatctgaatcagctattagagctgaaatcaggtgggaccttctaaattttagatccagattctcttttagggaatagcttttatggaaagggaagtgaaaatatttttctgtagtctgctttgtggtatgaaatactgttgatcagacgactgctcaggttcaaattaacagtgactaaagatgagatcagtggttaaatgctgacaaactgtcatttagagattcacaaattgctccaatgaccaaaaaggaatttaaatattttttatttgtatcagctgagtaagacctctcttggctcctctcttgacctccagaatgaattatttaagtctaatgttttttcttaccaggagagttacattatcctacttggctgcttatatcaagttaattagaagattgccaatttccccactctattagaagctatataaatatcacaattaaaggacaaatgatggctctgctaatctcaagaatttataatttgatgatctaaagatttatttaatataagaatactttaacaacataaatttttgttcttagccacttagtttagttcatgttgggatgaaacggctaatttgaactttggttaatttgaaaatgtagcataatacagttcagacttaagtactcttattttggagtactgttcattacttagactgttaaattaaacttctgtgagcaaaacagttaacatttattgaatctatgtttcgggcgtcaagctttccatgcaacacaccttacttttcacacataattaattgttccttattgttccttcttcatctgtaaaataaggataagaactagacccatttcaaaggcttgtttgaggattaaatgaaatgtatagaaagcacttaaaacattatagagtaagcactcaataaatgtaaaatattaaaatcagctgctttgaccatcaaaaaagttatatgttttgtcatgttattattatgtttaggcattattgttatcccaactcttaaatgggcaggaagctcacataactcataactaacaaagctgggatacaaattcggttctgtttggttttagggtccagtcttttatcttcattcaaagagataaatggccaatctatatatctatatctatctatctatctatctatctatctatctatctatctatctaatctatcttagtttaaggtattctgaattcttcaaacaatttctgccatgaataattccatccctaccatcactattctggctcaggcccattcaactttctcccattccttttttattttgttaagattgattaggttttggtggagtgtctactcttaaaacacaatatccagttctgtggttctaaaccacagtgaaaattgcttgaggtgccacaagtaacttttttcaaactagtaaaatagtacaataaaaatctaaagtttagaaatgactttttaaacctaaattctagcagatacaagattattcctaaaatagcaacccattcactccgccatgatcttatatgctttcttgagagggaaagcaatggtggagctgcaaccagttctccagcaaccttacacaaagcagagacctagcaccggcacattcccagcacagcctcttccattccatccatcatggaggccaggtgacaggcccagaatggctgagcaaacccatccctcagctaagcctctgtggaggttttctttctgccttaattgaccagataaaaaagaagtattaatattacctagaatcatcagataccctgtaattttaagagcaattcacatagttttcactcttctgacatgcgactacattgctgtttactaagttcattgtagacatgcaacagcaacaactgcaacaaaatttccagatgggactttaataccagagatatgaggggaaatttctagtagcttgaattactaaaatgatcctctgaaagattaataaattgtattttggtgtactttgtgtagaaggctatttgttaaataccagttcaaggtaaaaggatgtttaattaaagcttcatattcatgagaatttaacaaaacaatcagccaaattgttttactgtagttgtgcagcagttaactgaaacttacataacgtttaaggctttttaccccaacttcagaccctctgaaacaaactccacttggtttaacctcaaaaatactgctttagacaatttttttaacttctgaagagcaagaagcaaattttatgatatcggttttgcaaataaaatgttgtcaaagaatgaataacaaatttgttaattttataaatagatagtattacaaattctatagctaagagttattttgtaatccatgcatatggagaaaagaaatagagacttgtgggggcggttctttttttgatttttgttttgttttgttttgtttagagttgggggtctcattctgttgcccaggctgaagtgcagtggcaccatcataactcactgcctcaaactcctgagctcaagcaattctcccacctccaccaagcctggctaatttatttttatttttaattttttgagacagagtctcactctgtcaccgaggctggagtgcaatggtgcgatctcagctcactgcaacccccatctctggggctcaagtgatcctgccaagaagcttgatgtgcaccatgaagcctgcctaatttttgtattttctgtagagacagggttttgccatgttgcccaggctggtctccagctcctgggatcaagcaatctgccagcctcggcctcccaaagtgctggcattacaggtgtgagccaccatgcccagctaatattttttttaattttgtgggctgttttttgaggtatttaaataaactccatgttacatcttcatacatcattattagagagaatgctcaactaaattgttacattctttccacagcacaatagaattacagaataattcaaagcaaatacaaattattttcttagcccatcttcttaatttgtaatattgtcccagaatacccttccagaataaattaacatttacaaacaaatgagttttcaataaggatacattatgagtgtgaggttgagcaaagataaaatactaacatttgtgtagcaatgtgaagggctgctgagataacagtaggaaccaaatacacaatcaccaattcatgtggctcaagggaaataaatatgaacattcctgagttattggccaagattaaggaaatacaaggtttttttttcttaaggagtatgaaaaggtttaggaaacaggtaattttttgcaagtgataaaaaagtattaagtgcctggaatgttggaataaatagctatgatcgaagtagagaaagatgtgtttttaaggaacaaaagctccctttgttttgttccactctctgtggaaatgctttaagacttagccctgaggactgtgaagcatcagataagttgtgatgttctcccatgtcttcagcatgtgacccattcacacagaatattcagatacagatatgggttctaattgccaagtagtttacatttccctagacttcattgcaattgatttaaaaaaatggccactttacggtatgatttcacttcgtacaggtacacttttggcagattcagataaaaagaaatcattcatatttattatcattctgcatgttcagcctttttccttccttagaatcagtcttgattacttttaaagggactttactaatctttatcttcctctccatcctgccatcactgacctgcctcaatccctgttcaactctctcttattcagtctcctatgtggattgtcccactgccttctgtcctctgcgcagccacaaggcagtctatttaggatgcagatctgtttctgtcaccccactgctagacccccgcagtggctcctcacaaccagcctatagcagacaagcttttattagagcagactatactccttgtgtgcagaagtggtggttatttgtcatctactctgcccttgagattctcaactccactccagcaactctgaacttcttgcagcgtcctgcccttcccagcatcttatctttgcccatgctgctctttatgttcattctctttcctcttactctaacttctccttttagactcagctcccatatcacctcctccagacatttgttgaatgacctttgtcaatgagcccacgtcctggcatatctgaattactgcacttctatggctggtttgtttgttttgtttttgtttttgttttgtagttaagtgtctgtctcctccagtagtgttaatttctgagggattggaacaatgtcatagtaatccaacaaaatttgaaaggctgaaaatagttagttaaaccatttcttaaaaaatgttttatttggccagaaccaaggtacacagacataaattcctgtaaacaagcatttgcaaagaaccccagttcagtctataaagtagcaagtttaggtggtgtagacgtatgtcagtatttttaagtattccttcatatggtctgattttttaaaaaaacattttccatttatcgaattctatttgtgatatgtgcttcaattttgagctagattgcaagaatgtatatggccctgcaaagaaagtaattacctaggatgaagacatttgatatatttgctgttcctgtgaaatttgtaaaactactcattccaagagattttctcttaaaatgagatttttagaaagggaaaattcattaaatagtttacttgtggctgcttttaaatactaatattttgtgctatactttgtgtgccttaaaacatttggcaaaaccatacttttctacgaaaataaaaatgagtcctagcttagttctttcttaatactgacaactgcatttaacgtaggtgttaattttgttttggaatttttaacaacagtttctgttctagggttgaacttcagactttcagatatgattttattatcaaaaatcaggctttgggcaaggtcatttcctattttcctctcttttatgtgtgtaattataaatctttagagaaatattcctccctctgtttatggagtaacagtaaaatcatgttaaattcatttttgaaaattattttctaaaacctccaaaagcaagctgaaatatttgcaggtttattatttaaacctttaaataatacattcacaatgtgcatgctctctttgtctttattaattactctgggtttttttttcccaatttcttggaaattacctggtgagaaccctgcaggactgcatgcagaggtactcagtaagttaatttaggcaactgcagtaatggctgtctttgcttagcatgatatatgaaatattttgcaaaaaataaaatcacatgtagaatgacatatgcctatagaaattctataatttgatgggttctttcctaagaaaaaggggatattaattgttataaatgataaaaaaaaaagttacttccattcatgtaaatataaagtttcctctttgcttagaattaccttttaaaacatggaatgttactatctgatctttatgtatcttaatcctattgcaaatcttttgatttggtgatacagcaaacaacatgctatgtctttccctaccccactaagtttattacatttaaaagataattataatgctattgcattaaatgtataagttgtttacagagaaaatgttaactttgtaaattttgttatgcccccctcagttcagaaatgtggaggcacaccactgactacacaatagcttagcccacctttcaaattatttctaatatgattctttcatggtgtctttgctccgaataaactgaactagtcagtgtttctccaataatttttattcttttctgcctctctgcctttgctcaatctatttttccatctgatatgctttccttggtgttcagtgcaaatcccaaacacatcattccccttaaccacatagggaggtggtgacattctggatacttccaccatggggcgtactaaataactgcttattcacttcagtctatatagtctagttgtgagaactgatatcctggatcattagaattcactgcgtgtctgtcagttatcaataggttaaaccgcagaaaataaagctagaatatgtctttgtattgaattcatttattcttttttcaatgtttgacatgtatgaataatacagatatactttgccaagatatagatgttagaattgtctctatagagtgaaagaaatacaagttgcttctttgtgaaagcttcatgctttcttaaaacaggaaactttaagtaggtgcagattgacatgttgaagcattttgatgcaactattcttaaaaatgcctagaggttttactgtccaaattttttttttgttttttgttgttgtttttgtttttttttttgttgttgttgttttgctaaagcacagctaatacaataaatcaaaatttgtaaaatgtaatctcttcccctgtaggattttgtggtccctttaaaaaataaggtaggaaagaaaatttcaaagcaattatcagacctaatttttaacacaaaagagctgtcagattttatacccttattactttaatctgggaggtaatttgttgtattgttataatgttgacaggctcaaattccctgaaataaattatcagaataagaagtgtagtataagatagaaaaatttatttttttgggtattgcttcttaccaaaaagaaatgagatttgtgtgtgtgtgtgaacatttaaacgaaagaaaaaataacaaactattaaaatgtagtattatgtttgcataaattgattttgcaataaatattggacaaatctttgctgcagagctgattattttggaattttgattaaatgaggcagcaaaagtcagaaatattaagcactataaaaatgaaatttggttaaaatgtcactcaaggtatagttatgtcttttctttttatcatgaattattgaatggatcaaaacagaagcatcttatctaccactgtaaatctagccatcattatttcttattttattaaagcagaaacattaacatgctttgagtacaaattctgaagtggaaaggatgttttctgtgtaagatgaaggattctgataaatttaatattttatatttaatattttataaaatatcttgttacaattaaaatttaaaagatgccttgctttgcttatggccctgtggtgggtactaaagtatttcttatgtgaataatatgttcatatatatgcataattttataactgaataatctgagtccatatgtgaatgtatatatttacatatttttaatcagcttaagaatatcaatctggaactatttgtttcttattattcccatgcccaaatcacttctcgatattggcttaagtgaatgacaaaatattaactactttaagtgataggttctttaccttagtcagttcctaatacagcaacctaaactgatgtcatagaggccttccttgaaagcatcaaggtgccttctacatatctgaatgaaaacaaaagcataatttaaccgaaaaggagactgtgactactgcaaatgttcataaaaagaacaaaatagttttctatagtaatccacaccatctgtgattaaaaagtatcatctttactattccctcttgtcaaaagaacaatacttagaaccacatgtaataattttccatgctcattcatatatataaacatgaagacacatatagcaacataatcattctaccagtattatacttttaaggaaaattcattatcttaactgtttcttggtttttatatcagggacaaagatgtttagctaacatgatcatacaaactatgagtgtgtgtatatgtgtatacccatttaggcatgtgcaccagccaaggttttcaactggaaatgacaattagctacttcataaatgcttttggctatgcgtgcatattcacaaagccacctgctttttaaaagtattgaaaatttttattactaaatttcaaatctggattttacgaatgttgcctatcctactagagaccagtgttgattaatactcttttaaatatcaaggcagaaagcccaaattaatattagcataattaatataaatcagtactaatttgtattgataatagggatgttctgtatgtgatcattgtgtcctgtgtcctcacctgcaggcattatccttatatgtgtgtacatatatgtttatttcagaattttaaaaatgacgttgttatactttatatctggattcagtagggaatgaaacaaagtttatatttgttaattgaaatgcataatattgaaaactatccaaaaattgccttgagaaaaattatagccaagataaaatgcttaaatattcaatttatttcatgatccttgaatctcctggaacttaaattatatattaacctgataatagttaacttaggacagaatgtaaactagatcccacttataaattttatgtgcacatgtttaaccattcatcagacacagaacttcttttattttgagacagtcttactctgccacccaggctggagtgcagtggtgcaatcatagctccctgcaacctctaaatcttgggtttaagagaccctcctacatcagccttctgagtagctgggaccacatatggtgccaccacaactggctaatttttttattttgcaggctgatctcgaactcctggcttcaaacaatcctcccaccttggcttccaaagtgttgggtttacaggcatgagccactgcctcaagccagaatgtcttgatgaaatctgaattaaaaagattttgtttccaccagctatccagggcaaaacagagtaggaccacattaatccttgatagtagctctctttactcttcctagatttactcttagatctgtacttctgaatagtctttactttcttaatcatatgacctcctacaataaggtttttgttttatttgggttttcgccaatgtatttgttgatatttaaattttaattgcaacaaaatgacaaaatttcatgacttttatttttttcaaataatttttcacattaagacatattttacatgtattaagatatgaaatgaaaacagggtggagaaatatttggaaaaatttgattatatgtattaagatgtgaaatggaaaagagggtggggaaaatttatggaaaaaattttgaagtataaaagggaaacttcttttagacgttcttaaagacatgaaatcacttcgaattttactctattgcaaagagaagaaaaagctacatttgagcttattaagcaaatacatttttgggttgggtggcagcggggacagggtctcactctgttgcccaggctggagtgcagtgctgcaatccacagctcactacaacctctgcctcatgggctcaagcaaccctcccacctcagcctcctgagtagctgggactataagcccacaccaccctgcccagctaatttttgtattttttgtagagacggtgtctggccatgttgccccgcctggtctcctgagctcaagtgatccacctcccttcgccttctaaagtgctggaattataaaagtgagccactgcacccagcccacaaatacttttttttttcagacttttccctaggttgaaaaacaaatcaaaatggcaataggtgtaactactcttttggctcaagtacttttcaggaagtaatcaggttcctaccatgatatggtggaagagaaagatcacaattctctaaaactttgcaaatatgatatatatagtttttattaagttacttctactttttgacaaattccaaaataatctaaatataatgttgatcagttttgttgaactcctgtcctcaactgatccacccaccttggccccacaaaggtgctgggattacaggcatgaggcaccatgcccagtgatcagttttccttccttttaagattctctaaaaatgaaacatgcataggaaatatatctactttcttaataatacttggtttgaactagaagttattctcaaagtgtgcttttattgccttgtttttaggacatttatttcaatccatacaaaacatccaaataatttggtcttggaatcccattcattagtgaactaaaggaccatccaaaaaaataacagtctggggttacacttgatccttggagaggaaatatttctagaaatataaattctgtcattctcttttctcctgtaatttacataacactctgatggcggttttatggcccctaacagagatttggcccagaaaagagatgcttaaactgagggtatacccctgctaagtcaaaatgaattgtgaaatcactagaaatggctacaacttctcttcatgttctgcaaattgtttcaagatgttttctataaactttcactacttttgctttatttttatttcatttaacaaatatttactaagaacacaccatgtgctagccactagatcttaagtgccaagtcactggtgagcataacagacattcttcctgtactacagagattaccctctggtggagaaaacagtaagaatcaaataaccatgcaaataaatacacccattaatttattaaaaaaatgtatattgagcgctccctgtgttatgaatctgtactagatttgtggaatatagtacctgaacccatgaatcttacattctggtgcacaaattaaacagtaagcaaataaacaaataagtaaatattatcatggtgggtggtgatatgaagaaaaataaagctatataagggcacagaaaatttgaggggttgaaataacatgtttagagaggaatggagtgagtgagggaaagaatggtaacagataaggtcagtgagataggaaaaggcctggtcttctacatggcaaacagtgcttgttattacaaatggtgaaagtgcactgtaacaaatacaagatgttaaaagaatggacaactggaagcctacccaagggaatcaggggaagcttctgttaagaactgaattgtgtccccccaaaatacaaaatttatttaactctcaatgtagcaatcagaaatcaattaataagctggcattggtaagttcttaccattcagtaattactttgaatgtaaatggattaaattatccaatcaaaaggcatagagtggatgactggattaaaaaaatttaaaaagcaaaacaaaacaagacccaactgtatgctgcctacaagagactaatttcaccttaaaatacactcagactgaaagtgcaggaatgggataaattattacatgccaatggaaataaaaagagaagaggggtagctatacttatttcagacaaaatagactttgggtcaaaaactgtaaaaagagacaaagaaggctattatgtggtgataaaagcgtcagttcattaagaaaatgtagcaattgtaaatacatatgcacccaacattggagcatctaaatatgtaaagcagacatgaagagatttgaagggagacatagactgcaacaaaataatagtgggggacatcaatacccccacttttaacattggacatatcattcagacataaagtcaataaggaaacattggacttgaattatactttgggccaaatggacctaacagacatatacagaacattctacccaacagcaacaggatatacattcttctgaagtatacacagagcattctgcagaacagatactaggttaggccacaaaacaagatcaaaattaagatccaaatcatattgaatatcttttctgaccatagtagtaggaagctagaaatcaataagagaaaggatcatggaaaattagcaaatatgtggaaattaattccccatgtgactgtgtttggaaatagggactttaaagaagtaactaaggtaaaatgaggttgtaagagtggggccttaatccaataggactggtgtcctccttatcagaagaagagacattaagaataaatgtacacagagaaaagaccatgtgagtacacagcaagaagtagccatttacaaaccaagcagagaggcctcaggagaaaccaaccctgccaacaccatgatcttggactcccagccttcagaaatgtgagaaattaaatttctgttgtttaagctacccagtctgtgccattttgttatggcagcagtagcagactgataaaaaagagttaaccccttgaaaagaagcataaaggaacaacatgtgaaaagcacttggtgcatttgagaatctgaaagaaagccgaagctagagatgacacatgagagtggtgcctggggagatgagagaggtagagggaagccaaatcatacaaggtctggtggactctgcgaaggattttggcctttatcctaaagggctgacatgatttgatctgcatttttaaaatcatctgactgtggagaattggagtagggaaagtgtaggtgcagggagacctatccaaaggtcccaggtgataaattacgctagatttgggaaggtgacagtggagttggagagaagcggattgatctttaagaatgaatttgttgggacaaggatttcttctacatttctgggtttttcagatggaaggaagttggtgccattttagaagtggaaaacactggactcacaattttatccccaacttgacagttccattttggccatgctgaatttgagatgcttctgaaacatccaagtggagaatcagtcagtgaatgaatctggagctcagagaacagatggactggaaatataaacttggaggtcaaagcatatgtgtagtaatcaaaatatgctacagtttcagttctctgtggacagggattttatctgttttgttcactgatgtattcaaatgcatggaacagtgctggtatacaggaggtactgaatacatgtttgttttaggaatgaatgaatgaatgaagaatggatagattacctaggaaagagtttgacataaaatgagaaacagatctagaataaaaccctggggaacacctacatttataggcttggaagaagagaatgaacttacaaagaaatagcaaaggaattgtcacagacagaaattcatagagtccaaggtttaagaagccaggggaagaaggcgcttcaagaaggaaagagaatatacactctgaagtgagtagcatgcagcagcaagcctagcatatgaatgaacacttccgaatcctaaaagcaagaccagctttaaaatacttaaatctgtttgtcactgttgtcaatctttgaatctaataagatttaatttattttgtgtaagatttacctcagttaatagccgcttggaactacctttgaaagcacatctctgacacattctcagcctgggtggatatacgataacatcatcattctttgtattaaattatgaccataatgacagttggggaaaaatgtcagcaactaatagaacaccaataggttttcttgacaagctcacttggagtatcctctctggatgaaagctcaataattttttgctttactacctcctcctgttacttcactctgtactcccttatacttctgcataagaaaaactttattaacttcatgcataaccacataatttgagtcataattaagattcagatgagcagtaaaacaattttatatcaccacctgtatataccttctaaaaatagatgtttattagttacttagttttggtcagtcttcccttggaagataatctacgtggcaacaaaaactttctctctcctgtttgctgcattcccagacccaaaactgtgcctgatgtattttaggtgctcagtaatatgtacataataaataaatgaatacatgcttaaagtcgcacggcaggaggtagatataaaaatgctggttgggtttgcagcttagtcagagatgcaattcctaatatcaggttacacatttgaaatccaagcaaacatcttggcttgctaacatctctggctgacttttaagccccagccccatttcggatgtttccacatgaaagccaaacaggcattttgaactccaggcgtcccaaacgtgactctttccttttcttcctgcaccacccttccccagccgtcataagttcgcctctgaaaggcttttcctatctttgagagaagcatcaccatcccatcaacctgttcatctgagttacaaaaattttctaccttcatcagaagtccaaccaatcaccaaattctattaatttggcttctacaattttttttcatatccaccttccaaatcatcttggttcatagaatgatttgcgttttcccagcagttgcagtgatctcctaatagttctggtgcctctggcctctctcttctccagtcaatattccatattgtcagccaagatttgctaaaataagaaactgatacaaatcttcattaaccaacaagagaacatcagttaagttccttttatgcatctattctaggctaaaggaataagtgcttgaagcccacagagggttctttgtcttagagaggggcatggagactagacaggcttatgtcactgcccttctcaggcttctcctttacagtagagtaaaacttaaccacttaagatgatattcccagacctttaagtgcagactctcttgcctttctagcttcatcccgtatcatttccaaaatcctaaatacagtctacctggatcctgtgttgtgttgagagagttatgcacttccatccggagttatgcctttttcatctcatttccctaactggaatgagtttccctttcccctacgtgcaagataaaatgccattcattctttgaatctcaactcaaatgttagctcacctatgtgtccttacccattacacagacttcatttatttctctgtaagaacaattacaactgctgtggagcagattctgagcaacatagagacatatgttcctagtgagtccatttgttgttgaaggcctcttcttactaagtcttaatctctacctaattaactatcttaggtattaagttcatatcaactgctatgtttgtaagaatttcctagattccatactttatgctctctaaagcattgcccatcattgtgcaatgctgcaatacctgctttgttctttatttgtaaagttcttgtctctgatctgtagcaatggaggagcttgtcataacccttttggtagaaaggctcataccatctttggagttcaagatggaaatggatcctccactaaactgaaaaaaaaaagcctttataacacatcccatgcaatattgttaaatactctgcttttccttttctctctgatatggcttaggaacagttgcttatataattcatgcttaatattgtgtgggttacaaaaggacatgaaaatatctttttatcatgagtatggatagttaccttgggtattgtttgatagctaaagtgctttcactgatgaccatctgaccagtttaattgtcagctgatacatgtcagaactccttcatatactggctaatttctgtcagtttctaaatgataactgctaatgtcaaggcagttcaaaaatagcaaaaacttgatttcctcttaatatcttgaagatcatattcatgggcaccagcgagtctggaaaataaatctgatggatttttctcatcatatttagaataaacaaattaatgctagaaattgtttctaacaggagataataaaggaaatgggcaaacaaaaataaatatatagcttctgtgagccaattgttttttgtaaactggatgagatttttttaatgtaggcaagaattctaaaattatacagttaagctaaataacatagtatttgttcctgtcataaattgtctttcaattgggaccaaaattggtgtttaaatgttgtattataaagaagtgcatgcaaactatttattagtgaatatttatttaatttgacagaggtaagtgagagtgttatttatccatagcctggccaatttcaggcaagtaattgcaggatgaggagtaattccagtccctgtacctgctggtgagatcactgaagaactcactcagcgtttgtagcacacagaatggccacggttacatacctgagtgcattcacagtataaccaagcccaaatcctcggccaaatccctaagggaatctgggttttaccttgcaaactttggctgctaggcacagttacagagccttgttatgctttaggctctcaataaaaatgtttgccctgggttattacaaagactttcttggtacagaaattcagacaagatcacgaagcacagggtgaaaatacaggaatgagcagaaggagccaattctaaagttttctgaagtcagctcatgccttcataaatagtgagcctccttggtcgctcactgaaacaaaaaagatggacatgtaatttacctagaaatatggatgcctctaaattttaaaaaggaaaatcatttaaaacatgacacttataaagtatcttaagataatatttggttttatactatggtattttaatgataattagagaaattcaatgctatgaaattctaatgatattccgatactaactaggataattattttacaaaatctgaataatataatctccatttttcatcttttaagaaatatctacatataataattttcctttgttatgtatatcaaaattcaaatgtttgtgattgatacttatgttatactttttactgttgatcttaacaataatcactctaataagctttctacttatgccagtgataatattatagagttcctcttccacaatttgcctttgtaatcaagttatgaagccacataaaaattcctaatatgttatagttgcatcttgttcttaactcaaatgtcattgctcatcttgattatttatgttgtttatcataaggaattccaactgatttttcacagccccccaaaataaaatttgtcccttaagtttacttaaaagaataggacatacttctgaaaaaagtaaaaattgattctgaaatatttaaatggctgttcatgagaataaatgcataacttcacaaagtgactatttcatacaggaaagcaattatttggatgtgtaaggcatggtatgtgtggtcatactttttatctgcttccttataaatgaattaccatattagcatgaaaaaattcttagcatcaaggaggcttttgttttaattgctggttttaagttcatttgcttagctgaatattcatttggcttttgtaatacctaaagcagtgggtgaaacccggctctaggggcttcttcatggcctttaattgtttcaggagaagctttactttttatcaattaatcctgggtaccatattttgtacagaagattgaattttttctttttacacaggtaagactggtttagtgacatatggccatatatagtaggtgtttaattactatctattaagtggatgttggatgtcagacatgaactgtcatatttaggttttctgacatttgagagaagcattcaactttggtgagataagagagaagattgtgttttcacaaaagcaccctttagagaacagattgcagggatgtgtattcataaagtgacgtataaacttttttctcatctttaaccactttcctcaatgccatctcaaagcagcaacttaaattcagttatgcatttgatccacacaatgtttattaaacacctactccatgccaaagagtcttccagggatggggaaaacagagcttctatggagtttgcattctaatggagggagtgataataattctcaaagatgctgaaattcatttgtgagcatgtttctgattattgacaaaatgtgagtcataatccccatgtagtggaatctcactggcataatctgatgagcttcataaactgtgtcacagcaggaagtgccagttatttagtttgagcaaatctagacaatttgaatgtctaacacctagtcttctttcacccatgttgtaaatgacctgcttaaaaggaatggttgagccaatcaacagtaagttattgtatatctcaaaattgctagaagaagggaatttttatgttcccaccataaagaaatgataaattttaaggtgatggatatgctaattactctgatttgattattatacaacatatacttgtattgaaacatactgtatttcataaatatgtacaattattatgtgtcaaaaattttttaaatattttgaaaagagaaatgggtgaccactctagatttcacaggaattaattaccaaataacatatcatgagagaacattcttggatgttattttagaaaataacacatgtattgtcagtatgggaacacttatttttggtacagtctttaataaagcctttattcatttatgtagggccttggggctctcaatcttagcattaaccacgtatttaaggggtgataggcacaacataaattgaatcattagtttagaatcgctctccatgaggctgcctgtagatttttgttatcatccatctaagccacagaaataaaaatcgagtgaatacttttgtttatgtaccatgaatgcatttcccaaaagcaggaaaaatattcctagcactaaggaggtgtttgaaaaatttatttattaaggaccatttgtttagtagaatattcactcagcttttacggtacagtactaccaagagtagttggatttctgccttggagtcttccacggtatgacctcacacaactctttctcccaaacatcatatgccagtcattacctgcatatgtctaagagggcaaggatcccaccctctatggccaccccaaagcatacatgcctcatgcatgaggtttattatttacattcttacaaattgactttgggtgaagagtttaccctgtattgctaaaaatttgccttgagtgactttcctgagaaactgaggttcccttggcagtcagtatttactgattctaaattccattagaaatccatgatcttctaagaaagttcctctaagttgatcctaagaaggtatgaatagctaattatgttatgatgtatgcctctccctttgctggtctgcatgttctgcttgccagttttccacctgcagttggtggcattaagcagcagctgcattccttttatcttggttttcaattggagattgaggagctaagccaggtcttgagattcttcctttctgctcttttttttttttttttttttttttttgacagagtctcgctctgtcgccagactggagtgcagtagtgtgatctccacttactgcaacctccgcctcccaggttcaagtgattctcctgcctcagcctcccgagtagctgggactacaggtacgtgccaccatgcctggctaatttttatatttttagtagagacggggtttcaccatgttggccaggatggtctcaatctcttgacctcgtgatccgcccacctcagcctcccaaagtgctgggattagaggcgtgagccaccgcacccagcctctgctccatcttatggtcttatttgaaatactttcatgcatttggggtacctagacaaggagagactaaacaaatgatagtttctcctcagcttccattataggttccattttaagcctgctattgtatatcaattgctctttttttattgaaatgtaaagatagtttaattttgttttataaaaataactcctaagaaatagttcaaacatggatataaaatgctgtcaatggaaaaatggagagaggtagaggtatttatatttagcatttatttatttcttcattcaataactgtttactgagaatctcctatttgttgggatctgtggggcataaatagataagatataattctacttccttagaacctgcagtctaaatggaaaaattctaatcttgccctgaaccagcaggaatctgaattcccgttcagatatttagaccaacttttctgatggaaaagtattctgtcttcactgtgaggcatattttgaaagactgacaatgctcattgaggtggaagacagaggcagagatctctctgcattaggcatcccttgctgtttccattctacctgctgtttccaaagataactaggctcagaagcccctctctcatgggtttctctgagtacatcccaatgttcttaagtaatgatgaagtaacaggaaaaaaaattaaaaaccaaagttcagctatataccagcaatattccatttaattctcttaacaatgagatgatatagatatttggctaatgaaaaacctggatactaaatggccaagccaagccaggattcaaagccatgtctatgtgactccatagccttgcacttttaaagtcctaattttggggcctcttgcttagagatacttctctgtgaaggtggcacctattcttggcagtggtggcccagtgagccctttgtgggtagctcccataggttcctctcttgcctctctggtaactcctttgctttctcaaacaactcctcagggattggacagtgcagtgtcactctctcagcaccagctctagaaccctctaatgcaggcagttctctagaccactcctgaggcacttactcagggactgacaccccagacttggggcctcctgtcttgagaccacagagctggagtttatcaccagtgtctcaggtcatcgaataatttggcaaaatctcatatttcccttcatcctcatcctttctatgcctgatatgtacactaaactctggtggggactcagcaaacatttgagtcaatgttagacaggtgacccgccgccatatctgttaggcatgcatgcaaggcagtgctcatcatcatgccaccatgtggcctctggcagtgtcctttgtcccattctgaggaactgcaggcactgtgcttttgagtcacagtgtatcaactttttgtagttttagtatcatctccgttgctttttactgctataagtgcacagtccacttaaccttctggcaagttagctgcttttaacctgccatggaatggatactcaggtattacaatgcttttttacattatacttaaaaagacagatgacaaaactcccaggaaatgacttctctatgaattagtgcatttttttaagttttgaatctaccaaattaattgttgcctgttctaggggcatttttgcttcctccgtggttctcacttatatcatgttatttgtgttgctgagtctttggaaaaagtgattgcaaaggctgttttcttttcccttgttcccacagattctagatgggggtttgaccttgtgattttctgcagtttctttcctacttagccatttttcagccaaagaggtttctgctaacatgtagaattccttttatgaggaatccatgctatcatcagtgcggagtgatatgtgagtcataattactatattcataaaactcctagaaatgtagaatgataagatattttacagattagtttgtctcgtcttcttattttcagtctgagaaaatgcagaccatggagattaagggatttgttcaaggtcccagagatagtgggctccaaatcagaagaaaatctcaacttctagctctaagtccattgcttttccctctctcaatacctattgcttcttcttaaaaagaatcaggaatatctattaaatgattgtagattttatatttaagtttttgagtagttagtctcctgtaggtgagcattccttggaagacaaagcagcaaagtcaaaaatgtatgaatttagaagccagacagacaataaccaaatagaggttctatcatttcctacctatgtgataatggaaaagctattttccattatttccatattttatctacacctcagctttctgatctgtaaaaactgagattataacatcaacatgtagggttactgtgaggattttaaaaattaatattatatagtgtttagaacagtactcagcacatagtaagtattcagtcagtgagatgtgcagttcttggatgtcttcttcccctttatctgaaacaggtaactttttttttcctttatgcttaaaagagtgaattttgttgcagtgttattattttaggtttgtgataaatcttacaaacaaactagtgtgtaaacaagcttaaaatacacttttgatttgcacttttttttttaaagtcctgatctcattcccctcatagactggggaaagagtgaatgtagatttatgaagacatttacatgtcatagcccagcatttcccaaactgtggtcttggacttagaccacttgcatcagaatcatctgtggggattgtttaaagaagaagattcctggactccaccacagactcataaatactgtatcttcatcacagatccagtgatgaagaggcccaggaacctctgtgttataacaaacacaaaatgtgtttttatacactaatttttgagaaccactgttatagatgaattgccagtgaaactccagattacttgaccaaaaatattactttaatcatgctacttccctgttttctcacttgtcttcaattggccaaggagggctatcaggctgtgtgaaccttatggctgtcctaccttatggtacactgaaaatatgcccccaaagatgtccatgtgcttgtcctcagggtctgggaatagggtaccttatttggcaaaggaactttgcagatgtgcctaaattaaagatcttgagatgggaagattattctggattatacaggtgggccaagtgtcatcaaaagggacttcaaaagagaaggaaggagaatcagagttaatacatgatgacagaagcaagagactggagtgatacaaggaagggatcctgagctaaggaagttgaaaaaggaagggaaactgattctcctttcagagtcttcagaaggaaccagccctgctggtaccttgactttagcccagggaggctgattttggacttctgacctccagaactataagataatacaaggcatactgtccctttgctccactctgtccactacttctatgactttttcaaagttctgaataaaacctttctcttgcctaaaagccgtccttggcccttccagccaagagttatttccccttctctgaagttctaagtcaatcagaatctgtgcaattattgtgcatccagttatgaaaagctctgtctaggagtgtttatatgcaagatctttcaaatcagaacacccaggtttaaatcctgattctgccacaactaccttggagaagtttcttagactctccaaatctcattgtcttcatttgtataaatcgcatcagatggtgaagtttagagatgctccacctagaagtgaactgacatggtggctgaatcagagtcaggacttcacacatgtggcaatcatgggaggcattgttccttcggcatagctcggattattgtcataaacatgactattcagaccatgttgttgacattttattaatatgttcatgtttctgtttccctgttaatcccatgaaattaagcatgataataattataatgacaataataataataatagcaaagtagtatagtgaaaggagtattagggtttggttgactttttttttttttttttttgagacacgtctctttctgtcacccaggctggagtgtagtggcacgatcacagctcactgcatccttgacttcctgggttcaggtgatcctcccgcctcagcttcccaagcagctaggactacaggtgtgtgctactacacccagctaatttctgtatcttttgtagagatggggtttcaccttgctgcccaggctgagctcaagcaatcctccctgggctcaagcaatcctcccacctcaacctccccaagtgctgggattacaggcatgagccaccacgcccagcctgattttggtagtcttttatttcacttctagctttgcaatttactggaatgtggaaagaaaagaacatgatttatttatatttaaaatggaaataataatggtacttactcttaattatttcaggatgaagtaagatttcaggattaaagtcttagagtacctaacacatagtaaaaatttagtatgtgttaacttattaacggtaattggtatctaattttcttttttatttgtttctattctatactatgaatcttgatatacctgttactttatatatggcaataatatgagaaacaggaggaataatactggataaacatctaatatttaatgttatgctttgctatcatatgcgttataggatataaatctcacagacagggtttgctgttggagcaatgctcatgctatgaatgtatgcaagaaacacataaagcctgcctaggaacctctattctcccctcactttttttgcttctttcttttcctttttccttcctttctttctttcatcacaggtgatcatataaatagtttggtaccttaagtactttaaaatccattggattttggagcaatttttcaaaatttttcaaatttttcaaaattttggagcaagatttcaaaaaaaaaatctatgattcaatacattgccattcatcattaccttccctttacaacccttcatgctattttagtgcagatgagaactctcctattgtagctagtttgaattcatttttcaaatgagaattcatgagctactatgctaaaagtaaggtctgttacatcttctgcacttccattgtctgctaatgttgtaatatgatttttaagtaattgactttcttttgacacgctttcttatttagaaactcaggcttatttgtaaatctgttatctctatagatgtttatatattttatatagatgttttctctgtggtttgttccctaattattttagagagtcttggaattacttatttttatgtaagacatataaaatagctccatatgaccaaggaaatgtgatacaaaaatgctaggaaaacttggtagtaatactacttttgtggttaaaggcaaggaagggaaaatcaagccaattcctataagaagaaaaaagtatacttgaatatactaaatagatgctccttgtcatttaatatttttaaaggaaagaaaaattacctcttcttttttcttttgcttcttttatccaaagaaagacgtaattttataaataacttgcaggattaaatttacctgaaaggcaattgggagtttcccctctgacctgtggaatagtccgttctttctgtattcttcctagaacataaaaggggtaattgcagtggttgtaagctccccctagaaactttttctagtagcccagtgccttggaaattgtccatgaacttacacacacacaccacatgtgaatttaatatgagaaatggaggattcgtttgaaaaaactataaaacatgtgctctcttgagagatttatgccccttgtgtccctccttggccactgtgcatgagtgccatggctgagaagtaaaagtcagagctgaatgaagcccacattactttatagacttgacgacctgtggttttactcatgaataagcaacaactcatgcttgtacaaaatgcctgtttgtctgggtctctctcagttaaaaagaggtattttaagtcaaatagaaaatatattgtttaacttaccataggcttcagtgcagaaatacaagtcatatattacttcataacatggttgcatagagaagggaaaccatataaacaattcaacataattctaataatgtcttggttcacccaagataaaattaaccacctatcttaaagaatacactacgttaaaaatttatttcttatgtactaaagcgaggatgtatttattacttagaattttttctctgtttttccccaaaatgtggtttctataaaaaaaatcttaatagagaatttggtatcctttcaaatagactttttaatgcagtatgaaattatattataatctagttgatgacaaaattacattgggttatattaactattaatatatatattccccaaatctgtaaactcttaatttctttaatgaagatcaagtagtcatcattttttctatgcttgtacaagttttcccaaaaatgattaatcatattaattgttgttttggaattccacagattaatttaaaagtagtatatgtgggaggacatttcttgaagaagtgtagtagaaaaagagaatttctataagaattatttttaaaggttgaactcacagaagtagagagtagaatagtggttgccagaggctgagggagggagatggaaagggaaggaggagatgttgatcaaagagtacacaattttaattaggcaagaggaataagctttagtggtctgttgtgcagaatggtgactataataaaaatgcattgtatgtttcaaacttgctaaaggatgagattttaaatgttttcaccacaaaaaaaatggtcagtatgtgaggtggcagctttgttaattagcttgatgtaatcattccacagcgtaaaaatatatcaaaacttcacattttctcccataaatatatataattattacttgtcaattaaacatttttaaaatgattgtgtttaatcaccaaagatagtgtcttttattcttagtaacaacctccattttggattagaatatttgaattttatagtgaaaataatctacaaaatcagttatgcatttatcagatagtttataacaaaaatggatgcatcacagtcatagctttcttagcacagttttctgaaatgacttaatcccaaagtaatttacaggcagactaaatggatttattatgtataaacatcctcatctcacattatctaagaaaaaaattgatgtttggtaaaaaaaaaaattaattcacaataataacatgagcccttacacttatcagaaaaacccaggtatttacaaagtatagataaaaatctgttttttaaatttaaatttttttttttttttttttcgagatggagtctggctctgtcgcccaggctggagtgcagtggcgcgatctcggctcactgcaacctccacctcccgggttcaagaagttctcctgcctcagcctcctgagtagctgggactacaggtgcccaccaccatgcccggctaattccctgtattttttttagtagagatggggtttcactgtgttagccaggatggcctcgatctcctgacctcgtgatccgcccgcctcggcctcccaaagtgctaggattacaggcgtaagccaccacgcccagccaaaaatctgttttttaatattgccatattctcacaacaaacagcttcttttcataaattttaaagttcaaggtaaacagggcacctttaaaaaatcttgtgaaaggtgactgccagtgcaggcatggcaaatagggggagatgatcagatgattaaaaaagaatggagaacagattatgaatgttgttgaatacagaaaaaatttaatattctctttaattctgttctgtagttaaaggaaagaaagaacagtgaggaataaaatagagaggatacaaaaagcaggagcaaaaacagatgaaagccttaagttctaatgattttttaatttttttcaaattgttttagagatggggtctcactgtgtcacccaggttgcagcgcagtggcgtgatcaaagctcactgcagccttaacctcctaggctcaagcaatcttgaggcttacttattaaagataaaccactcagatcactcttagtcgtgacatgcagagaagtgatttttttgttgttgaaatataagtcagttggttaactactataatacttcagtaaggatttcagtccttaaatgtgaaaacactttcttgaaattgagtaaatgtaaccattaattttaaactgtgatgagccatataccccacatagcacagcagggtctcaatatgacctgccatgggggcaagagggacaaaaagtgagaaatgttctgagcagtaacttctcgcatagtcacttctagctcctgggctagagattcctaccttacaccttgatcaagatttatgaggaagttaaaaatgcagaaaatgtcaagcccatctctgaagtatgattcccagtttgtataagattgtcatcttataatatctaaacattattcttcatattaaaaatgttttcacatgaaaattcaatgatggcatttatgtactcagtgcccatccctctcaaagaatatccctgttgttttctgaggggcagctactttgatttcacaatttttctggattttttttttcacttttgtagacatatagcagtgatttacaatgattgcctctaaaataatttagaatcaatagctagcaactggtactccttcagtaatgcctcaggtttctggattggtgtgttagttagctgttgccacaataatactgcataatatattacctaaacctgaggggtattcaggaagtatttatttcttcctctcagtttgggtggggtcagctggggtttggctgatctaggctgccttcagctgggcttggcctcagttgcaggttgggtctaggtctactgcaccttgatttcattattcttgaaccaagagctctgtaaggcagagtcttcccatggccttaagttgcaggttgggtctatgtccactgcacctttatttcattcttcttgggccaggagctatatgaggcagggtcttctcatggcaaaaggcagagtaaatgcaccaaagcccaacctggcaataacattttaatcctctgctagtgtacttctgctaacatactacttgtcagcaaaagtcacatggccaagcctaataacagtgaggaaggaaaatatcctttgattccagtggtaggttatgcaaagtcatataacatatggtatagctatgggaaagagtattagaaacaataatgcaatataccatgttccaccttctagatcacaattattcgcatgccacccacacacaaaatagcttacttctgtctcattttgtatataaatataattttaggaaattcccatacttttaatcataagtatgaaatcaagttcaaattccaggatcttattatttatacctgttccagatgcagttcttcttgatctggaggcctgttaatttaaaaaaaaagttatctaatgccccccaacacacactcccaacatgtaatagtggagtactttggtctgtgtgcctctcattgtccactttttgaacagaatattcattgtgattatcctgtgaacaatccattcaaaaagggggacaatgagaggcacacagcagtcattgattggtccatagcaattctgaaaattgccaggtcttcctattctggaagaaggtaatgttctttgattaggtgttacttctgttccctggaaattagctagagagaaaaagagattgtatcaacacttgccttggtgaatgtattcagaagccatcagggtcttcaagacaagcaaagaaaaaaatttccttttatttttgacattttctgtacttcattaatatgacatctcctggtacataactacccaggtcttgagatttctaaagttctcagtgatatgatcttttctttctttatcttactaataaatacttatttaggtttttgcctaggtagcatattttaatgacccaagcatcaaaaagtatgcaaatgtataaagtgaacatgtatttcccaatatatttttatttttcttatctttttttacacacagaatagtagtatactataagtactgcgcaatgttctttttttcacttaatatatatcatagatttttccatatcagtgcattaagagtgccctcattttttagagctatgtattattccatttaatggacataccattatttattacaggacaaatgaggtgtttccagtgtttttccattacagataattgttgcaatgactaatcttgtacgtgtgtcttttcacacatgggttaatatatttgtaagaaaaaaattataaaagtggaaatgtaaagtcaaagggtttaggaggttttgttttgttttgtttttctgtcacccgggctggagtgcagtggcacaatctcagctcatggcaacctctgcctcctgggttcaagcgattctcctgcctcagcctcccaagtatctgggactacaggcgtgtgccaccacacctggctaatttttgcatttttagtagaaacagggtttcgccatgttggccaggctggtcaaactcctgacctcaggtgatcctccttgctgggattacaggcgtgagccaccatggctggcctggtttatgagtttttaattttaaaagaaactactgaattgccttcagtagaatttctaacagtacttactcccaccaataatataaagagggcttctttatctacaatcttgtcaacactgtgtgttaacaaacttttggaatttgctcaatgaagtgaaaatgaagttgcttttcctttttaagcatgagagagaacttatttcaggtattagagaagtttttgcatttttctaaacaaatttactttcttatactgggcctatattttactgggttgttggcttctactgccttcagtagatattagggctaggcacaatggctcacacttataatcccagcattttgggaggccgaggtgggaggaacctttgaggccaggagtttgagaccatcttgggccacatagtaaaatcccatctctagaattaaagagttagccatgcatggtgatgtgaacctgtactcctagctactcagaaggctgaggtggaacgatcacttgagctcagtacttcaaggctacagtgagctatgatcacaccactgcactgtagcctgggtgacagagcaagaccctgtcactatataaagaaagaaataataaataaataaaagataagtgaatattctgtaggacctgcatatatgccaaggaaattagtcctttttaggttaattgaattgtaaatattttttgtattattgactttacttatattttaaacaactatttagatttttttttgttttctttaatatggattaatttattagtttttctattatggcttttaaattttaggaaatagaaaggccttccaccactttgaggttataaaaagaattctcctgtacatttattctagtacttttgttattttattttgttacattactctctgatcctttcagaatttgttctggtgtaatgtaagatagggattcaacttttttctgtatggccacccagttgtcttagcaccatttattgtatagctcatcttttctatacacatatgaaatgccacttttatcatataccaaaatttcatttattttttgtgtctgtaactttatattttgcttcttaaatttacatctctattcatgcagtagcttcatatcattttaattactgaggctttatggtgttttatgtggtagagttactcattcttcattacacttttttcagaattttcctggctgctcttgtttgtttctttttccatataaactttagaatgagtttattttgttctgagaaaaaaaaaaagtattgacattcagggtgccattacatttacaaattagctgtgaaaggatgaatgtttttatggtacattttcttatccaagaacatagtacgcatttctatttatgtattttatgtcccttagaagcatcttaaaagctttcttcatatggttcttgcatatttctcattaagtgtttttctatttctgattctatttatggcttagcatatgtgatactaaaaaggaaggactccagctgttttaaccctggctctacctccaaattcccacagattagaagaaacagatagatgttataagtaagcagataaaagttttaagtgaaaatgagaggacaggtgggtagagatagcatattaggtgctaactagtttttgtcatcccatccaaggaaagccaccagatttgtctggcacacacaacatgggcaaagcacaatggagatagaaaggactcagaaggcagagcagttgtcatttagaagcagaaaagcagtggatccaagaatttttattaggcttggctccatataaaagctatcccaaataacagtgtctttcaacacaataaaggtttatttttctctcatgtaaatgagttatgggtataggcattccaacactgttatgggactaactaacgcatctgtgattcaggcttctttttttccctcattactatgtttagtgtgtgatctccatccccaagtttgcctcatggttcatgatggctgcttaagctctcaccaacatgcacatttcaggcatgaggacaaagaaaagaggagttaggaaaaatgtgtgtaccttcaagtgaagccggttctcttctaatactttccaagaagtcccactctgtcactcatctcctccttaagtgtacaagaggttgctcccaacaatatagagattctgttactaaggaacaaggagagaatggattttggggagacaacttccagtcctgccacgaggaacaaaccttcaaaaaattatatcctccaaacatgttgagaagtgagaaggaaaataccaagaagaaaataggaaagtgaataaaatgagtacagttcaattagttatcatgttttagaataatttaagacaaactagtgctcagaaaaacctgagctagatattgctgctttgattttgtagtttttgagcttgaaaatgtgttcaagagtaattgaatcacatgttcccttttttcctttggaattggaacctcagtaaggggttaaaatacaatccccaacaagtacagttggtacaggggtcacaaagatgattaagacatagtccctgccttgagtaatatgcaatctagtgtggaaggcaaatagatacagagatacttctagtgtggagtgaggagtgatctgacagaggtgagctcagggtaagagggactacatattacaggaacctgaggaagcctgagtaggggagtagcattaggaaggggaggggaggtggaaattgcactgagtcccaaaggatcagttgcaggggagggtgtggatgtatatgagggaaggggaggaggtggtgggaggatagaattagttagctaaagagaagagccaacgggcagagaacttgcccagcaagaacagagtgtgtgaagtctagcaagtgaaagagagtgcggtttattcaagggctttgcccactcttatgtctatcttcagttgggaatgactgaagagatgaaagtggagaggaagccactgggactagatcataaagggtctttgggacaaactacttgatttttccattatgcttgagtgcaggaatcactggaggacttgaagcagggatgtggtgtgctcagacttgcatttcagaaaaatgaatatagaggtacagtgagaatgggttggaggtcagcaagattcaaagaaaagagtactaaagaggcacattagacaagaaatgatgagagcttaaacaaagtaaagagtggcaagtgacttgcaagtccttaaggcgggagaaggggaaagaaactacagtatttggcatggactgaatcaggaagtggggaaaatgggggaaagaaaggaggaggatgctccagtgtctgtcctggacaactatgtgaaaagtattactcttcataaagaagtgaaaacaggaaggaaagtagattttgtagcaaaaataaggtgtgttcagttttctgtgaaatggggttaagatgctagttggacattcacatgggactagagaaggtttgaacttaggaaaagaactgggctgaagaaataagtttaagggtagccttaagccatgctgtgactaagccacggtgagtagggtagggtgaaaggaggacagaactatgaataatacaacatttaggaacaggaggatgagtgaataaaggagacagagaaggaaccaaaaacaaggagaagtgaaactaggcaatagtagcactgtagaagtaaagaaaaacacttcaaatactatagatgtcaagtaaagtaagagccaccatacttattggatttagccataaaaagatcattgaggaacaacgcaaggtagctttagcagaaagataaggatgaggagtgcatgagcaccaaggaagataaatgtaaaatactttcaagcagtgatgctcactgagttagggagaagttagactttatgtccatctttttaaaaatggaagagtcatgagcaagtttaaagccatacaaaggtgagagacagacagtataagaaagagaggagatgctgaagcaagtttctgagaagttagcagcaagaggaatttggagaatacgtgaaaggattaaccttgaacctccagtgtaagaggaagaaagaaaacctggataagtgtggctaagaggctcctaagtgctggggaggacagcaaggacagcaactgtacatcttaatggtttctaatgggtaattgaggaatgagttgcctaggagcagatcctgcatcagtcctgcagccccatgaggctgaagatttggaatttgtacttcctccagtccacgtggctatgtcattttctccattagtgctctactcagtaattcaggtataaggtagctgagaacagtttgatttacacagggttgaagttctcccaaataggtgtgaagggaggataagggacaaggaaggacaagagacttgttggtttgggcaataaagtggctacattggaaagagaatgaagacaaaagaccaacatggttaattgtgtgggatgggcttgagattagatcttgttgatatttaaaaattaattaaagtcaaagtgagaagcgagctgtaactttgattgcagaggagctttgtaatactgtgatttccttctcaagttcaagactgaaaaatgttatttaattgaatgttaaattgttattgcttgatccaaaatgacttaacacaaattttttaaacatgttcaataactagtttttgtttgtttgtttgtttgtttgtttgagacggagtcttgctctgtctcccaggctggagtgcagtggtatgatctcggctcactgcaagctccacctcccgggttcacgccattctcctgcctcagcctcccgagtagctgggactacaggcacccaccaccacacctggctaatttttgtatttttagtagagacggggtttcgactagtattttttttaaatgtagcattgaagttatagctgatttcatttgatgtttgagacttttatttgtgctgtggtttcaaatcccccttttgatacccagttaagattaatcctttttacttacaagctattattctacttcataggcatataaacttttattgcagtagagcccagaaaaactggtggatgatgttgcaatttatatatcacaaactacaataattttaggttctgtcatataattttagtaattttatttaaaatttaagattacccagtttaggccctgtagtaacagaataacttcttcagagatcaattttctcagctataaaatcaagagactagattgcttgttaactctacttctatgattctttattttaatctaattttcaatttcacttcaacttcatgataattctaatatcagtcaattaactgtgcacagttacaaattctgtaactcagtctctaagccttctacattggcacaagaggaaggccattggttagaagagaagtcaagtgactacttgtggatagtttagcaaatatctaacatactggaaaaaaattcaagatgcaaggcttgctgttggataacttggtgatcaaaaaaactcttttcttagactaaatatctaatgacaattgattattataacctatatttaagcttaaaactagcagtatctgtaggatggttctcctgaaagaattatacagttcaggacatgtatggacaaggctgcaccttcagaattaagtattttatttcagcagaatccaatatgaaaattaccatttctttcaagaaaagcattgaagacattatttgcattttagatgttttcaaatgacatattttgaagactaggttgaagccattgttataataaacagcttccaatgtttctcttaaaagagttatactttttgtatacaatagagtactactaatatttttaatgtcttaataatgcactaaatatagtgtctttaaactatcttcataaaaaatgactatgtatctttaaataaagaaaaatcttaatttttagaactatttttcatttttttcaaaacttaaagttttgaattagtgagtttcaagcacaacacaacttgtcattcctctagatttagaattcagattactattggtgactagtagttagaagggtcttctattaaacaaattggattgtttttatttttaagaattttataaatgtagtcattttagatgctttgaaaaatgaagaagctttcatctctcttctaatttgtataaaggctttgtttatataacaagtagaaatttaacatttttctagcattttaaaataaatttgaaaaactacttagacaatattatttttatctttttaagctaaaaacttaaaaacaaatttttatggcagaatgtgtatagctagtgtagcaatttcaaaactggatatttattttatttttgtttcttttttgttaatagtcttttttaagaaacatgaaactcacaatttaagattcatgcacatatgtgtgtacacatacacacacacacacacacacacacacggattccccaattcaaatttttaacataagatttgtgacactgacaatttttgtcagaacatatcaaaagctctaaaatatctcatccctttgacccttgaattctattcccaggagtataacccaagaaaacaagaaaaatggttctgtacaaataattttagcagtgttatgtatgatattaaaaagtggcagcaatctcaatgtccgataataaggggcataattgagtaaattatggttcaatagtagtagtgtggattacattgacaaaaaaagatgaatataaattgctaagaaaaaatatgataatctgcttatgaagtaatataaaatgagaaagtgtagaattaacataatataaattatgcttacatgtaaaaaaagatttctttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccaccacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgtaaaaaaagatttcaaaggaaaaaatttacgtaggcaatatgtaaaggtgaaagtattatcattttctttttaaaaatactttaaatttgatgtgacagtaaacatatttgtaatatagagcttttaaagaatgtcaactgtatgatgaatataaacaagatttctcttttttttgagatggagtctcactcactgcgtcgcccaggctggggaacagtggcgcgatctcagctcactgcaacctcctcctcccgggttcaagtgattctcctgcctcagcctcccaagtagctgggattacaggcatctgccatcacgcccggctaatttctatatttttagtagaggcgggatttcaccatgttggccaagctggtttgaactcccggcctcaagtgatctgcccaccttggccttccaaagttctgggattacaggtgttagccaccaagcccggtcaggcttcattttagtagtaacagtttgatcataactttcatcatatatattatttaatgttagtaaaatatttataatgaaagaagaaaaaatacgtaattgttatgatatgtctaatcagcaatcaaacaaagcttgcactgcctctggtgggacaacaatatacaaaggataaaggtgtgtgacttctatccagaaaacacaggtgatttttttttttctcttggaaagccaccagcctggtgcagttagaagcatttcctgagagtgtctgagagaaggcttgggtggacattggagggtggtgttctacctgcgaattttggctcattagtagggcttgatatcaatttagtggatagagaactacatattggtttttgtttgtttacttttgtatcatatattttggaaacttttccttttacatttaaatgctaatgaaatcacattccctattgactttcttatatttgtactttatcataatacttataggtaagtattgtttcatgaaacttgtctcagttttatctgcagggaaggtgcaaggtggagaggtagaaggacagaggagaggaaaggagagcaagaatataaaatttgttacttggggctgggcgcagtggctcacacctctaatcccagcactttgggaggccgaggtgggtggatcacaaggtcaggagatcaagaccatcctggctaacacggtgaaaccccatctctactaaaaatacaaaaaattagccgggcgtggtggcgggcgcctgtagttccaactactcaggaggctgaggcaggagaatggcgtgaacccacgaggtggagcctgcagtgagccgagagcatgccactgcactccagcctgggcgacaaagcaagactccatttcaaaaaaaaaaatttgttacttatggtttgggtgaaaaaactttgaaaagtaataccttacagggcaaaaataatctgttgacaagacaggactcaaaatgttgactttccacgtttctcagattcaaaacagcctcaggcccttgtgacctcattcaccagaagttcttgggctgctttcaattcccagagacttcattatagaatccagatattctggtgtgtaaaaaaaaattattctctaaattactataaatatattaaaatattatattacactttaggttctcaactttgtccatttactattttttagtatatctaaaacagtatgcgaataaactggtaagactttcagttcacagattcgttataatatcttatgtttctttatttctttctgctgttgtattgatttatgacgttattttccatggtcaattacaagaatttgcatggtagtatagaaaaaaaaatttaagaaattagggcaaccaagatgtccttcagtaggtgaatgggttaatgaactgtggcacattcagacaatggaatattattcagggcaaaaaaaataaggtatcacatcgtgaaaagacatggaggaacgttcaatgcatattactaagtgaaagaagccaatctgaaaaggctatatgctgtatgattccaactatatgacattctggaaacagcaaaactatagggatagttaaaacatcagtggttgccaggggttagggagaaggagggatgatgaggcagaacccggaggatttttagggcaatgaaactactccatgtgatactattattatgtgaatatgttatacatttgtcaaaacccatataatgtacaacaccaagattgaaccctaatgtaaaccatggactttgggtgataatgatgggtcagtgtaggttcgttgattgtaaccaatgttccagtttggtgggggatctcaatagtggagaaagctgtaccttgtgtggagccaccgggtatatgggagcgctatacttttgctcaattttgctgtggacctaaaagtgctcttgaaaatgaagtttattttaaataaaagaaaggaattatgaattaatatgagaattgcaaaaaggatataattgtgggggaattatagaaatcagctacgtaattccatggagtagctctgctgaaagtctaacgatatgctatgtccaaaggactgaagcaactatctggggtatgctatgggggccaacacagaagacatggaaaaaaatcttaaattttaccacatcctgttctatcaatgacctttccaccaactgcttattttggttttactctgcttcatctctattgcttctgaacttccttttcatttcataacagaaactctgagcctttgccgcctcactaaatttcattttaaaacctattctttcttagaaatgataatacagaaaccactttttacaaatacaacatttaaagaaaatcacagtcacctaaataatctgtttctgtatcagagaaggcagtggacctacagacggtctgttcagtcagctgaggatttaggactgaggaactgttaattcccacagcagctctactgactattcgatagtcccaggacctgaagtctttcagagtctgcttcatgcactataaatatataaaatgagaaaataaaattaattattgtgttttaagaatatttatagcactgtaagtttaggctattatattaattatctatctctgggtaacaagataccataaacttgctgcctcagaggcacataaatttattatctcacagattctcgaggtcaggactgtaggcaagacttacttggattatctgctcagggtctcacttggttgaaatcaaggtgttggccactaacaaactgaggtaccagagaaattgtttttccaagtgtttattacagtaatcccctaggcttctcaataagtttcagtgtcttccctggatagtgacattgcagagagctactgtcattttttcaactatcttcagttcaaaaatatttactaagtacttcttatttgccagtttaaagcattggaagtaagagacaaatcagaggacctgttctcagggaacatatgatctactagcaaagcaaactgggggaatgatgtgaagggagaccaagtctgagtcattttgagaagagaacggaaactcagagtggctgtccggttcagtttgtcttgagagaaacatccctgctagtgagtaactaaaattctctgcagatgttacatttgccatgagtacctgttacatttggagactgaagcagtctgcagaggttatccaaattgaaagctaaaatgagattctcaaagaaagattaagtccaaatagcaattttatggcagggtttgtggaggatctggggagagatcacaggcaatggatatagttgagcaatatagttgtattcacccagcccataagggagatgaaattctgacaagggtatcatagggtgaatgaagacttctccaagcagagttatgcagatggatgaaaagattctaggaagttggattgtgtgctgaaagtgtcagcaagctgctggtgccattttgtgccctgaaccctataggtagatccctaaggatttcagctgctaagcccttaagtcctgttagcccttgtctccttctccagtctcctttacctgccctctaattacgactttattgatgctgattgagcatcttttgggagggagacctaggaattgttctgagttgttcactgtgtttgcagtgtaatgacccttggtgccaaagtaacaccattagagggctctttcctggtgaaaaacttaaaagtgtcaggatgacattggtcacctataaattagggaagagagtgcagatgagaattcaggtgaagtcaatgatgtcttgcccttttcctgagggcgaaatacaggagttgggatgtttagaaaagctgaataggcaacgagttgaactttgattggcatgagcttgaatgtcagattgcccagtgaaaatgttctgaaaagaagctccatggttaaggtgtcaaagtgtcacatcagtgaatacaatgtttccttttctgtggcttttctaataataatgaatagccaggaagattttgtggtttacttgcagagatggcaccccatgactttctgtcacctttgggagccagcctgtaagagagtcccaaaggtgaagagactttctctcacctgggagagtaggggtcccaatgtctcgtagggcagtgtttctcaaacttacatgagcatatgaatcacctgggactcttactaagatgcagggtctgatgtagtaggttagagagttggaggaggtgaaaagaaaaatttgcatttcaaacaagtttccaagttattcaggtgcttctggtccataatcttcattttaagtaacaaaactttggagcattagaataggaaagacataccttagatgatgttattgtggccttgatatactataaagccacaaaatgagaggaaacatagcttaccccattagctgatgtatgaattaagaaaagaacgattcaggatcacttacagatctatgagaaaaaaacaaaacccaggcaaacaaatatgcttcctggtggtagtttctgtcttttcttaagaatatgttataaaagaacaggaaacctggcagttgctagaaaagcagacaaacctaactccattgtcccctaagtctgaaggacataatcttctgttttaagttttaggggtcacttaataccagatggttaagtaacttggtcatgctactaccaacaacctatccgcttcatgctctgccattgagcctatatctcccactggctgtcaactgccttcatacagtaatactggaagcaactgaaggtttattcgcttggggatgaattctatacttagttatcaagtattctagagtgacttgtggtcgggggaagggttaagaatctctctaggagtggactcacagtggagccctggttagaagatagcttcagtattctttattgtaaataggtcatttgaatttttaatgccatgcaattcaaggatcgccacataatttgtatttctcttaaacttaatgcagtgaaactttccttgtgtaatagatgcttttgtaatgcaatcttggaaatagttttcaaagttcataagggttgcaaaagttctacttgatctgctcacatatacaattgttcctttccctgctcctctttctactgctatttatatcagctgtcctccaggagatcagttttcttctcagcatctgatataaataaccacagttctctaagcatggtctgttcaaaatttccaggtagttcatggactgatatctggttaactgttttcatgatgtggcagtgacatgcatttgttactaatatctattaatactctttatataaaatgcaataacggttgcacctgacctcaatgatatatttattaaaaaccctgctatttttaatggacaggtaagatgagtttggatactgcagggtcgttcagaaacaagcagcagtgatattcctttaggccatgcccttgagttgaaattttccctgagagtcaactccaaatgcagaaatgaacataatgtacccaatagaatgcagctgtctgatttgccccaagcctattcaatatctttcagactgaaggagtgtgggcttccgcttattttcatgttccttatactgtaactaaaagaaaccggaaatattcttgcttctttgaaaatattacagataataaaaactggaatacaaaactctctttttaggggtgaatattgtttttagtttaaaattgtccatgtgaaaggctagtcagtctagcttctgcaaaaaattcttcaaaaacctttgatcattttaaccattttaggtgtattttgagctaaaatgcactcttgacttcaggtaatgtagcagcagccattaaatacttagaagatttaaaggtcaaactatggaacagaagtagaagttttaactatataaataacagcattaataaataggctttagtttttcttcactggtgctgaatcaaaatattattaaatataattaatgaaatattttataatatacattatgtattttaaatatttttcattttagtcatcaaaacaatttaatgattttaatagaattttaatagatttaagctaacattaccaagcaacttcgtaatttaaatttcaaaatgaatttgtagtaaacacaaacccattttatttttattttatattatacaatataatggatgacaacagaatgtaatgacaatttttcaaatccaatttattaatgtccctagtagtgaccataccaagattatgctgcagtaaacccttttaaaatctaaatcctctccttactattaggtccatgcttatattcactttgtatctattacaaacaacttataaggaaagaatgctggaactggattcaacctctggtttgtattcttaccaggtctgctgacactgagtctcagctttctctttgacgaactgcggactctaatctgtaccttgcctgttttttggagtagtattaactgaggtgaaaataaagtattagatgtgacatgaatttttttattgtatctttcatggtagactgagtaggttttgctgcagtaacataagaaaaacaaagccccaactctcagtgaatataatcttagcccataggcagaagttcatttctccctcatgcttcatgtctacaggagctcagcttatgatccctttgagacccagcctaacggaaaccccatgttagcatgtgttttcataatcaccaggtcagggaaaagatactggtaaatcatgcactggcacttaaaacattcttccagaaatgatacctctgctcacactctgttggccaaagtaagtcacatggccacacaggtaagctcagagtaggtggggaagtgcatttctatcgtgagcctagagggagaggggaacaggcatatctacgatgagatctaatgactatcacaggtatttaaatttaaaactgcaatctatttatcctgtggtgaatttagtggagaaattatttttgccttgcaatggtaaggaggactgttatgtaactttctactatgaattatagatgtgtactgccatctacttctcatctattgagaaggggagatgttctgatctgaaataaataaacatcagaatacttttttcacaatatatgtactatgatgtttctatcagtaggaatagacagctatacaaaagtgaaatagaaaaagtggtaagagggccaggcacggtggctcatgcctgtaatcccagtactttgggaggccaaggtgggcggatcacctgaggtcaggagttcgagaccagcctggccgacatggtgaaaccttgtctctactaaaaatacaaaaattaactgggtgtggtggtgggagcctgtagtcccagctgcttgggaggctgaggcaggagaatcacttgaacccgggaggcagaggttgcagtgagccaagatcgttccactgcactccagactggtgacagagcgagactccgtctaaaaaaaaaaagaaaaagaaaaagaaaaaatggtaagaaaggcaacagaggtacaacagatttgctgagaaatcctatagttagaatggggaaggttttttgggaaacatgagttaaggactggatattgaagcctggaatggatatggatttatggacagggaaggatgatctataatacagagaagtataattcaacacagaaattctgatttctaggctattactggaatacactatttcaaggctattaatgactacatttatgttatttttcctaaaatatcaggaccttttaatctaatgactcagctcttctgtgtctctgtttttcttgcactttgtcttattgctttgccatttaaaaatccagccatgaaaggaattttggaaattgtgttcttttccatgtatgtaattgctccttaaaactgaaaagatcaattaggaaattattggctccttcgtacttcttttaccacctctatttattaattgattgaattgggttcgccaggtttagctctttaatatcagatcaataaaagattaaatgtttaaattaagtgagcacacatgtaactttcacactccttgcaatttctaggagccacatccaatcattcaggattgtcagtaacggcagcaatcaaggctagaatcagagtacttgcaacttttcattctttttcctaaacttcagcctacatttatgggaataataatgcagccatactttcctcaaactcagtttatatttttgtttgaaattaaagcagctttttgagacaagaattaagattgttgccctgatgctagtcatagtgaatttctaacccttctaacccttcttaaaaggagatggtcgtatttgtttcctttggatgccgtatcaaattaccacaagctgagtggttcaaaagaacagaaatgtactctctcacagtacttgatgccagaagtttgaagtcaaggtgtgtctgaaggtcatattctttctgaaggctccagggaagaagccttccttgcctcttcctaacatctagtggttcctagcaatccttgacctgtgttggcgtgtagccgcctcactccggtctctgcctctgtcatcacatggctttttgccctctgtctcccctgtatctctaactccaaatttctctctccttataaggacatcagtggttgaaattagggtccactgtaatccagtgtgatcacatcttaattatatccgcaaagactctatttgcaaaaaaaaaaaaaaaaaaaaaaaaaaaaaaaaaaaaaaaagggtcacattcacaaataccagagtttaggacttcaacatttctttataggagacacaaatcaactcacaacaatggcattattgaaacttttttgtaattttttagcattctattctgtgggatacttcccctcccagcccagaaatttatgccagttactaatttcatcaagattattccccttgctaccgattgccaccttatttaaaagtctgcattattgttgacctgccccaagacctggtttcttgatacccagtcttctctttctcatgattttctccgtgcaacttgttaaacttttactttctttcagaaagcactgggaggcagttcagatgtaccagggtagacaggctagtgatcaagggtgagtcagggatttgctgacaggtactaatgggagtagtcattgaactaaacctgaagcaacagtgaaacaaaacaaggtttgcatcacttctaaagaagatacttagaattgttttcttcctcttgcttcaacaactacattggatatatttagctgaatgctttattttgactctaagcaaaatctcatagcaacatcttttctttcaaagtaccattaatgtaattttgagtacaggaataaggaaaaaagttagaaaatttcattgaggataataaattgagaccaaacactaccagataatacatcaagaacattaacattaacaacatccttttatgttatgctacattcttgtgttaaactaatgtataccatacattatagatactaatgtagtagttgcggaaaataatgacgctctttgattctatctagcagaactgcaaactcttaattataataacaaaagattatgtgttacactctaagtcttgcctagaatgatacaagatatggattttgagttattttaaggattataatccttatatttatgttctagttcaggggttgatgataacctaaggtccagaatttggataggaaaaaaaatgtatttgtttttcctaactctaactgatatttgatatctccttcaattattaatgtaagccacaaacctcaggggttatggcatcaatagaaatcctagattaattttaaattatatcacaggtattgaatatatctcaaatataatttatacttagcacttcttcagaattatgttagctacttagacctgctgtgataccttatttaatgcattaataaagaattcttttaatattttgataactatttctatatactcatttttccttggaatatttttattttatgcattttaaaacaattctgttgaaaatagttcctcgggcttcatgggactgccaaagtggcccatgacacaaaatcggataaaaatttctctgctagttttagtaccttctgtttcatgatggcaaattaaaaggcaggttcaaatgtcagcattatatactacaattttctttctttctcagtcagacaattcattaatcatctgatattttttataatactatacctaacatggggataaatgactgaaaaaacagggttgtaaaaatagaagcatagcatacattcctgtcctcaatgatattcagtctagttagttacatagcatatgaattgccattgtccatatcatatcttaaaataattcttatactgtatttttataatgcttaaaaaatgtactcaaaatgctgtcctctgtaagaactcattgaacaccttcaacagggttgttaaattggtaaagcaagatcctactaggtttataaataaagaaaaggctttcccttaagtagtgagagatgaagcaagaaaacactcagctctcccaaactgtagttcagtgggactttcatttcacatcatttccttagaaaaatcctacgtcagaaaatcttcagtctttttcgttgtataatctatacatctccgaaaagtgtaagatggcttgttaagaataaagtgtggtttggttgtgtaagaccaaccagaaaggggaaagggaagaggaatgatgttgagattgggagagtagttgctgtctgtgatcttttatacagttgatgtgtgatagttgtttgtttgtttgtttgtttttttaattccaacctgttcttaaatgcaaatacaaaaactagagaaagagatggaatcaagctaaggttaaactcaaaagtgacttcagtatcaacttgttggttgtatgtagcctttctgtcacagaactgtgccctgggttctttttactcaaaaagtattccataaaacaaccgcctattggtgcattacttcacagcctgttatgaatgagaatcttgagtcccaccccagacttaatgaatcagaatctgcatgttaacaaaattctcaagtgatttgaatatacagcaaaatttgagaaccacagatgactttcaattcacccataataactgagaaaagactgtaaattcctacaccttgttcttccataatttaaggagtttcttgctttgtttctaccttcattaagggatatgaggcccatgctaagaaaaatgcgtttaataactactttgagtgaaaaatctcactaaatcaggcagttgttcctaaagagaatttaaacagattttcatcatagacagcatggtatctgagacaaacctgcccctgttggtgctgtaccaggcaaactcagtgaatgtaagtgggaaatgttttgggagaacaagaaagcccaagtattgcatttaggcaaatcataagtgcatagtgtgccagagaaaacaaatgtttttcctgcactggctctgacacgttcacacatgaatgtgtttcattcagaaaaagtaaaggctctagaatggcacagtctggttttatgagaaacagatgtgccatggttcacccactccctgaccacctgtggtttgcccatgactcaactttcttgaatgaggggagttaactcttggattctgaacaaactctaaattacatatttattttcttcctcctcatacttcttttcaccactcattgccatgatagaaccttacaattctgagaagtttgaattctcaacaccccaaaacattttcatttaaagttgaatccttgctaaaggtgaatccttgctctgatatttagattgagattctgttaaaagttcaaatagaataccaatttatccagctagttagagtgatttttggtttatattttaaagccacctggttatgaggtatctttacttactgcctattttgttggttgaggataggaattattaccagtcagaaatatgcttttgatgtcattggttagtcacttaattttcagctacctctgtttattggaataatgtggaaaaattaaaaaaaaatttctcagactttaattcaggtaatacctgctgttaaatgttactgtgaactacttcctccaactgctcacaagtagccaaagggaaggatttgaacttcattacattttatctctcctgccatgctctgccttccactctacagaaaagggacagggaaatagtccaatcataggtaggtggatggaaaaatacaaggcacaaatagcccacatagggaataatcataccttaaatagtcactgacaacatttaaaaaaatatatttttatttccatttatgtaatcaacttagggttgttattgacctgccactgaggcatttggtttttcttttcataggacctttttcatttatttcttcagaagcattatctaattaaaaacaaacatttaaattaacatggcctgtcaaggaagtacaaaccagtcttgagttaagctataattacaatgacaacaatgtcaaaaagaaaaagcaaaaaccttttttaaaacctgtaattacttcattgtttataatttttaattggaatgcaagtaacagggaattcaaatttcataaaaccgtggtctgtatatcttgttatcaaaatgctatccaaataacacatggcaaaatgtaatttttttatgtaaatggggagacttatgagacaaagaagcaaataatctggccacaatgtgagtctttggcaaaccttggaaaggaactcccaagtgcatttcctaaaagagtactttgtgtgttcaaatgtactaactctatccagagtgaaagaatgcctaggaatgaataatctgcacaatctgatagaattaagtgttaattatttagaagtaaaatttactagaaatcaatttcagtatcattttcagatttggttttcagaaaaggaaataccctgttttaataggtttggaaatgcaggactacttaaagtttacttgggtaagataacccttaataaattatcaaggtacttttggatttattaattttataaacaataaaactagctgttgctagatgtcggttatagactgagctgtagaaaattaatgatcttttaaaaagacagttgatttttcacatggccactgtatgatgctttttaagttcacttgattaaaaaggtgacaatactaacatttcaaaatttaagtcattctatatgatcaaatatggttctatttgatacattaaaatatcttaatttgaagttaaaaatgctttgaataattaaatagatatataataaaaatgttgaattcatgtgtcatgcatactgattttgtacctcataagcaaagctacaatggtactaacagggtgtaatttgttcaaaataaatttttataccagatgatagtgaccttaaaaaggatttttattgctcaagccttccacttccattcctttgacatacttaatgagtttcatcaatttatgtcattaaaaaagatacatcttctgaatatgccagttgaccaaatctattattttggatgtttgctcagatagagctggtactgggatgaaaaaaaaatggctaagatatggttcctaccattaagaagcctatgatttggctaaagagaaaaatctatccaaaactaggtttaatacaagaagggttatccagagtgctggtagggagggagacacataggagagtaagaagtagcatttgaattggattttaggggataggcaatttttttattgaaatactgaaaggcaatttcaggaaaagggtacagtgtgagccaaggcatggactcaagaaagtacaggatgaatttaggtaatgaatcatctgtgtgatttggactcaaaatgaaaaaaaaaaaatataagaaaataagagatgaaaacataagtcgaagccagatttgagaaagcttaaatgatgtactacagcactgagatgagtctttagatcacgagggaccaagaaaaaaacataattttttgtcattaggtaaaactcatgttcattattaaaaaggagaaatgtaaagtaaatatacacatttacaatacaaaaatcatcaaatactttgaaccacttgaaactgccattttcaaaagtcaacagcagtcaaatatcatcactttaatatagctcatcttaataattgattctggaatcagaaatgtgcattttaccattgactttttttatgaaaataaattattaaaaagcagcataattaggattaatataggcatcactcttatttagtacaaaaagcaatgtatcaattctataattttgaccacctactgtgttctgagcatactgtaaggcgcattacctacctttattcattcattattactcgaatcactttaatgataaatgatggtcagaaaatatttatatagattttcccaaatcatctgtaagtaagtgatttttaaagataggaaagtgatgctcaagatatttatataaatttcaccaagtagttagcaagtaaatggtggtgataggattcaaatgtacatcttttgccttttgtttgtttggggtttggatttggtttttgctatactaccatacattgcttcacgttgggggtaagctatctccatagcatgacccagcaatcccccagtgaaaagtcaaacatttgttgagcatctgtcttgaaggagaccccaaatcaggtgctgggtgtaagggcggacagcatgaaagacgttgtcctttttcatatggagcttatatttgagttgggagacaggtgcaaaacgttagttacaaactaatttcttcactaaagtcatgctatgtgcaaggagataaagtacagatgagttgatgttgtataagaggaggaagttaatctccaaagcaggaaaaacaacctcagacatttaagctaatacctgaaggtaagtagaaattaatgagttaatggaaatgagagaagtttaggcaaagaaaacagcctaggtacagatttctgctttctttaggtaacaactatatctcaaggtaaacaagcttggaatgaaaagcagggtcctaaagaacatagtttcactctggctctgccccacccattgatatgagcaatcaatcatcttcaattatttctgtgagtctccaagttgtattcatacatgttcacaaccacagtccattaaacaatttggatcttcacagtctcctgaattgcctaaattccaaagtgtgtacagtttaggctaacaaacgagaacagccaatccatgtaaaataggggactagactaagttattttgaagctgtatttctgtcctaataacctatcatattgtgtttctgattttctacaagtattaatactataaaattaaatgtttggttttattagaaacagggcatagtggatatgtacagtaacaaaggacaggaagtgaagaatgaattgatcgaggttcttctagatagactctaaaagaatacttccaagagacaggaaatattgtatacccattgtcaatgtttgaatattattaatgaattaataattaaaatgtaaggcaagtttttacttgctaagaagacctgtgcattcatgtaacaaacaccatgatgaagctatagaatgcttccataacccccaaaatttctccatttctcttcccttggtactagtttctgacagtcactgatctgatttctggctctatagtttggccttttccagaatgtcacataacaggaatcatacagtatgtagctttttatgattggctttttttcacttggcataatgcttttaagatgaatccattttgttatgtgtatcattcccttatttcttatatttttgagttggatcccattttacaggtataccataaaaggataatttgtttattctttcattaattgttggatatttggtttggtgattatgaatgaaatttctataaacagtctcagataggtctttgtgtagggactttacttggataaatatataggagaaggagtccttgattgtatagtaagtgtatattcaactttataagaaaatgccaaatgttttccaaagttgctgtaccattttacattctcttcagtaatgcgtgagtttcagttcaacatctaaaccaacacttgctggtgattgtttataaattttagccattctacttggcatctaatagtatcttatagttttaatctaatttgcatttttgtaataatgatggtgaacatcttttcacatgatgtttgccactcatagctcaagtgatgcaccttttaaaatattttgaccaattctaaaagaaaaatgggttgtttgcttttcattattgaattgtaagagctctttatgaattcaggatggaagttatatttaatgagatgggtgttttacatatattttctctaagtctatgacttgccttttaattttgttagtatgtagtactttttaaacttgtgtagattctttgagattttctacatagacaatcatgtggtctccaaataaaagacagtcttatttattcctttctaatatgtataattttgatttcttttttgtactttattatgttggttagaaccttcattatgatgttaaataggaataatgagagcattcttgccatattcctggtcttaggtaaaaacactcattctttcaccattaagtgtgatgttacttataggttaacttaaggtgccttttttcaggttgaggaagttcctttctattccaagtttgctgagggtttttatcattaatggatgctaaattttgtcaaatgctatttttatatctattgacatgttgatttttatttgtgtaatagttgttgttaatatgctgaatattgacccaaacttgcatttctgggataagctcacttggtcatgatgtatcatcttttttgtgtttcattagatttgatttactaaagttttgttgtggtttgagagcatattttatatcagcgcttctcaactagggacagttttgctccccaaacgacattgggaagtgtctggagaaatatttagttgccacatttgagggaagagagaggattttctacgggcatctagcagacagggaccaaggatgctgccaaatatcctaaattgcataggaaagcaccacacaacaaagaattatcaggccccaatgttgatagtgcaagttcaagaaatgttgctgtatgggatctcaaaaattttaaatttgttcagatttattattttatgacccagaatatgactatctcggtgaatgttcaatgtacacatgaaaacaatgtttatccttttaatatagggaagaatgttgtataaatgtcaattaggtcaagttggttgacagtgttgttcaaattttgtatatctttactgaattttatacctacttattctatagattactggaagaaaagtgttgaaatgtccaactataattgtgagtttgtcactttttttttagttctctcagttttttactttttattacattttattttattcatgtctgttagttttttgcttcttgtattatgaagttctgttgttaaatatattcaggtttttacatattattaaagaattgacctctttattattatgtaatgtctctctattcctggtaatatttcttgttctgaagtctactttttctgatagtaatacagtcactccagctttcttttgattagcatttgtgtggtatattttttcatcctttaatttttaacctatgcctttatatttaaagtgtgtttatttataacacatataaagtgcatttatttatagagttgggacttcctttaatttaatttgacaatttctgtctattgatattttagagcatttacatttaatgtgattatcaatatggtaaacttaagtttaccatattgctagttgtttactattgatgtaatatgttctttgttccttttccttcttttcctacctgtggattaactaaatatttttatgattccatttttatctacattactgatctataagttgttcctcttttcaaatatttttagtagttgtgctggtatttacagtaaatatctttaagctatcacagtctatcttcaagtaatttatatcatttcacctgtagtatcaggacctcacagcacatattccatttactcctttccattctttgtgttattgtcatacattttacttctacttataagcctcacaatacattgtaactatgcttgatttagacggtcaattatctttaaaggtgattaaaaataatttttaaaaatatcctttatatgtacctttatttctatcattttcagtgctatttatttctttacatagcccacaatttccatctggtaccatatgcattctgtcttaaggacttcctttaacttttcttatagcataggtctgctggcttcatgcctgtcctccagcagcaggcagtcacctcctgcatgcctctgccacagcagggacctctctctcgtttcctgctcccagtctttctcataagcacctcacgcaggcctgtggaaaagtttataaataagtgtgggcttccctgtgggtggagttcctagatatttcaaactaataatagttcatacttgtcttttagaaatttgtgaaacttttagctaattttttcctactcacatttgtagggaggccacctatttttcccatgctttgccaaagattaaatactttgtatgtccctcttgaggggcatatcactctttgaacttaatttacttggctgccttgaacctcagctctctaatgggctcaaggaaagtagtaattttgtacatcttctggcttttggtcattgttagcaggaacaacgttctcttgtatctctctacaacatttaccaaagtggaactcctcttttcagcatcttaaacaaattttggatttgaaatggctcaaagcatttgggaactctattttacatacattttaaaatgaagcttctatagttctgtggtatcttatatgatcttaattgttaattagttggaaggatatgtgtcatctattagtaagttgtagagtttttgtttttagacattatttgtcataaccccaaagggtctatttctacataagtattgaaatcatttttcaaaaagcagcaacagaaaaagctgctataaatttcatggctaaagattgggagatatttgggggtgatggtatctgctgatattaaccttgtgatcagcctaaatttctatttattacatttttacttgtttttattcctataaatattatatataagattaatagtcaacttatggaacatttgtcactggaacatatttgtcattccctatttatatatatacaaatgaaatacacatacttgatcgaagtaaatgcattaaaaacaatcatctttaattcctttgaatctgtactacatacaaacgacatagttttaggattctctacaaattcttaagtataattaaatcagaattaaggtgatcatctacatattgaaagctgccttccaaatgaatgaaatgtaatataacatttcaaatataaaaggaaatgttgatgcccacgaaataatttcatcttcatttatctaggatcaaatattgtgaagaaatttaacattatctatggattaatataaagacaaatgcgatgggctgtaattgagcattcaaattaagtttttcatatagtgtgctcatatgttagacctttaagaaatgtgaatcagatctaatcatagcagcagtgagtgataatgcagtttgccagctaaggcaaggcaccccaggaaaatgctattcatataacattgcctaatcagtgtatatctaaggcatctttaaaggaaaatgtatacagatgctcctccatttatgatggggttatgtccagataaagtcattgtaagttgaaaatatcattaatcaaaaatgaatttaaaacgcttaacttcccaaacatcatagcttagcctagcctaccttaaaagtgctcagacacttaacattaacctacagttgggcaaaattatctaacacaaagcctattttacaataaaatgttaaatatctcatggaatttattgaatgccgtactgaaagtgaaaagcagaatggccgtatgggtacttgaagtatggtttctactgtgtgcttattattttcatggtgtcataaagtcaaaaaatcatagcgtaaccctggttaagtcagggaccatctctatgtccttcatatacaagattttattattttacttttcagaatttctcgctgtgatgaaattaatgtagttgggaaaatagtactggatttaaattcatttctaagaacagaagaaaattaaagatattaattatgaagttacaaaacatatcaatgagctctttttggaatttgagtttagtatttgagtcagagtgatgtgagagatatttatttgccaagcatgaagcagagacttcagtggctgcagtagcatagtatctgctcccaagtggtttccagtctggtaaagggatatacagagcctcagtctaagtgctgcaggaggcatggacaggattcagaatgcccagaggtcccccaggcagccagggaaggggaacactgaagatggagatcattggaggaggacggcattgcaagcagaagataagaaagaatcccttcttctcatccacatgacacatatcataagatcatatggcctcaaaatcatagctcttcttattttccttaagaacatggagtttcacatgcaattaacttaaatcttcccagccctccattctcccttcaataattacctttctattttgctgttcatctaatgcgctttaacactatgctatgttagaactattttttctattctgtttattttcaggcttttaagaaatttttattagacgattttagtaattcatgtgaaaaagcataaatttaccaatctgtagcagcagataatccaagggagagttcatgctagaagtgggggatcaggagtaaatattctcctaactaagagcttaggtcaaactagagtccaagagagtagagaggtaaagcctgtgctaagagccagaatatagcaagaagcttttgatactctcagctgccaactaggaaacgggtgagaacaggcacacaaatgagcaaaggggtagaaatgagatttacagcaattgtaatatatttattcagtgcctataatcatctttgaatacactcatttatttagactgtgcattctgtgttgcatatttgttgattaacattttcattagtttaccattgtagaaacaaaaatagtaagttatgtgtctgtaagaaagagacatgacctgctaggtcctgtccagaggtcttactaacttggctgacttaaagatatgattaaaggaataaagccatattaggaagaagtggttattaacatcacccagaatggccagaaatttcagcataaatatttatgagagagtccactgaaactacacatttagtaaagggaaacaagatctttggtttttgagaactttctactggacaaaaaaccttgaagtcaaaagctagtcaaaggtaccacgtgatacttcttgtttcaggtgaagctgcctgtctatcacagagcaaccactgcacaacatccagagttggcattaaatccaaaagctttggagatgaatgacttcgttaagattcctctctgggaatgtgaagagatgggatctaaactcaaagactctgatccataaatttttggagctgtaagtctgaggtcaaaagacatgaatcttaggaaacaaatttccttttctccagggcttcctgtctctttcctcatccagttataagggaaaaaaaatattacagtagaagaaaaaatggtcagtgcaagctgatcttggctaaggttaaaggagggccatacaataatggtctgcctcttcccatttttatttagcttcccaatagaataatgatcatgctgtggcatgttttggaataattatatctggcagaggcatcactcaggttttgcctgtatgtaaatggaggactgtttccttgtgagtagatgaccatgcctcccaatttacctggcactgtctcaggttgtgcccctttcttctcaaaataccatgatttggatgaaaatataaattgccaccctgttaatgagccactgttttagagatggctccctcccagaaggaaagctacctaaaataccctcagatggtattagacattaacgaaaaataaactttaaatattttctagtcacattaaaatagctaaagtaaaaaaagtgcaaatatcagtaaagggataatgcttcacatacacatgcatgcacacacacacattcacacacacgctctggcctatttttcaaatggaagtgcctgtgaggcttaaaagtatgataagaagaaaaggaagaaaatagataagatgtgcaaatgagacaacccttactaaaagggtgaagggacaaggagaagtgcagccaatcctgagcagaatgtactgaaacattcagcatttcttccccaggatggcacgctcctctgaagaaatgattccatacgaaggagaagggtcccctttccagatgacaggctttgtcttcaaagcaagggtatgcaactactggactttgtctatacttggtaacttttataaataaatcaagtctggtaattcatgctgtaccaagaaaggctctagttagaagagcagcattagcattttagattttggtctaacagacagtgtagcaaggtctcctgggtaaagttttaagagcaattagagctaataaaaagacaggcttgtcagcacctgaacaatgtggaaaaggagagccagtggcttggcttttgattttgaactggacccaagttaaagctaatagaattgtttttttcaggagtacgtgtgtgtgtgtgtgtgtgtgtgtgtgtgtgtgcacgtgtgcacttgtttgtgcgtagcctgtgcatggggtgagggggttcatgaacatagatacagttcagctttggaataaaagtgaaaggcatttttagttgctttcaaaacctctaaaaatagccataagtctctgccaaagctaatatagacaggattcccatggaaaccctctgggctagaaggggcgggtattattttttcactggttattggttaaaagacttctacccattttctataatgtaggagtgtgtttactgtcaaaactgatgaatcaaatcttaaaggcacctgcttatctgttctacttatctgaaggagagaaagtacagtagtgtctgtacttaataaaaaattttcgcaaggaatgcgttagttaagaaaaaaaagtaccaccttctttcacattctgtgcttatatgttctgtagctagtttttaaattcctactttgagtccatggtcacagccagatttcatgatatttttacccatatatttatctgtgataacagtcatctgtttttacattttctcattttgggtggtgtcttatttggatgtatgtgtcaattccgaggcaccaagaattaaaggatgtatgatcagcctagaatttgacattgtgaagttaacccttaggaattttcattttcttcactttcagctggaagattaaaatttcaaaaaatattaagagctaagaatgatgaacttatttcttttcttttgaattataacacctttggggaaagtattttaacaaaataattagctgtttatcagtttacaaatacagagataagaagaacttaaatctttttaaagattacaaaaagcaagaatacaatagaattctaaaggtattttccatatatttcagtagattcagattatgactagttaaatgattaattgatagttattttaaaaactttgattgctttattctttgattttattctttttcttctttctaataatgcgttttctaaaccatattataagtaataattaacatatgtacatggttcttaataacctactaaacacttccatgtaaatcatatttaatcatcataaatataaacataaaggtttataaagtcaccatttttataattattctataattatgaaataatataaatattctttatatgtcattttgttttatttcttcatgtggttaatgtcatttaacttatagttctagaagatgtttttgcagtaactacaatatgcatatttttttgcttagtattttacatctttaagtaaagattgaggaggaaacgtaatgccctaaaatattacagctcaccaaacacatcatggagtcatattttaggatattcttagtcccagatagcaggagtagtggctagaaacaaacctttgatacgtagaagtcccccagattcctagatagtatctggaagcatccagggcctggtgctgaaaggatctggttttcttctcctgttgtagtggctaagaggcctgtgtagaaaaagctgtgggtctcacagacagcgatcttatcgctagagctgggttaggggtatatccaggagacattttccttctctgagccccacttgcaagagacattcgctatacccagagggaactccagtagaagtgccaggtaaatctgaaatatgtgctaccattccatataggaaaaattcaaaaaatcacgtcaaatatctggggggaaggaaaggaaagggtatcacagtcaggaaataacatttttgtggttaactttacagattttaaattgttggttttagttttgtgagactaaagggaggtgaaaagggaggagggaggtcccagtgtaaaaagcgtaggtttgggaattactcaggcctgggttttaaacacagctttgccatccaactagccaatgactttagaatacttaaaaaaaaaaatagaatacgttttaagtttagatcttacacactttttgatcgaagacagcagagttaattatatgaggtggatcgtgtatcattttaaccaggcatcagctttcacaatggttaaacaatgcttgacactgaaggattttgaaaacatcaggacgaaaaggtggtgtagtatggccaaaaatgtgatactgttgtaatctgccagaaagctgatttagcttgggcagtgtttcctaggtactagaataaacacagcctattgtccagatgagaagaggatgatagtgtgttgtgattaaatgagtaagtaatacttatatattgtttgctgctgtttgaataactaacatttactgctgtatctcatgaattatttaagtatattacaatcatcaattttagttagattttctctttatttactaaattggcctatcattgtcacttatatcttatttaaatatttagtcttatcttcccaagatataatagtaattgggcagcactgagccattttagtaatgcttgtagtaagcacacacatgcacactgaaacctatacaattatattgataagctattatccagaatcggatgttttcataaataaaaatttgttccataaatggtagattttagtttacctaggggtaaactgtgaatcatataatgcatcacttatttattacaaacataaaaattcactttcatataaagatatatctttatatttatttttctgaaaaaatgctagcactctgggtcctgggtgtgtcacttccatagcatattgaatggtattaacaagccttacattaattattttttaaacaggcttaatagccccacaggcaggatgtgttggccttaaagggctgagttattataaacactatctgtgtagacatttaaaagaaacagtgtgggagttaaaattacaggttcaagaacctatttttcgtctttctcccacacatagactcatctcctgtcatattatttcccaaaagtttgcaaatttccagtgtttctccataaatccttcttttacataagtgtataaaatgtcaattacaagtcatgcttggtgccctttattgtcttaagattcttaatatctgaatgcttagaatgtaaattcttacaattctaataccttagtatttgaaaatgttatgttatgagtacaaaggtgttcatttcaagactgaggcttctattgtaatttctgtcctaaaggaggcctccagccagggctttctctgaattccataatattctagttaagggtttggcaagtaaggaaagggaaagcctaaagaggaagacacatgaaagaacaaagtaatgttttccaagtagtcccttgaggggtaaacatgagctgttgtggaaagaaacaggacttctcggggagaaaaaacctgggttgaattctgattccaccattttgttgtcctgtatccttgagaaagtatgtaatcccttttcacttttgtctccatttcaatatagaacactaatgaaaacaactttttttgatcagatccagtactctcttttgtaaaatgattcagtacctctaagttactgtgcaagtataaggtcttataatcattattttgataatagctaccaagaataaggaaagaaaatctacatagccaagtcactagaaaggctgcatttgccaaggtcatacttagaacactgggaaatgttcatatgtgacatctaataatgaaaaaaaacactctgttagtttaattgtaaaattaggctcgattctaaattgtactcatttggaacaacaaaaacaaaaataaaaaccaaccaaccaacaaacaaactgtatgagactttatcaaaatatattcccctaacccactaggtagaaattggtgacaaaagaatataaactatttggtgtgacaaataaatattaagtatctgctatgtgctggctactatgggaagtgctaggaatactgttttgaacaaggaaagcacaatccctgatcccttttttatttttcttctatttttaatttttgtgggtaagtagtatgtgtatatatttacggggtacatgagatgtttgatacaggcatgcaatgtgaaataagcacgtcacgaagaatgggacatccatcccctcaagcatttatccattgggttgcaaacaatccagttatactctttaaaaagttattttaaaatgtacagttgttattatttactatagtcatccttttgtgctatcaaatagtaggtcttattcattctctctattttttgtacccattaaccattcctacttccccctgcccccagcaccccactacccttgcaagcctcttagtaaccatccttctagtctccatgtccatgagttcaattattttgatttttagatcccaaacaagtgagtgagaacatgcaatgtttgtctttctgtgcctggcttatttcacttcacataatgatctccagttccatccatgttattgcaaatgactggatctcattcatttttatggctgaataatactgtattgtgtatatgtaccgcattttctttattcattcatctgttgatgaacacttaggttgcttccaaatcttagctgttgtaaacagtgctgcaacaacataggaatgcagatatctcttcaatatattgatttcatttcatttgggtatacacctagcagtgggatttctggatcatatggtagctcaatttttagttttttgagaatccttcgaattgttttccatagtggttgtactaatttacattcccaccaacagtgtacaagtgttcccttttctgtacattcttgccagcatgatcccttgagtttatattctggttgtgggggaacagtgggcagggtggagggagaagaaatacaagcaataatcaataaataagaatctcagatcaagataaggaccatgcagaaagctaaaacagagcaatgagtcaaaatgaccaacgtctactttacactgggtggtcaggaaagtccatggtgatatttaagcagaagtcttaatgatcaaaaataagccaacactttgaagactgaaataagagtgttctgtgaagagggaccagatattatcaaaaaaggtcctaagacagaaatgatgtagagggtcttgaggatcagtatggctgaaacataccaataaggcagacgtgtggattcatgtactgagaaataggcaggaggcagctgatatcaaccttcctatatcacaggtaagctgtttagattatattataagcctgatgagttaccactgtggctttttaggcagaagaatgacttgatctgatttgtatgtatataaaacataatgctctatggtgattagactgtaggtaggaaacaagagtggaaactgggagacctgctaggagattattacagaagagacctagtggcttcaactaggatgacagtaacaaagacattaattcattcatctgtttatgccttcaacaaatattaactaatgatctactgtgtgccaagtcctctctagatatcaggcatgcaccaagggtcaaaagcaaagaaactgcctttatgtggcttatattcagtagaggatatagacaatcaaggggaattaagagtgatgggtctaattttagataggatggtcagggaagacttctgctcatacctaaatgaagagagggagcaagcattgcagttgtctgggacaaaagggactcagacagagagatagcaagaagaccctaggatgggagtgtgcttgaggagttgggataacagcactatggctggagcacagttcggtaggagacaaatggcaagagtttagatctggaggccagctaaaagctaaatcatgcaaggctgggtagaccataacacggcctttgaattttgttctaaattcactggaagtcatcggaaggctttgaaaaaggaagtgacttgatctgatctgtattttaaaataatcactccagctactgtgggaaaaaaagataatggatatggcggtactagaaaggaagcagaagaacctatttggagactattggactaaaccaggcaaaagatgatggtggattggcctaggttggtagcagtggaagtagtaagaattgttcattttccagatacaatctgaaggtagagcctgcaggatttgctaacactttctatgttggatatgagagtaaagagccaagaaaattccaaggcttttgtcctgaacaattgagcaaatggtggcaccatttgctggagatgagagggaaaaatatggtatgttgggggcaataagggaaggttggggatcaaatgtttgcatttgggcatgttaagttagagatgcctattgtggagtttgctagtagaaagttgtatatataaagctagagtttagagtagaagatgaacttagagatatatatgtgtgtcatcacagcataaagatggtatttaagctatgtaactaaatgaaatcacctagaaaatgaaggtaggtagaaaagaggagatgaggagaatgaatttaaaatgtgctttgaagatagagataagagaacttgctgatgggtcagggtaaggaacaatcatagctaaatttgttttcaacaaccgagtggataggtataattcactgagttgggagagactggagaaggagcaacaataagtttgtaggaaaggaatgaagagttgtcttttggtatgttaaatttaatgtacctgttagaaatgcaaatgaacttgttaatgcataatagacatttaaaatcaagagtgaaatcagttaatggtgttagggtaactggatagccacatgaaaaagaatgaaattggacccttacctcacattatacacaaaaattaagtcaaaatggatcaagacctaaatgtaagagctgaaactgtaaagctcttagaagaaaacacaggagtaaatcattataatcttggttttgagaaagaattattaaatatgacaccaaaaacccagcaatagaagaaaaaattagataaatttgatttcatcaaagttaaaaaatttttgtgcttcaaaagacaccataaagaaagtgaaaagagaacccacagaatgggagaaaatatttgcaaattgcatatccgataagattataataaccagaatatattagaaagtcttacaactcaatagtataaagacatttcattttaacaaatgagtgaaggatctaagtagatgtttctccaaaaaagatacgcagatggcaagtaatacatgaaaagatgtttgatactgttagccatcagtgaaatgcaaaacaaaagcacaatgagataccacttcaccccaattaggatggctatagtaaaaaaggcagataatgatatgtggaggaagatatggaaatactggaaccctcatacatgctggtaggaatgtaaaatggtgcagtaattttggaaaacagtcaaacagactggcagcttctcaaaggcttaaatttaatgttaccatatgacccagcaattccactaatagacatatatccaagagaaatgaaaacatatgtccacacaaaaacttgaacattaatgttcatagaagcattgttcataatagcctaaaagtagaaatgcccctaaatgtccatgaactaatgaatgggtaaataaaatgtggtgtgagaggcagggatgtgtcagagatagttaagaggaattgggcagtgactactaaaaggtacaggatttcttttagagggaaccgtcagctgaaacctaaaaagaggctgaatacaaggagaccagatgactgactattgagtttggtggcctggaaacaattggtggagagccttcttggtggagttgaggagggaagtcgaactggaatggatggaggagagaaaaggtgaggaagggaagataacttctgatagcttcttcaagaaattttgctttgaagacaaacagaatatgggataggaaatgggttaaagttgacttttgttatttattttctttgttttagagcagttttgctttttgatgtgactgttttagtatagaaagagaaattgatggtacaaatgggagatagaggataattattgaagtctctgagagagaatgagtccacatggaaaacggatgaaacttagatagagatggggcccttcattcaacgtaattggaggaaagtggaagactgagtaggtaaaaataagtggccccagttatcatatcacaatctacttcatgagaattaatgggcttctttatagttaccttatttttaaaaccactgtgtgtgtgtgtgcgtgtgcattaatgtattaaatttattttcattgtaaaaaaatttattttcattgtaaaacccaatttttgtttccctttcatcgtgtcccaatctgggatcatccaacatggtttacatttaaaaatatttcactgcccacttcacaattggagctatctgtaaggctttagccaacaattcttgcagtggaggagagggaagcatttcatcatatggaaaaatagccactctgcaaatagtgagtctcccaatctttggccctagcccggaagtcctcaagtagtactctcctttcctcagatactttgcttttcctatttccacgtatgcaatgatcagaaaaggataagcctccagaagagaacagagttaaataattttgactctaaaacagaaatatcatgccataccaatacatgaatagagaacaaatgcatatatattgttttgttcaccttttcaaaaggaattttgaatttttgaaagtaatgtgatataatgtttaatgctgtatgcttaataaaaatacatacttttaaggtaacagctatgtttggattgtttgatagaataaagtatcaaaataaatctaagcatgatcaaatacaaaatcatagatacatcataaaatatgagggctatctgtatttttcaatccttagaatcatctggtggagtttctaaaataaaatatcgatgtctaagctccaccccagatcaattaaatcagaatatctggaggggtacctgagcagagattttttttttttaaagctctgtagctgattccatgtgcagccagggttgagaaactttgggctgattattgacaatttcctgtagaaatgcacagaactgcctcataagcttgagttctggacattgcagactgcctgctactgacatacagaaggaaaaacaaacccactaaaatgcaattctacaccttctgaaacttcttatttcatagctttgtctgaaaacaaagctttgtataaaggacaagaagttaaaatgttgggcttttctcttggtttgtttcaagatggggaagtagaataaaaagttcatcaggctttggagatgcaaagaactcaacagctgttaatttgatagaagtgggaagtcagccagactaagaactatttttaggcagtgtattgacaggtgttttaccttctctcacaccctcctggacagggcttgcctagagtagatctgagttttaaaactttcaataaaagaaacagaagcctgtaaaaacagagtccacagcaagtaagccatctctacaccatctcaagcaacaggttgagaaagcttaaatgggagatatggttttaaaatggattttaatggctcatttgactgaaatttattttagggagaaatggattctagaaaatgttggcagttatatcaggtgaaattattttgttgtcaataatccaaaaatgagagcaatgggaagagaggaaagagacaaaggccaagtaggtctagctcttgagatgatggacatggtacctcagtaagcattgggaaacatctcacatattctgcttttgtgttaaagatgataaagcattggtagatgatggtgaaatgtttcagtgatggcttgacaagtaaatttatttcaggggtttgacaagaataaaatataatgaaacaaaatattataatctttgaaagatataaaatacaatgacggtaaatattataatctgcagaacaatcagttttgtttttaaaaacagaatctgtaagatgacctgaatcacacatttataaatcaaaaatatttagtatgaaatcaataattatttcgagaaagaaaacattattcatatatgtgtaccgattttattttccatacttttagagtgctgtattgcctgtggactttaaatatttaaattcctagtctgttattaatactaatttagtatttgcatgcgaatatcattttagttttatcattttcagttgtagctgaaaagctaaaactacttaaggattccattgtgtatacaatcataaattagtaatattagcccctaaaagttttatcaaagtaaatataccactgcagaaaagattccttcatttatttattcatccacaaattttactgctcactaatgtgtcaagctctctattggctttcacatttagagagaaatatgaaattctctcagccctcaagggaccctcgatctagaagggggaagggggcggggaattataaccaaagaatgccagtaaatttggtgcactgaaagaagttgttgcacatatagtgaaggagcagataaaggagtgggcagccttctggagcgtgagtggggatgaaagtgagagaaacaggtttgctgtgtgcatgcagatttaactgtggccaggcagaggggaatgggtgggtgtggggcagacagtgacaacagcaggtctcaaaaagtaagtaggcatttagggctcagacaagatggaagggtatccatttattccaacttatgaaaataacaataaatatatcttgacttaaattaaacttaattttttgaataaaggacttgaagaatgggaggatgttcaacctattaggcaaccaaagtatttttcagcaatttaaaagccaatagtgtacaaggattcccttttctccacaccaacacttgttatttcttgtctttttgataatagccatcccagcagatatgaagttatagttcattgtggttttgctttgcatttccctgctgattagtgatgtagagcaccttttcatatttaggtgctcttcccacacacacaataaagggtaactatgtgagatgatggatatgttaagacatttgaatatagtaaccatttcactgtgtgtgtgtgtgtgtgtgtgtgtgtgtgtgtataacatcatgttctataccttaaatatatgcaataaaaatggcttctgatggtaatgttatttctaagtaggaactttttttcaggcctcattaaaacaagacttctgtgattttgataagagatttatgtagtagctcttgtgagttgaaaagctagggagatagatacaaggaactagaggatgcaatctatggttgggttatttacgtatagggaacaaggacctcgtgaagccctagactattatatgcaaaaagcatgcttttgtttatttctctggggagatagtctatggttttcagcaaattctaacatgattcataaccctaaaaagttgattttttgccttaagaacttactttatatattttatgataccgacttttcactgagtgtctttattattttgagtttatgaaaaatattgcactatgaaatttagccctaaattagcaaattctctatcttgacttacattttctctagtgcagttacaattttaaggctattacatatcttttaaaatacttacacagagaatacatcgatgcaaaagatcacatacaaaatttcaatgtagacctgaacttataatcaaccattgcaatagcctctaatagcctattttatgacaaagtgccatgaggaaactctcaaagctaattgttgaaaagaatgataatgaacaagttttagagagtggacagcaggttataatatttatatataactcattataaattgtcaagtggctttatacactaagaagagaaatttattttctattctggtaaaataaatagcttcagagaagtgaaaataaaaacaggtattttgacaacattaacacgtgttaaccttgtgaaatggccatcctttaccagcctccatctggggttgttctaatgagagaatgtagggaaagtgctatgcatctaacatgtcagccgaagctagctcaaaattcactaaatcccacaagatgtattgaagggctgtgcagcattcctacttgctcaacctgtcaattgttgcttgttggataagaaaacaacattacttttaaaaaatgtcactgaactgcaatgttcagaaaaaataacagcaccaccctttctcacttgcaaacattgagaaatgttcaactacagctttctcctaagaactctgaagctaccaaagagcttttattgaaaggataatgtctgcacacctaccacacctgaattgcaatagttctttatagatctctaacaggaaattttaaaattaaactatattgttaaggacagcttttgtttgcatgtcacggataatctagattttagcttatcagtgttgccccttgtaaaacgctatattgaatatatcaataaacaaaaggatctagaactagaaataccatttgacccagcaatcccattactgggtcaaattactgggtgtatacccaaaggattataaatcattctactacaaagacacatgcacacatatgtttattgcagcactatttacaatagcaaagacatggaaccaacccaaatgcccatcagtgatagactggataaagaaaatgtggcacatatacaccatggaatactacgcagccataaaaaaggatgagttcatgtcctgtgcagggacatggatgaagctggaaaccatcattctcagcaaacttgttctcactcatatgtgggagttgagcgatgagaacacatggacacagggaggggaatatcacacaccagggcctgtcagggggtgggaagctaggggagggatagcattaggagaaatacctaatgtagatgatgggttgatggatgcagcaaaccaccatggcatgtgtatacctgtgtaagaaacctacacgttctgcacatgtatcccagaacttaaagcacaattaaaaaataaataaacaaaggtaatattatatagatgctattcacttgtctaaatgtttttaaaagttaaatttatatttagtttgaagcattcttttcatacctgaaaacatatatttttttaaatggaaatctttttttcacttccctaacaattaaaatatttggcaaaatcaatatcaaactttctaaagtgtgtatggaaatgtaaaggacagctaatgtcttcagatggatttatattacaaaatataagacctattatagaactgtagcatttaagatagtgtagtattggtgagaggttagatagcagtaaatcaatggaacagaatagagattccagaagcagacccatgcttactggtcatcttatttatgacaaagatgacactgtggtgcagtgggaaaataattttttcccccagcaagaactgcaaggtcaattggatagccttatggaaaaaaaaatgaatcttgactctttcatcacaacatacatgaaaatcaattctagatgaattgcaaatctaggtgtaaaggttaaaaacaaaatcttctaaaataggggttggcaaacttttcttgaagtgcccaatattaaatatttcaggctttgcatatcctacaatctctgttgcaattattcaactctcttccatggtagcacaaaataagtcataaacaatatataagcagattagcctgtctgaactccaataaaactttatttataaaaacaggtgacaggctgggtttggattgcaggctatagttttccaatcccttttctagaacatctttttgaagctcaagtaagcaaagatttcttaaactaaaacaaagggtagaaaccaaaaaataagatgtgctatattagattacattaacatttaaaaatgtgtttatcaaaagacactgttaagattatgaaaaggcaatccacacggtgaaagaagatattcaaaatacatatattcaacaaagaatttatatccagtatataaacacacacacacacacacacaccctacagattaataagaacaaagacaatccaacagcaaaaaacaataggaaattatgaaagtttcacaaaagataatatcaaatggccaataaacatgaaaaggttctcggcttaattagttatcagtaaaataaaaaataaaatgtcaatgacatacttctgtgtatccacagatgaaaaagattggcaattccaaatgttgtcaaggatgcagaacaaatgggacttgtaccctgctggtgactgtgtcagtgggtacaactcctttggaaaactgcattatctacttgaggtgatcataggtgtcctttgatctaacaatttcattctttggtagcaacacaaatgtgtccatatgttcatgaaaagacatatacctgaatgtccatagtggcactatccatattgtcacaacctgggaactatccaatgcacagcaacagaaggaaacataaatacatgtgttatattcacactaggaatagcatacagcagtgggaatgacctacaactatacatatggaaagacactgtgatatatttacataatatgcattcatactacacagcaataagaataatctaaagctatatgcaacaacatggatgaatgtcaccttacctccacctcccccaaaaaatattgagtgaaagaagccagaagcaaatgaacacactttgtccctttccctgctttatgtttattttgttctccttttatttctatttaatgtaaatttggtgtttcaaaaataacccacaattcataagcctatactgatacaaataagtgattgaataaattaatcagtgaaggagaagagacacatttgccatgcagaaagctccaaataatttatgtagataacccccatggagctggaacatacctctgccttttaagggcaggctgcacataatgacttccacaatatggacaggaggggagaaaaataactttacagtggagaaggctggcaaacgttacctcagccaggtgattgcggtcgacatcatcactcataagtcatttgacaatatgcagccttggcatgatgtgatgagaatggcactttacatctgtggtcttcctccccaaaacccataaccccagtcccatcatggtaacatcagacatgcccacattgagggacattccacaaaatagctcatctgtactcctcaaaactgtcaaggtcatccaaaacaaggaaagcctgagaacttgtcagagccaagaatatcctaggagacacgaaatctaaatgtagtgcagtatcctggatgggatcctagaacagaaaaaatgatatgaggtaaaaactaaggaaatctgaataaagtatggactttaataatgtatcaatattggttcattaattatgacacaggtaccctactaatgtaatatgttagcaataggggaacttagtacaggatgtactagaactttctgtactatctttgcaagttttctgtaaatctaaaattattccaaaattaaaagtgtatttaaaataataaacaattcatagagtaggcactgtgttacaccgcaactgggaagcgtgctctccaacatcaagttattaacaataacagaatatataggtagaaaacaaggaatagttgcataacccaatagccatttataatgtaggaattattctttgttttttctacaaatttaaatagatttctagtcattaaactttatgaatgtgaattacttctgtttactccaacacattaaggtaggagctttatgaacaattacttagagatattttaagttcaactctttatatatcaaacttcatgcagaagagatgagtgatgaaatagggaatttttttgttagtaattatggactattaaaaattaactttcactccattacactctttcaacaaatataatacaagcatcatagaatgttggaactgaaagggacatttaagagattagttcagctccttaacttcacatgaaataactgagtgccagagaatttgagacttgcccaaggtcataataaatttgtgggagagctggaattcacttattcagttgagtgagcatttacagagtatttattatgtttcaagcactgtgataggtgcaagagatataaaaattagtgagaatttatccttcaggtggaggaggcagggacagggagaggcagaaaaataaatagatgaatacagtacagcgtagaaacaagccagcagacatgaggccagggtgccatgaaatgaaggaacaggttcatttgatacaactcaggcatcacctgagcctttggaagatgggtgggatttacactgatgaggaggccggaacagacattccaagcaaaacagatcacataagccagaggtaaaagagggaaagggaaataatgtgttgtgaagagctccatccagcttccaggaactgcagaatagtgtaagcagggagctgagatggatgaaaccaacaatgctagatcctggagaggattttgtgccatttaatgagctaagtctttatcatgtaagaaatagaaagttattgcaaggttttgaattttagtttggccactcagatggcttagtggaagttagattcgagaaggacaagacattactgggaaccctatcaaagaggttactatagcactcaaaggacggatggtaaacagttggtttagaaaagtggtgataaatatgcagcaggggaggtggagtcaataaatatttaagaaaaatgatttgcgattagttggatgggggtggggtaagtggagtgggtggttgaaggtgttggccgaggagtcttgagctagactcctagtctataccacagatctttggaacttcaaatcacaagaagcacacattagccccgagctacgtttacacatttttccacctccaccctaggaagcagctctgaatatcagcaagtgaaacagttttcgataagcatttaaacaacaacaacaaaactcatatccttttggtcttatcctaggtcaaaaggtaccttcttgccctacacacatataatcaagaggaaccacagaggtgattctttgaagagccaagataatttgcttccaaggcttttgtctttactcctaggctacagagcctgccctaaatttcaggtataccccatagaggccatcatcttgaatctctgccccgacacaccctccattaggccttgactgtgggtgattgtgctgcctataaaagagaatgtatgaagaggatcaagagaaaatataatcagttcaccgttaaaaaagctaaacttcaaatgcctgtagaatattcagttagagaaaatcagttggcagtaggataatcaactctgaaactcaaggaaggcatgcaatttgaaagtcaaaggtcacggtaagagaaaaacatgaacgtggatgccatttttcaaggagagtctctagcataagtggaaaagtgggaagaatgtcaggccaaagatgaaggtcacagggtcaccagcacttgaagtacagctctctagtagaaaattcaatgaagaatttataggttttagaaatctattgcataatatgatgactacagtaacataagcatgtactgtatacaggccaggcgcagtggctcacgcctctaatcccagtactttgggaagtggagacaggcagatcacttgagctcaggagtttgagacctgcctgggtaacctgacaaaaccccatctctaccaaaaaatataaaaattagccgggcatggtggcacttacctgtggttccagctactcgggaagctgaggtggtgggggtcgcttgacccccagaggaggggactgcaatgagcagagatcacgccactgcactccagcctgggagacacagcaagaccctgtcacagaaaaaaaaaaaagaatatactgtatacttgaaaactgctaaaagaatagattttaaatattcccaccacaaaaaaaaaggtaactatgtgagatgatagatatgttaattagcttgattgtggtaataatttcacaatgtgtatgtatacgaaaacatcatgttgtgcagtgtaaataaatacaatttatatttgtcaattcaacctcaataaaactggagaaaaaaattttaaaaaaatcaacagcacagtcagaaatgtatcagagaaactagaagagagttgtatcccagagcacagaagttcaaatagttttcaaaacaaagtgatcaattgtattgaatatagaagaggtgccactataaatagcttttgtaaagatattcattaaatttggtaatgaagaggacaaaggtaactttagtgaagtgatttcactgtagtgcttgtctttagttgcagtaaggtggattgaggagtatgtgagtgaagaagttgagactgcttttccacactgttctttgaaagtgtggatgaaattggaaggagaaaggcaagaaaaagtttaggagcagagccgtgggagactcttgatcttgtctgtttgatttgggatgagatgcttagtatatttgtaggctacagggaaggatgcccccctagaaagctggtgttgacaagagagggcattatgaggcagagtcctggaggaagaaggagaggcccaggccagggtcataggcacacagaatgggggctggcattcaacagtcaaaggatgatagggatatttctttttcaggcccagaaaggaaggaagcaagccatcataaatgaatatgtagacaagtttgtgagaatgtgtgtatgtctctcagagagagtggtgggacagaagggagttgaaagagttcatacttgactgttatttatttacttattcatttttttttcctagtaagaggtaaggtaatctgctgagaataaggttaggtggagttctaggagagcagtgagtatttggatgaagactgaggagagtaggcaaaggaattaccgaggaaaaaaataagaagattaaactaagcgggagggttcttttggcattttgttttttgttttcagacgaggtgtgattctgttacccaggctggagtgcagtggcacaagaatggctcactacagcttggacctcccaggctcaagggatactaccacctcagcttccctagtagctgggaccacaggcacgagtcaccatgcccagctaatttaattttctgtgtgtgtgtgtgtgtgtgtgtgtgtgtgtgtgtgtgtgtgtgtgtgtgtgtgtgtgtgtaaagatggggtctccctctattgcccaggctggtctcaaactcctagtttcaagctgtcctcccagctgggcatcccaaagtgctgggattacaggcatgagccaccatgctgagccatgagtgggagattcttaattgggatcagcaacaatctatagtcttgcataatttttcagttgtactcaactaccactatttagttaaaggcatttattaagtattctttactatgttcttggcattatgcattgcaaacattaccacaaaccacagtaggtaggtacatttattaccccaatttacaggttaagtaacttctccaagtttgcacagctggtaaaaaggcagaacagaggcctgtccgactccaagccatatgttattttccatatgttatacttcctcccaaggagttggagctttaagaattgataagacattttgcttagcctgagaaaactcctaatgcacaagagaagatatgccaataaataatcacaagcaaatgtgaggtattgatatgctccaagagcagagaacaggagcccatcattctgatgaaagcttcagggaagcctcagggggctggcatctgagcactgactaggtctgagtttatattcaccaggtggacaaggagtctggagcatcccagacttggggactgtatgagcaaggacaaggaggtgtgagaaggcaacccagttttgctcaatgcatctgggacatagagtgactgttgggtgaggagtggaagacttggggggagatatgagatcagataataaggggtattttatctactgagaactttatctggtaatcaactggataacatgtaaggttttaaataatgatattagatttgagttttgcaaacatgatcatgttggtaacaggcagggtggaatatagaatagggagatcaataattataataattataagctgtcacttactctggatcaggcactatgtaagtgattttcttagattcagcaatttaatcatagaaaagaaagaatgagccccaggtttctagctctgaggccagtgttctttccactgttttcttatttttcatagttttcttgtttatatctaaacataaatcttctgacactaataatcattcaaatagtgtccctacccaaattcatgtctatgcagaatctcggaatgtgatcttatttggaaatagagtctttgtggatgtaattagttgttaaagtgaggttgctaagagagtgggccctaaatcccatgactggtatccttgtgagaagaggggacacacagaaaggaacatgaaggccaagacagagattgggatgatgcagccacaagccagagaatgccaaggattgccaggacccaccagaagctaggaaggggctaggaagaatttgtccctagagtcttcatagggagcatggctttggtgacaccttaatttggggcttttagcttccataattgtgagagaatagatttgttgtcttaagccaccaactttgtggtagttatggcagccctaggaaactaatacacctttcttgttatatttccagctagggatatattcttatatgtttataactgtgtggattttgagggagaaatcactcatagttgatgatctcatgggcctgccatctttgtctttattgcatttcactgtcatttgcctgatagattaatctcatttggattccctggggcaaatcttgttttatcttcatgttgatgttgctgcccatactcaagtattttgggttacaaaagcagaattatcttttaaccctagcctggcagtaacatgaagacctactttataaccaaaacaatttctatgcttgaaaaaaagtattatataaaagtactcaagcctgctttcaacttgacttttgtactgacctaggggttgacagagtctgcttttattcaagactggaaatatcaggagatgtttgcaaagtacatgataagccagttaagcagttgaacacaaagagagtctttttatatcttatttgaaacccctgagttttgacaacatagaactgtgaaattttagagctagccaaatagaattgacatgcaatgaataggagttaaaatcattttaattttgaccaaaacaatagtattgactttaaccctacatcatttttcacttttgctgccaaccattttcttttgacatgtcacttacatttgttacctacttcacaaatgctcctgggattggttctccttacaattcatttttcataaaggaaagctggacataaatgcatttgaggttttctagggttacctattcagactcttcagtcacagagacaatcttatgcaccctctctctctctctctctctctcccacaagagctttcaggtacatcctgatgataaagagaaagacatgatgacttgagcagttctatgcagagcatcttctccacaccctataccgtggtcccacacagcgcagttcatttcatgcttccccatgaatgagagtattgtaagttctatgtgcatgaagaaataaatgattatcccattctccagaaacacaaatgccgtatcacaaagcatgcaccattttccttttaaaattccttcctgaaaagtgtttgtggttgttgttttgatgaattaatcatattaggacacagaacgcagatcataagctcagtgatgaagaaactcgtaacattcaagtttcaatggaaatgtttcctgctcagaaagtccccttgtccctttgtgtctcctaacctccattttattttatcataacaccaggttatgataaaaccataatacctggttttttatcataacaccaggttatgataaaaccataatacctggttttcttatttattaatgtattcattgtcctcttgtctgtctagactcgtaggctcttacgtgccttatcactgcattatctacagagcctagaatggttcctgttgctaatcaaatgtttttcaatgaatgaatcaatgactacagctagatatcccaggaattataaggagtaagaattcagagaaagaaggagtagtggaagctgtaggtaactgaagacaggttttttagtagagcagtagaagcagggactctggtaggggacctagagagaaaatctttggtaatgtcgggaaggagttagcttcaagtcttcagagacaaaggaaagaggcattcagaggttgggcacaaaacagttatgagtgggagaggatgaatgggcatttcctagagttgtgtccttcaggcagctgtagagagagatggtggagggggttatgtaagctgaacactctcaaagctgacctataaaatatactaagtaaattggactctcagtaaaggaaattgcccaattcctaagcaccattttcagaggcttcacaataagagtattcattctgaaatcctacatttgcgtgtatatacataactccatggaaaatgaccttataatatagtaatgatgtgcaatacagtaacatgctggaaaaaaaatagtgtagactttgaaatgaagtaactaaatcacaatatgcaagacatattcaagcaaatattcagataaagttacctgtcagtgggatgtgtctttgcctgttctctctacctgtgattccacatggctttatataggaaacaagagaggcttatttcacccaaaatatcctaggtatttttttatcctcgatattgccagataaagaaattatagaaagaaggcagagcatatcattgtgttgaaagaaaagtaaggaactctagttatatcaacattacccaatgtcacctggttacattaaaaagttctgaataaacagcttgaggggaaaaagacattttctttttctgagttaatatgtctctgtgctgtagtctgggcatcttttcaactttcctttgttgacttggctgtttttggattggaggcttctttttcttatctgtgtggaggaatgcttttctaactagagcctgatgattttgctgagatgacaaggcttgtgtgggtttaccacagaacacaaaaggccgtgtagcccaaaaagaactgaaatatgttctctaatacccaagggcttaccaaatgtggaggtaacattcacattccaacatgaggagctgccacaccacctctcctggctctattacctctggtggcaatctcatccctcctcgaatcgtcaacccttctggccaagggtcgggtacacattcagccaagtgctgtgatggacactctttcctttggagagagcatgatcaagatgtgaaggagctgcatgtgttactgactgtgcttccaaaccaccactgctgttcagggcattgcatttctcctatatgtaaaaccttccctagattccaaacttgatgagtcaagacctgatagagagaagagaagagaagagagagagcagagagaaccagataagtggatgaaagatgtaagagaagcacagtcattgggagatttctgctgtggaggggagaagacttttattataataatattataaacaatagttactctatgaggtaatgtattcactgcaggtaatagaaaattagactaacattggcttaatgaggtcaggatttattttccccacacaatataaaatctaaaggaagtcaggcctccacagggtcttgcaggactggggctctgtctggcctacttttctcaatgtgtcatcctcatgttcgtcctctcatggtcacaagatgattgctgcacctccaacctgcattccagtcaagtggcaaagtgaccaagaggctactagcaaggcttttcctttttatgggaaaagatcttcttcgaggaattcctacccatatccctttggccagaactgagtcatgtggtaatccttatgtgcaggagagactcagagcttgggaattcactattctagcctccgtggtagagattaccccagaagagagaaagtgatggtaatggattctggattaaccattatgagtcaagcccaaattatcacataatcaaaggaaaataatacatctaagcaccaaactacaaaaagctaaacagcagtttaaaaatgatcaaagattatgcagccagaggcagcaacatcagccaataaaggtaacaccaaccaaaagcgattgaccaacactaaagtgctttagacttgcttggctttcatttagcatctcatgaagtatttcttctcttatatcgttgaagacaaacagaaaaaaaatattttagaattaacacagagtattttttctcctgggatgttagaggaacacatgcctgcctgagtctccctggcactgtgactatgctcctttggtctggggcaaagcttctagtagcaaaggttgaagacaccatggagctgggattgtaactggaaaacatgacaaggatagggagttagtcaagaacaggagcaggggtcaggcacagtggctcatacctgtaatcccagcactttgggaggccgaggcgggtggatcgcctgaggtcaggagtttgagaccagcctgtccaacatagtgataccccatctctactaaaaatgcaaaaaattagctggacatgatggtgggcgcctgtaatcccagatactcgggaggctgagtcaggagaatcccttaaacctgggaggtggaggttgcagtgagccaagatcgcaccattgcactccagcctgggcaacaagagcaaaactccatctcaaaaaaaaaaaacaaaaacaaacaaacacaaaacaaaacaaacaaacagaaaagaacagtagcaggcagaatttgtgtatttttctcatttttccttcctctctggcacctgattaacatttagccttcaagttgaagctaaatcatcaccgcttgcttggagtctattgtacctcctgggtgcacacatcacagagttacatccattcccgcaataaacaattacttagaagccaccatgttccaaattctgccataaaccctgggtttaggacagttcaacctctgctgtctagagtagcactacccaagagacatataataggagccccataggtaatttaaagttttctgttatttacatttaaaaataaacaggtaaaattaattttaataatagatttgatttaaaccagtatatgcaaaatattactattttgacacaattgttatgacatataaaaattattagtgagatatgttatactctttttttcatactgcctccaaaatccagtgtgtattttaacatagcacacctcaatttgaaccaaccacatttcaagtagtcagtagccacatgggtgagtggctgctatgtcagacgatgttgctctagagcttacagactataaataatgatttattataaaacgtgcttaaattctttgtagattctggatgttagccctttgtcagaaggatagattgcaaaaatttgtaacaaaacttcatgttctacacatgcaccccagaacttaaagtaaaataaataagtaaataaataaataaataaacatgctaactatgcctaataaatgtctaatttatgcagctcacatcatttgggaatggggaagcagtctcattgaggaaaggtagtggcttctctagtcagttctccatatgaagtcatttgtctcagtgatttctccattacccagagtctagatctcagccacacgggtttagaaaaacttgatttattcaaagtcctaaagtttatttacttcgcaatactggcctctcacaacagaaatctgagagaccggtgtattagaaatgagaatcctgggccgggcgcggtggctcacgcctgtaatccctgcactttgggaggcagaggcgggcggatcacgaggtcaggagattgagaccatcctggctaacacagtgaaaccccatctctactaaaaatacaaaaaattagccgggcgtggtggcgggcacctgtagtcccagctactcgggaggctgaggcaggagaatggcctgaacccaggaggcgagcttgcagtgagccgagattgtgccactgtactccagcctgggcgacacagcaagactctgtctcaaaaaaaaaaaaaaaaaaaaaaaaagaaatgagaatcctggttcatttgtgatgaaacatgtctgtgcatttgtattatctccacagaccagggtttggctaccctgacctgtgagacaaatgcagccccccacctgtttttgtacagccacaaattcacagtggtttttgcatttttacatttaaaatgaaagaagtcaaaagaagaataaaattttttgatgaaaattgtacaaaattcaaatgtcattgtctataaataaagttttactggaacacagccatactcattcatttaagtattatctataactgcttttgtgctgcaatagcaaagttgaatagttacaacagagaccatatggcccacaaagcctaaaatatttactatcttgcccattacagaaaatgtttgccaaacccatgttatgtatgtgaatcacttgaggagctttagagatgtacaactattcagcactactctcaagtaattcagatttaattagtctctggtgaggcctaagtatcagtatttaaaaaaaaaaaaaattgaatgctgtagccaatctatgtaggaagccaaagtaaccagaaggttgtgtggaaatcatggatgcagaacaaagagaatcaagaaagtaacttgagtacccgtcctcccagtccatgcctgtcagcatacaggccacttgagtcagcatgccaaggcacattcttctgagtcagcactcatccctgttcctattcacctctgtgaccttgatgttcctacatttccaaacttaatcagctcctctattgattggcacattcttcctgtgcattcaccagttaatcctgccttatcagcctgagggccaatctgtctctctaacatgattttgtttatgtctgttctgagtcactatgtgctgctttaataggtttcttaagaccaatctgatttttctgttttgttgttttccaaaatgtttcctggttgcctcagtgcccgtgccttagacaacttacattccaattgctgcttttcttgggtatctgcatttccagcctgacatcaactagtcacttaagtgtttggtggatgggctcattggtagctgaataagtgaacggatgaatgagtggggaagaaaagtggggaaaaaaatacaggaggaattttgtagactatgtattgtgagtatagtgaattttaatgctctagagcttacagactataaataatgatttattataaaatgtgctaacaaaccagaatgtccagattcaaatcctgactctgctactttccctggaaagccccatgggaagatccctttgcctgtattaacaagactttggatatctgtaagatgggaagagttacacatacttcacagaatagtatgcggatgacttatcaaatacagtagcacctactccaatgcctgactcataacagcttctaaatagaaagtttcattcttcttccttctgtttagctaaggcatcctttcacacttaaaagggcctgaattgtttatagttaaaaatagtttgctgtcttatttattatactatacagcagatagcagtattattaaagagaacttggtaaaaatattttattgtttgaacaaatagtttataacaatttttcaaataattctggattctataattctatattaaccttatagtttgatgccatggtactaataatggaatttttacaataacagtatcatatacctattcatttgtagtccatgtctttttttgtataagatgaaattttattttttcttcaaaggctttttaagttttaaggtaggatattacttaatttgaacccatgtcttatattttatatccttaggaaaaacataggccatcctaaaaaccttgtcctttcttatttgttggtttctcaatagctgtaggtattgaaggattaaaagttttcgaccctagcttcacattagaaatcccagaggagatacttttaacctttaaataccaatgccaagccccagtccaaaccatactttctgatggtggagccaaaggcattatctgttttcagtcttccagatgataccaatgtgtagccaaagttgggagctactaatctaaacccaccctccatggtttttgttcatgtgtatgtgtgtgtgtgtgtgtgtgtgttgagacagtcttgctctgtcgcctaggatggagggcagtggcataaacttggctcactgcaacctccgcctctaggttcaagggattcttgtgcctcagcctcctgagtagctgagatcacaggagcccgccaccacacctggctaatccaccctctatgtttaacatatgagatgaaatgaagtacagaggtgaaacgattggctcaaagcccttcagcttaactgaaactgaaactcaggtgttttacctcagaccagtgtttcaggctaatcctaaaccaagaattttaggacatacagttttcttgatacatacaaaaacttcactgtaaggaatatttttcagttaatttaaatataacttatatagagaaaggaaatataacttgttatagaaagagtatcagtgatagaagaattaagtatacttcatgtgttagatgtggtgacttattcatcattaggtatgttttgtgaggtagacattatcatttataaatttcatatattttaaatgaggaaactgatacacaaagagatcaatagacttgtattaggtcacacagctggtgagtggcaaagtcaggaaaggaactcaaaacataggacacttagtcccacctttcttttcccttcctaaaaatagaaccctatatttgtaaaatataatttttgttttgttttccttttggaggccgagtggaaaggacctcttggataggagtggtgaacaaaatgcacttacgtttcacaaaggaccattttataattaacttggatggggcccagtgcgagagaacagaagaatagtattgagatgaggggatcctgcagcgtccaaatagaattagaactagacgccacttgtcaagataaatgtttgacaaaacgggcatgtctctccagaattcattaaaatgttgttttaaatattaacaatttcttaaagcaatgctgttgatgcttaagaagttatactaacaagtttttctttattcttccttggtccagctcttttgtgctctatagaatgactgtaatcacaaaataagctcccaaagtagtgaaagttcctcaatataaatgataaggccactaaagcccagagaagccatatccaacatcacttgagctagaatgcaatgaagatgaatttagtagctaattcaatttgacatcaagttgagctacagattaaatatagaaaaatagccaggcacagaaagacaaacttcgcatgttctcacttatttgtagggactaaaaagtaaaacaattgtactcatggagatagagaataaaaggatagttaccagaggctggaaagggtagtgatgggtgcggttcttcacagagaagtggggatggttaatgggtacaaaaaaatcactagaaataatgaataagacctagtgtttgttagtgcaacagggtgactatggtaaaaaataattttattgtacatttaaaaataactaaaataacatgatcagattgtttgtaacacaaagaataaatgcttaaggggatggatatcccctaaataaataaatgtaggaaaaacttggataaatgtttctattagggaaaaataaagtcatttagaacattaaggacattaaaagaataaagtacacggtattaaacttgaagataaaaaaacagagtttttaggtccaaagaattatattcagtgtttgtttattcaacaaagggtttttgtttgtttgttgttttgttttgttttgtttgtttttagtatgtgccagaaatggtcctgggtctggaggtaacaatggcacacatggggggaaatcatcaataaacagtcaataagtcaataaacaagatcatcgcatctttgtaagtgctctgaagaaaataaacaggatgtggtcttggaaagtggatgagaatggcttcttccgtagagaagctgcgaggcctctcgggagaagcagcatttgaggtaagatctgaaagctgagaaagagccagccacaggaggagctaaatgcctgagacagcagctatgcatatgagagcaatagaaaagaggccaaagtgtgctgtaatgtatgtccatgtactcacacatgcatatccacacgtgtgtgcatgtgcgcactgaatgatgacaaaatgtgaacatcagctagactagtatccagaaatcaggataggtaaattcccttgacatcatattttgaagtgttctaactcccttttctcctacccaatgccctccccctcaccccaagcacacacatggaacttgggaaaacattaaaaatattgacttccagaaaggtacattacatctttatctctagttcaggatgtcatatcaaatgactcctgcctatgcctggttggtggattacttttgtaaattcaactatttggaaaccactagttttcaaaagactaatgtgcagcaaaagaaaatgtctaagcctgttttgtgctgctgtcacagaatacttgagactgggtgacgtatagagaacagaaatttattgtttcacagttgtgaaagctgtgaagcccaagattgaaggaccatgtctagtgagggctttctttctctgtcataatatgttggaaggcatcacgtaccaagagagcccgcaggagagatggaaggggccaaactcatccttcataaggatgccacttctctgataacagcattaatccatgtgagggcagagcccctatgacttaatcaactcctaaggtgctgctgtcaacactattgcattggagattaagttttcaacacatgaactttgggggacacaatcaagccatagcagccagccactatattttcatggaaagaaaacatattgagactcccacaaagtaaacttctttggatgccatgagtgtaaaatcttgatttgagcttcatttcatagccatggtggcaaatcaaattgttaaatatatttgtgagtctataattatggagaaagtcattgtctcataatatattccaaaaatgtttaaatatttgtttgtcctcttcttttttcagtgtctcatagtctttctcttttaccatgcccatttatttcttgacatcaccattcatgaaccttcccaacatggttttaagttcaagcttcttgttttttctgctttggtaggatcttgctataccattctcttgcccttcgaagcacaataaagccaataatagagacatcttcttgtatcagcattttggaatcaatattttcataggtcttttacagttaaatcagctcttggataaagtggaactttaagaaagtctggactttaaaatgactatattctggtaatcacaaagtcataaaacagagcatttcagtgacgatgggtcatgttttttcagtcttaatttagaatttttttcaactgactttgagttgctgttacaattcaacctgcctctggtgttttatatgccttaaaatttgtggctactgtataataaccaggaaagcgtagctacagggttccaattactttggcaaaggagccttattacattgtctccaactaagcacataattaatgtctctatttcaaggctatttcagcaaattcaaaacccagaatctatccatacatatttagggatgcatgggaacacttgtgatgtcttcattgcagcagacagtaataccagaggaatttttggaagaatatggaatactttatcatgggttgcaaatattttaaagatgtggtttgaaattaaacatgttgttctaaaaagtctccatgggaatagaatgtaatagaattacccacctcctgggagagtttttttatgggtgagacattttcagattgttacaacgtctgagcaggcattatatggcaagagagcacataggagatacatatctgtctacagtgcgtagggcatttgcaccttgagtatcctgctggacagttatgtaggtaaaaagcctgtttgtaatcatctgaacttaagcttatctccattttgcaaataaacacaaagtatttttgcacaatcttaatactcactgaattttgcagaaatgcagctaccatatacatgaagagaatattgtggttagttttgttcggaactttaccaagaattggtcaccatttcaaaaaaaaatcacaccattgatggcagcacagcttgtggcatttgagttgccaataaaacatgcccatattattatacatttgcagcagttgcagttgcgaggattctgcatttaggtgccaccatccaacaatttaattatattttgtaatcaagcagatcatgcccaaacatttacctatagaaatacatttttgtcatgaattcctcttcttatttttccccttatattatgggggagttggcattttgtatttaggcaaattattttattcattaatttcttttcagaatactagagggacatttaattatattatcaaaggagagttaggtgagataagatcaagaacaattctgaaatatatcactcctccaagaaaaagggggatgtggtgcctgcgcacacatgtgcccttcaatgcgaagaaagaagcaggaaacggagatgggagaattggccttgatttcagctcttattgagtgtcaggccctgtgcccagcctttcaaatgcatgatctcattttttgtgcatagtgctgagaaatgccatgtgtgctttgaatcctgtagccccagagtgccacactgggagctgactgcttgacattcggagatcagagaatgagaggaaatgagtatatgaatattcttgacattgctggagtgttagaattatttaaaagttctgttaaataagtgacagtctcagagcctgatgtatggtagttaatgaaattttcacaaagaagtattatcataaaattcgaagaaaatcatagtagctgcgcacacaaattcacatgcatatgaatgtcagtgcacgttggtgcattcatgcttcctatttatagctttcgggacacatccgaaagtgataaatgaacattgaaatgctacacatatgtttatatccacttttagctatggggttgtctcaaaatgtggtatctccactgagccaaatcccaggcatttagaaagtacgaaaaatttaaaactttaaagtgaaccaaagaggagagagaaaaaaaaaaaaatcctaaaactgagagatatggcaatcataaacctggcaccaaattactttttaaagtacagtatgaaaaatgaaatgtgtcagaattggttactaatacttctttgttggctaattgtcatttttcaagtgttggctaattgtcatttttaaagactgataaaagaggacctttccgatacacagatatcatggcatttttaagccttgaggttaattttactatatataacatttcaggggtgcaaatgtaaacattataatttcagataagggacagattgctttcttttaaaaatgcccaggtaaagctaaaggttagcacttaatgaggggtgtatgtctgttcatctctttttttattgacccgaatattgctgtaagaagaaataaaacaaagcaagagaccaagttcagaggagagagtacctgtgctgaaaagatggcgttttgcaaccactgcaataaaatgaaaatgactagaattttgaaaacctttttcttaagtttcatttggttgcaagttacagaaacccaaataaaactgatttaagcaaaaaacaaaatgttaggtcacctgactaagaagtccaagggtattgcttgcttcaggcatagctagatacaaggaattgaattttgttaagttgtctatctctcttgccatctcttgactctgctctgtctcatctgaattgacttctgtctaggtagatgcttccgacatgttggtggacagaagcataatatctaaattattctaatccgagcaaaacaaaactttctttttccaaaaattaaaaaaaggggggagtgcgtgtcttattgaaccaacttgggtcacatgccaatgaagcaaatactgtgggctggggcatgaattatgctgattgccaggccaaggttatgtgtctctaagataggagcagagaggtgtcagccccatcagaacctgaaccaaatgcactgataccacaggagatgagattctataccctccaattgctagtggcccaacccaagagggagcagtcagatattgcaaaaatttgtattgcatatattatagtaacataaattttaattttgtacatatccctcttgagatgcaagaatgcatagttagagaataactgaatttcaaaactgaaaaagatcttgtaagttatgtagttgaacattatcaatttaaatatcttttgagaattcactcatctttaaattgagtcttgctaattgcaaaaactggttattgtatagcagtgcaaaatactaggtgggagtaatataacatatgaatcagaattgtattaaaagcatttgttgtatatcccaaagatattttaggagtcactcactgatgtgaactacagggattattaccaaaagtttacacaaaaattgttttaatctgattttccccatcccagctatgttatcacttctaaagtctctattattatcatgactttttactcagtttaaaacgttcattgaaaagtaattctaacttctttttgtatatatatatatatgttcctctgctcactatttctcctaattattacagacaaggacaactggtgtgccctgtttactaggaaaaaacaatcacttcataaatatacacctttcagaaaatgtacacctttaaaagaaatccaaagtgaaccccaaatgtacagtcacacactcaaatccaaattccaatagctcacactaaatagagaagtatttataatagaaatgtatttgtgtttctaataaccaatgagtatatgaatattcatatttgcctattataggcaagtcattattaaatataatttatggaagcagttacaaaatattaaatatattttgaagtaattgccaagtcctttgtacaaaggaagagaaatttgacccaaactaataatctcccattatttgagattttgtcattgtcagtttgagtttacatttgaaaattatgtgactgcctggaatcccactcccaagcctggacaatgatgtaggtgttgtatttcaaaactagccaggaccacagagagctaaaggagctcttttttgcctgcaactggttacctcaattcattagagctgataatgaggccaaggccaaggccagggctatgacctctgtgaatgtcctaagctccctggatatgaggccacagaccatagcactgtccctgtccttaaggagaataagattcgaaggatatggacagagtaatgcaaaacactctccaacattataaggccctctacatagcatgctatccagtgctagtggccagactcttcattccagagttattcacatcataaatgggaattataaaatgataggaatctttgctgacccatgaaagctgatttaaggtttcaacataattagctgtatttgtgatattaagacagtaatattaaattttgcaagaaatactgatacaaaaaattccaaaggtcaaaattgaaatacaaatagatactataatgggattaaagggcaagaacatctaatggtgaatctgttcaatgaatataatgagattattctcaggcagatgagtccctagcttaaacaagaaaatgaactatgcagagcagagatataatattgcaacttctatgaactcactgcctttacgttttgtcaacacacattaattctgatttcttttaggacaatcgaattactatgacaagtatcagcaaagcttcatgaacataaataaatttttatttaatcctaaatttatctgaactagctaatttattcactattcccgttagaacagcatatcaaataaaaactcacaatgcccatgaactataaaattctttaatttatcaaaatattaagtataggccaggtgtgatggctcatgcctgtagtcccagcactttgggaggctgaggtaggcagactgcttgagcccagcctgggaacatggcaaaaacccatctctacaaaacatatgaaaaaattagctgggaatgttggcacgcacctgtcatcccagctattcaggaggctgaggtgggagaaccacctgagcccaggaggtcaaggttgcagtgagcagtgatcactccactgcaccccagcctgggcaacagaataagaccctgccaaaaaaaaaaaaaaaagtgtttagtataaatactgcttgttatagttacattgacaaatacccctaacatgctatcagagctcagccattaagttaatgttatatttaataggttattatagtgatactgtttagccaattgaggttttaattgtgtaagtaggatacattacaaattaagaaactttattggatttttatagaatagtggcttagtgcatgagttataacatagacttatgatgtgaataaacaacaaaataagatcaaattttggccagtattttgagcaggaaaaaatcaacatattaaatcattgggatattatttataattattaaaaactcatgaattcttaactagaattataccttctatattcattattagttatgaattaattcttaaatggctcaaatatgaatatcaccatgtgtaagatgctaaaccagtcactgaggaaaaacaaataaatgtgaaaattgttgacctttttaaggaatttatggcctagaatgtatgcaagatataaaatactaaacaagaagcaatttaaagcactctgtgatacccatgagtgaactggggtgtaaatcctctaatacttaaaaaacagaacacagtcactatgagattgtagctaggtcttcagagattaatatacttcatattagtaacatgtgcttgaaagttcatgagtatgtccagatacttcttatctcaatatttccttggatgtaattactctacttctttgaaatatcttttaagctggtattatggtttgaaggtatcctgcaaagtttatgtgttggaaagttaatccccaacgcaacaatgttgggagggagggcctaatatgaggtgattcagtcatgaaggctctgctcttaaatggtttaaagttgttatgacagaagtgagttagtcatcagaagagtgggtttgttattcaaacgagtttggttctctcacttgcatgtgctctcctcctcttctgccttctgccatgggacaatgcagcaagaaagcactcacaaaacacaggccccttggacttcccagcctccagaactgtaaaaactacatctccattttttataaatcacccagtctcaggtattctgttacagaagcacaaaacagactaagctgttatttccatttcaagcattaggtttcacttagtgtaatacataattcataaatgtgaatattctcagttaggtgcacagaatgggattgatcaagcccccagttcatggtacacagacattaatagtcctgagattggcttcctttttatataatacttcattttaaaaattgtatttgtctaccctatctcctattttcaatcccattttccctatttgtgtatatttaatgtaggactgttcacttaatttttaaatttttatgaatgcatatatatgtatatttatatacatatataagacatataattatgtgtgggatatgtttttaaatttacaaacatttagttatataaatggcaaagagtggtgtatcagccagggttctccagagaaacaaccagtaagatattttatttatatagagagacagagagagaagagagacagagagacagattgctttcaaggaatttgcttgcttacacaactgtggggactgggaagtctgaaatctgtaggcaggccagcagaccggaaactcaggcaggagctgatgctgtagtcctgctgccgaatttctaaaggaactcttggttttgctctttagtccttttggccaattgaatgaggcccatccaccctgtcaaggtaatctcctttgcttaaagtcaactgattgtagatgttaaccacatctacaaaatgccttcactgcaacagctctattattatttgattactgggtactaccatttagccaaactgacacataaaacttgtcctcatacatggcttctggtttcctgttctgcttaagatttcccccacttcttcaagtaactttattttaatttataactatacacctagcttcaacaacagaatacacttgtggacttaggttgtataccatttcaactcaagaaaaagaatctgtattttctacagtccagtctagtaacatttctttgagatcaaacacggaggttccagagtttgaatgtgaaatgaatacgatggaggcactgaaactggttcttggcatcatagtccttaactgtgggactgcctgcagtcctgttcttgaatgagaattataaccagccttccttgagcacattctgcatgccataccttgggccaagagctttttatgcactttaattatttctcacagcaacctcataaaactcttccaaatagtgtaacagagaattaaatgtgtagccctccagatgatactgaagaagcatcaagctactttgaaaaaaatatattttaaattttatttattatatcatatgttctatttactatattttaaggccatttagaataattcagacagaggaaaaaaatttactttgattactagtaccttattgtgtactttaaatctgactcttgataaccagactaataattataagagaaagcctacctttattcccactcctatatcagactgtctgagttacaatttgaatttcaaaggtaatgccacacactttttattgataggaatagtttcagaaggaatggtaccagttcctccttgtacctctggtagaattcggctgtgaatccatctggtcctagactctttttggttggtaagctattattgccacaatttcagagcctgttattggtctattcagagattcaatttcttcctggtttagtcttgggagggtgtatgtgtcgaggaatttatccatttcttctagattttctagtttatttgcgtagaggtgtttgtagtattctctgatggtagtttgtatttctgtgggatcggtggtgatatcccctttatcagtttttattgcatctatttgattcttctctcttttcttctttattagtcttgctagcggtctatcaattttgttgatcctttcaaaaaaccagctcctggattcattaattttttgaagggttttctgtgtctctatttccttcagttctgctctgattttagttattccttgcctcctgctagcttttgaatgtgtttgctcttgcttttctagttcttttaattgtgatgttagggtgtcaattttggatctttcctgatttctcttgtgggcatttagtgctataaatttccctctaaacactgctttgaatgtgtcccagagattctggtatgttgtatctttgttctcattggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggagagctttacttccaactatgtggtcaattttgggataggtgtggtgtggtgctgaaaaaaatgtatattctgttgatttggggtggagagttctggagatgtctattaggtccgcttggtgcagagctgagttcaattcctgggtatccttgttaactttctgtctcgttgatctgtctaatgttgacagtggggtgttaaagtctcccattattattgtgtgggagtctaagtctctttgtaggtcactcagcacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgacgttagctggttattttgctcgttagttgatgcagtttcttcctagcctcgatggtctttacaatttggcatggttttgcagtggctggtaccggttgttcctttctatgtttagtgcttccttcaggagctcttttagggcaggcctggtggtgacaaaatctctcagcatttgcttgtctgtaaagtattttatttctccttcacttatgaagcttagtttggctggatatgaaattctgggttggaaattcttttctttaagaatgttgaatattggtccccactctcttctggcttgtagggtttctgccgagagatccgctgttagtctgatgggcttccctttgagggtaacccgacctttctctctggctgtccttaacattttttccttcatttcaactttggtgaatctgacaattatgtgtcttggagttgctcttctcaaggagtatctttgtggcgttctctgtatttcctgaatctgaatgttggcctgccttgctagattggggaagttctcctggataatatcctgcagagtgttttccaacttggttccattctccgcatcactttcaggtacaccaatcagacgtagatttggtcttttcacatagtcccatatttcttggaggctttgttcgtttctttttattcttttttctctaaacttcccttctcacttcatttcattcatttcatcttccatcactgacctctcattctttatgcagcaaaacaatgggagcaattttaggtccctcaaacatttttacaacaaaataaacaatcctctttttacttaatctgcagataaagttaaccattgactcagctttgtccctcatgtgggcaaagcaaaacccaacctcatatcgttactttaacttagaaagaattctgtttgtgttagttatagtctcattttggtaacatagatcgtaagacataattctgaagatgagctttttgcacatttctgaatcaaagtagttggtttagaaagagccctgtagtctgcatagaggaatcctcttaaggtccaagaactcatgtctcaccaccagttgaaaatagagcagaggcctgaattcagagcccccggccctgaccccaactgcagccgagacaattacactgcattctggtcttactagagctcagcctcatagaacttgttcttgtaaactctgtgctcatataaacatgcacctctgcattgaacttaaggaattataacgtcatcattgtattgccgtgactgcccctatttccttatgattcttccacagccctatcaactcctaggctgcatcactgttaaagtttcctgagataatcaggaagattttctaagagattgcaccaggacatttgttcaggcctctaatatcagaaccttacttgtttcttgaggcaaccatggagttcagtctcagaccaaccacaatcaataattgtcttagacacaatctttgttcctatattcccactgattctccttgttttaaaagaaacaatttcagaagtgaagaggggcatgcaatgccacgtacacgttcattctcaccattttaatttttgcatataaaaacctgcataatagactcaacaaaaatctgggctgcgaacagatagttaatgggagaaaagtcacctcactgcctcattgctaactactaagagccatgcctcccaaagtcttgtatgagaattgccaaacatataaatttctccaaggaccttagttctcacaggcttttctgaaagtttatgcttaatggttttcatttccaaaagtagagcttataccagctagttctgcacaatgtgtccacaccagaatattccctacaggcactggatctgtcctataaattagtctttatcagatttcttctcagaactctggaggtttggcgacattgtataagtactttaattgttatgtagttttgagaaaaagaaaaaatactcctaatatgttcacaaatcatcaccctagaaagtattagacctacttgttgctgtcagatactttttagttcgttggttctttgactaaatacttaatatcatgatcttcctcatctttttaattttcctgaagtggcttttcagatattcccctaagataggttcttctaaactgttataaataatacttttgtttgtgagtaatataagcccaataatcttcctttgaataacttaatagctataaatagatgcatttcaggagataaaataaagcatagcaaattataaaacatagactcttgaatataagcttgaatatataaatatagattgatataaacttgtgcatttatataaacttacatgtcaccattctgacttttttgagaaatgctttacagtatactttttaatgttaaatttttgtgagtacatagttggttgctacatttatagggcatacaaggcatgataatcacatcacctcaagcatttattcattgtgttaaaataatccaattatactcctttcattatttttaaatatccaataaattactgttgactgtagtcaccctgttgtgctatcaaataataggttttatttattctatctaactatatgtttgtacccattaaccatccccactacccccacccctccactgcccttccctagtctctaataaccattgttccattctctatctccttaagttcaattgttttgatttttagatcccacaaataagtgagaacctgtgatgcttgtctttatgtgcctggctcatttcatttaacataatgactctagttccatctatgttgttgcaaatgacagaatctcactcttctttatagcccggtagtactctatagtgtgccatgttctatttatccactcatctgacaatggacacagattgcttccaaatcttggctgttatgaatagtgtgcaataaacatgggagtgcagatatctcttcagtatactgatttcctttcttttgggtccataccagcaatgggttgctgaatcatatggtagctctatttgtagttttttgaggaacctccaactgttctccatagtgattgtactgatttgtattcccactaacagtatacaagggtttttccctttattccacattctcaccagcatttgctattgcctgtcttttggataaaagtgattttaactggagtgagttaatatctcattatagttttgatttgcatttctctaataaccagtgatttgaacacctttttcatatacctgtttgcaatttgtatgtcttcttttgagaaatgtccattcagatttttgcccgttttaaaatcagattattggatttttttctgtagagttgtctgagcttcttacatattctgattattaatcccttgtcagatggatagtttgaaaatattttctcccattctgtgggttgtctcttcactttgttgattgtttcccttgctgtgcagaagctttttaacttgatgtgatcccatttgtccatttttgctttgattgcctgtacttgtaagatattactgaagaaatctttgcccactccaatgtcctggagagtctctccaatgttttcttgtagtagtttcatagtttggggtcttagacttaagcgtttaacggattctgatttgattttcacatatagcaggagacaggggtctattttcattcttctgcatatggaagcttcccagcaccatttattgaagagactatcctttccctaacatatcttcttggcacttctattgaaaaatgagttcactgtagatatatagatatatggatttgtttctgggttctctattctgttccattgatctatgtgtctgtttttatgccattaccatgctgtttgggttactatacctctgtggtacaatttgaagccagctaatgtgattcctccagttttgttctttttgcccagaataacttcagctattctgggtcttttgtgattccatataaattttagaattgttctttctatttctgtgaagaatgtaattagtattttgatagggattgcactgaatctgtagactgctttaagtagcatgaatattttaacagtattgattccccacctatggacatggaatatctttctgttttattgtttcctcttcaatttcctttatcagtgttttataattttcatcgtagaactctttcaattctttggttaattcctaggtgttttattttatttgtagctgttgtaaatgggatcacttccatgatttctttttcagattgtttgctgttggcatataaaagtgcttcatagtgtactttacttcatggtgcccgaaatctgctgagaggcaactggtgacagagacctgaagaaagtggagcccagaaatgtcttggattttgactttatctctttctttgatggtctttcatgatgctaaacaagtcctgtgtgcttagatagaaactgaagcttgtgagaatgttttctcttttacctggggtggattgggatcctcaccatacagcattaatttcttaacgatatatataatcatagaagacaatagaggcatcattccagacaatatttttaaagccatttggcacaagaaataagacaagcaaaaatccaaaaagtgacaaaagctctacccaatgagggggtcagtcccatctaagtaatgcaaaaatgggattggcttgaggaagtaggaatgggaacccagtactgaagttataggccaaatcaaaagatgggaaatctagaagacatatttcttcaaaaagataacataaagtgcttagggtcagttcaacaaaagccttaaggatcaaacctgaagagacaaaaaatagcaacagacgaagtaaggcaataagcagagaatcataatacttacacaacctcaagaggttctcttgatatgacctgctgagaaataaaatattatctgaaaattgcaagactccaagatgttggcccaatattcctattattaaggaattaaatgtgtcttctgcatttcccatattttgatttggcttgtaactgcagtactgagttcccattcctacttcctcaagccaaacccgtttttgctccttgcatggtaaaccactggactgaagctcattaagccttcctttcaaattttatttattaattttcagtttcgtttttctcccatatgagaataagatcgacaaacagctttacagtttgaaaaacttctttctataaacaataaacattcagttttataagcagcctttgtctctgttactatttattatgtatatgttgcatttctcatggacatttgtcaatgagaatttttaatctctgtggtaaggtgttttcttccatttatttatttatttatgcatttatgtgtttatgcatttgtttattttgatgtcaggaagccctacaatttagttgacttatttaatcattcaagagaataatattgaaacagtgaattttgatagcatcatgtctgggttcaattattagctacatcttgctaatctgtataatagtcataccatagggcttagttaattgtaaatactcaataaatttttatttttaacctcaccatgtttacttagtatttattatgaaaataacaatataatagttatttcaaaagtaattgattgatttatgcaataattatctttactttcaagagggttaaattctattaaattataaatgatacatttaattatcatctaaaatcaacagcatcttttactgtttagaaattatttctctacttagtatcaggatctctcctgtcctgatgattattatcattattatttgttttagtgacagagttttgctccatcacccaggctggagtgtggtgatccaatcacagctcactgcagcctcaaacccctgaactcaagggatcctttgcctcagcctcctaagtaactaggactaaaggcatgcactactatccctggctaattttttttaaaaatattttgtagagacagggtctcaatatgttgcccaggctgatcttaaactcctgacctcaagcaatcctcccacctaggcctcctaaagtgtgcgcctccacacctggcctagacccaaagaataaataataatcaattgctctgtgcaagaggttgacacaggatgtggaaaagtgttccaggcagaggaagctgcaagcgcaaatccctacagagcaaaagtacatggttttggggtaactggaagtccagtatggctatgttatagaaagggaagtgagaagaaagtaggtagtgttaaataacttggacttcatcctgacagtattcacttgccaaagaagagttaggaggagacagatgtgatcaaatgtgtttcactggcagcagcatggggagttcactaggggcaggatggggacagaaattgaaggagagagtcaatggcggccttatctgggctagtggcaaaggaaatggagagaagcggactgatttgagtgatacttaggaatatctaagaaagaagaagttgttacgattttgaatattttgcaaacaatcaaacgcacacttaagagaggatacataaaaggagtattcactttgggaatggcaaaaatggagagatgcaatatgaagaaacagagactaagttgatttatttttgtatggtctggaatatttagttaaagtgtctacatcaaccaaaccggaatacaaggagttgttctgtgcaagagggtgcacagagcactgtacaagggtacccattgtcaaaacccatcatgtttttattagctattaattttctcctatgtcttatgttactcatcctgataatccactgtatctatttaaaataaatagaaaggccctttttactttttatttgtgtgtctagtgccccagcactttcaaggagcctttcccaagccaggtggtgaatgaagaataactataaaagtgacaccactgccgggcgcggtggctcatgcctataatcctagcacttgggaggccaagatgggaggattgcctgaggtcaggggttcgagaccagtctgaccaacatagtgaaacccagtctctactaaaaatacaaaaaaaaaactagttcaaccattgtggaagtcagtgtggtgattcctcagggatctagaactagaaataccacttgacccagccatcccattactgggtatatacccaaaggattataaatcatgctgctataaagacacatgcacacgtatgtttattgcagcattattcacaatagcaaagacttggaaccaacccaaatgtccaacaacgatagactggattaagaaaatgtggcacatatacaccatggaatactatgcagccataaaaaaatgatgagttcatgtcctttgtagggacatggatgaaactggaaaccatcattctcagtaaactatcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaagtataataataaaaaaaatagccaggcgtggtggcatgtgcctgtaatcccagctactcaggaggctgaggcaggggaattgcttgaaccagggaggtggaggttgcagtgagctgagatcgtgccactgcactccagcctgggtgatggagtgagactccgtctcaaaaaaaaaaaaatgacaccacattttttgagtcatgtctatgttgactaggtaaaaccttgcacacagaacacatgtaaaaattacaatccatgtgggctgaatgctgactgtgttggatggaaatttgcacatagggcacttctctacaattcagtcctaaaaatgtcaagacaaaggagcatttagtgacagtcattctggataacaaagatgcactgctttctaatgcttccctttactttcacatttttctaaagttcacagatgtgccctcgatgtggtctgtgtatttttgtgaactgctggaaaatttcactcacacaccaatggatccaatgaacacaaaatacctcttccagggagcagttgccaataagcagtatttttagaggcacatgtcacagtttctgtttgcttctgttgtgacttttaatgggccctgaatgattaagaaatagcctctgataaaaggcatctcccgactgcttcattatgtactatgggtagtaaatgtttactacacagtgggctcaagctaacatgttattaaaccatgttccggttacatcagcgcccagagaatagcttttcccttgaacatgtttatcatttccttaaatgctccttaacaatgatgtcatattatttatgcatgcttcctcaggaaaatatgttggttgattttatgaattatttggtaaactttgttactcactctaggagactacacctgtttccaataattttctcttacatgttgagtaaaggaattctattgagagaagaagtgagaagtgaaggacacaaatatagatctaaacactagagctaataggacattttattgcatagaattcatgtggtatgttgctgggactagctttcctgtgaggattggagaaccaggatttctgctatctgaccagagtagaaatctattctcctttctcattgtcagagtaatgacagtataaaaatttctcaccctccagcattagcagggaaactttctatttcttctgctgtgattggaaatgaaaaaggaaatgcttgcttttgaaaacacttccagctactataatgttaatactagaaattatgactgcgagtaagaggaggggaaaagtcattcaggtgccattttggctttccatgaacatggctataaaaataaagtgcctctttgggcatgcttagtcattactttggggttaaagttgaagtcagaaaaaaaactctgaaacatagacatgtgtttttcattctgacataaagaattaacaattttccccagctacaactatggagggttagtatcttttaatctgtctgttttctaaaacagcatggtaacattttattttgcctaacctggagatgctaagaataccctgtgtctggttctccttggtacagagtattcgctgtataaactgatgaggttgatttccatgtgtttataaaaaggcaggaaaatgtcttcttgcctaaaactcatgcatggcatcattgcacatggcattgctcaagcacagatctcgcctggtggctccaaaatgaaaggagagtggggagttgccagggtcagagccttcgtgcaaaataagctgccactaactggcattgagcttccataactccctgtgctgggtttgcagtgaaggaaaattgtgttgatggtcagttctgaaagcatatttctggtagaaaagaaaaatagtggagagagattttattctttctacctgttcccagactactctgctcaggcttcctgaatctaaggaagtctaataaattctgaattctagagagtaaattatgaaggttcatttgaatgtcatctgctacccaagttctatacatcccctcttaggaaagaatcataatttattataattatttttctgtttgtggataagtataccataaatgatatacgcaagcatctctttcctactaaaaaagaatgctatattctaccagtagttttcgtaaaagagtaagagactcctctcagaatgaatcttctatactcctatagctctgtcacagtaacagcatgtgtcacaattggcatgtattgaattatttaaggatgattctttctgccccagtagattaagagcctgtggaggccaagttccaggtgtctctcattcttggacttctgttaccggaaagggtcccagttcagacccctaaagagggttcttgaatctcacacaagaaagaatttgggatgagtccatagagtaaagggaatgcaagtttctttgagaaataaacaaaagaatggctactccataggcagagcagtcccaggggctgctggttggctatttatagggttatttcttgattatctgctaaacaaggggtggagtagtcatgagatttctgggggaaagaggtgggcaattcccaggactgaggtttcctcccctttttagaccatatagggtgacttcctgacgttgccatggtatttgtaaacggtcatggggctggagtgtcttttagcatgccaatgcattacaattagcttataatgagcagtgaagatgaccaaaggtcactttcattgccgtctttgttttggtgggttttggctggcttctttattacatcctgttttatccgcagggtctttatgacctgtatcttatgatactagtcctgccgacctcctgtctcatcctgtgactaagaatgcctgacctccttggaatgcagcccagcaaatcttatcctcattttatgcagtccttattcaagagggaaccactctggtttgaatgcctctgacactacaatgcgtgggccagcactctacctgtagtaggtgctccaatcatgtttattgaatgaaatcatattgtacagggagcccatagggaatatcatttatactctgctaaaaagcatttaattttaggatggatttaatggcaaaacctctgtgtactgacatgggacttactgctaaaattgtgtacacaggggacctcggaattgccatgataaaaatcagtgagaaagagctaagtgccacttttgtatgaggaaggtcactcctggccagaaatggagtcagagaggcttattaactttgtgtagaatggagctaggttgattagactggctccaaaggctagctccacttagaagccatagtaagtggcacattaagtgcacccaagctaaatttctcactgtaaagaaacattgcaaaggctttaagaacaagtgacagcaaattacaaaataagcagcaagtcaggatttaccctactacctactgtcataacaattactgggtcaagtgaggggcattttaaaatggaaacactatttttctaatttacgtggattaaaaatgcatatttccctgattgatttataatctattgataattaatttataagatactattacaatatagtatacactgccttgaaaacattccaagtgagattgctttcctggtgaacatgcattagttttaatttttctttgttatgccccacctagaaatgctgtttattcactcataaggaactatgatgtttaatctattggattttgtgttcattgtatctgtttttatcatttacctatgactaaagtgaacagtgagaaatatatatttaaaccaaacaaaacttttaaaatatctttttttcaggggcttatttccagaattctcccagagtgaaagtcgtaccctaagaatatgttaggccacttggggaaacatttattttttatttttttccataaagtctgtattctttgttaaatggaaacatttacttttgaagcctactcaggtatagtttattgcttcgtaagaggaatttgagtttacaaagctttccatcagtttgttagcatgttacacacatctgggaatagaaacttaactgtttttaatccaaatgggcctcttcctttacgtcccacaattaatagaaattactgtctctcacacccacctcatgtaccaccttttaaagtgaaagctttaaaatggttgtccctaggtgtccaagaggtattgattccaggaccccagggactggtttcaggacccctgtggataccaaaatctgcaggtgcttaagtccccgatataaaatagtgtagtattgtatatggccaaagcacattctctcatatactttaaatcatctgtagattacttataatatctaatataatgtaattgctatgtaaatagttgttttactatattttttatttgtattacttttttgttgcaatgttattattttttcaaatattcttgtcctcttgttggttgactctgtggatatggagagtcaactgtaccctgttgtactccttggatcaggcatttaggagcagtggctggactatgagttggttattctgggcttgctgactgtataaagatttggttcatgtcactgtcacccagagcctatggggccaggcaggatcagaggaggaaagagggcaagcaggacttctatgagagcaagagcgtggcccagtgcagagccaggcccaaggccactgatgcacaacattttgaatctaggaacagaaggaaagggaagggtgggaagcagaagacaaggcggtggtcctgtccaccctggaaaatgagtgcctgcctctgagaataggatgaattagccatgctcggtggtgctcctccaccgcagtgcaatgtaatggctcactatccaacctgcagccaggctgcctggcttcaagtcgtcactctggtacttactaattgtgtaaccttagggagattactcaagctcaacaagcacctgtttcttcatctgtaaaatgagggttataaaatcattaccaacctcatagattcctgtgaagattacttagaaaatataaaatactctagctcactcctgtaaagagcaacgcccgacacaggaagttaagcatttttgcatcatatgtcttttgcaactctaactgcacaccactaaactctttaaattctgtatggctttcttctaccactagtatctgctatgctctttgtttctgtgtcaaatccttggcagtaaattaattttttaattcaaatccagtggtttactcatgtcaagcacctaagcctagagacatagtctcagtctttccctttatcatcttgttaattgtcaaagctgatgaggacactaccaatccaggccacagtgacataagaagaattaattcttttcttggttatttttgcatgcatttcctttaaagcagaataccctcacttagagttttaagtaggagacaatttgtcagaagataatgcttatttggagttttaagtaggaaacggtttggtgtaatattcttaattttatatgaatttgtgcatagaatcttatcagctgaattcagaaaacaatgagcaaatatcaggcaaggggaggcatggtaagggagtggagaagtggaccatggtcaggaaatatgggattcagtttgggataattttttttgaagtcctatatgaatgtatggagttctagtgcttggggttttagaagatgcaaagcagaatcagcttttactctcaaggagcctatagagtcaggtgggtgatacataacatgtagatggggactttataacctcagaacctaacacacgcctggcacatagaaactgcaaatcactcactttttatccttagaacacagcaaatgagaaaatgtaataaaaggttaaaatcagatttttataagtatcgtaagacaggtgtaaagttctatgtggtataaacaaggagagatgaaggaaagatgtggaagaccaagcacttgactgggtcttccaagatgtgcagaatatgtggctttgtgggtggagaagacatgagcaaaggcagcaaggtgagaagattcaggaaacattgtgagcagtttagtttgacgaaagggaagtggagagaaatgaagttgaagagtagattggttccaaaccaatcaggattttcaaagctaagcttagatatttgaacgtgattctgcaggcaatgaggatccgaggaaaaccttgtatcagagtagtagcatgatcagatttaagcgtcaggaagtcacatcattaaaatggatcaacagcttaactattgggcagtgagtttagaaatgagactggtgcaagagggatttatttatgagataaaattgatatgactcattttgcacctctaagtgacagacgatggtgccactagcagagccagacagccccaaaagaagatctggcttgatggaaagatgacaagtttaacttggggcacattaagttgttggtgctggcaggacattcaacaccaaaactcatgagagattttcagtggagagatcactcatgtacagaaaataattgaagccttggaattaccaaaggagaaaatgcctgagaacagaggcttaaggccatttccttaaggaacacccccacttgcagagcaagagcacacaaacagtgaatggcaagaaatgaggtgaacactttggaaagctgcagaagtcatagggggagaaggtgtcagaaaggaaagtccagacaagaattttattgtcgcaaataaatatggaacctgagaagagatgctgaatttgatgactaagagaaaactggtgacctttcaggaaagtagaagagtagtaagggtcaaaggcatgctgtgaaagattaaggcatgaacaggtggtgagcaagtagaagcaatgagcatagaagattttctcaagatggttgatagcaaaagcaaagacatcctagaattatcttaattttattatttgcttaaaagtcacaaacttcacttgacaacttaacagaatagtaaaattaaagtaactttgtaagaacggggagactacaacaggctataaactgaaagagagtttccagtgccccataaaggagtaaaattgaaaaataacagtgggtggtcaagaccacaaaacaagtgggaaaatatgggatcaaggatgtaattgacatgttccaattttatgaaatccacatcatatatctagattaacgtaacaattaacatggtctgccaaacagctcagagatggccacgagaattccaacagtgtatgagccattttgtaatccagtcatgtggtcacccatggatgtggcctgtcttcccaaggatgaattaattaccttatctctttattcattgtctttccattcccattgtcttagtaatatcagagaagtagactgagtaatcttttcacaagagcactcctcaaggtggaaaaggaaactagactctcagtagtacattcagcaaagagtagggagaaacagtcctcctaaaacctgccttgcatatgaaagacaggagtcaggtacaactatttcactgacctgagaaatacagaaagatgtttggggtgttgtccagggactgctaggttacatttattgtcaatgtgagtaagaattgtctaagagtaaaatattgaggaagacaaaatgaacatttgcctacttctacaaccaagaagggatatatggaagagttcatctggaaagtaaaatcacattaaaatgctacaaattaatgtagttattgttgttaatattattatcaacactaatagaaatggcataaacataccttcacatttgctactatatattgaattaaaaaatggtagagataaggctaaatttatcctagttcaacaatgattcaattcatatgagaaaactgagcatgatttgttcgttttgaatgccttaaaccaaatattttaatgtgcattactcacaattagattctaaaaatgtaaaacaaacatgatgctacagcactagtacaaaggcagcaaaaatgcattttaaaagcaggaatactacttcagaaaaatgtattaaaattgaacatgagcttgagaaagtaccgctcagtgcaatcatggaaccacaattaaagctgggcaagacatggaaggtttcctgatagccttgttttataattgtagaaactgagggccgagctcagttgctcatgcctgtaatcccagcactttgggaggcggaggtgggtggatcacttgaggccaagactgtgaaactagcctgaccattatggtgaaaccctgtctttactaaaagtaccaaaattaggtgggcgtggtggcgcgtgcctgtaatcccagctactcaggaggctgaggtgggaggatcgcttgagcccaggaagcagaggttgcagtgagccgtgattgcaccattgcactccagcctgggggagagagcaagactctgactcaaaaaaagaaaaaaagaaactgaggcccacacaaaaaaaagaaaaaaagaaactgaggaccaaggtgtccaagagccccattaaatgaatgcttaaagagaaatcaagcaaaatcccttccataaatcagtaggatatgtaacactatgaaagattttatattgatcagttaattttttaaaaaatcgaagctcagtttgaatgaaccttaacttaaaagtaataaaattagcccttttacatcataagaatttgaaaaagttgtgaataagcattcacacatacttatttaaacttgtattaaatgtgaagaaaggctgattaataaaaaggaaatttcattgagaaatcatgttaatgtcatcatggttttaacaggttaacttgttttctctcttgattataaccatacgtctctgatttaataaattttctgagtctgtattaatacagttgtgtgtattgttaagaaattgttagaatttttaaaaacgatttttcacagaaaataagcatactgcaagaagaaaacagcaaggaagggtatttttctgagtactatacatttcagttgtatttgtagtacctatgtgacaatcttaattattggttttataaaagctaagatcaggtaatttgaaatttacataaacattgcccttaatatttaactaaaatataatataaattaaattggaaatgttttatttgatttatcttttacagaagtataaatattacagcatatgagttattttattaacccttgtgttaacaattatttttgagatattttggaacttttaataacagaattactaaatgattctttaataattataaagtatgtattattttaaaataataaatatttaatttaaatttttaagttttaaaaacattttcatattttaaataatttttagtatttgtttaaataatctttgattaattctttaacaaagaattagtgtttttaataacaagataaaattggcattgttttctatttcacagtaatgcttcagtcagatacatacatatgctttgttagacatgttacatgctctgaaaaaagagttaatgactgcgtgcattcattatgaggtagaaaattcttactactattgatcttgttatttcatgatttgaaaatcttaaaagttagtaagatgtgcactagatgtagggaattaatgtttgttttttggttttcttaacagttcgacaattttatttttatttattttaattttttaattattttttaaaatttgtgtgggtacatcgtaggtgtataaatttatggtgtatgtgagatgttttgatacaggaatgcaatgtgagataagcacatcatggagaatggggtatccatcccctcaagcatttatcctttgagttacaagaaatccaactacattctttaagttattataaaataaagaattaagttattattaactatagtcgcccagcaataaagctactaaaaaatcaacatatcgatgaatgaaaataccaggaatttaaaatggaatcatattacataacttgattcatattatttcataatttaaagccctttttgtacaaatcactattaaaatcagtactatttagtgtttcttccaagagtattcaaaagtaagaattatctgatattccataagcaatccaagtcaggaatatctaatgtgaatggttggtaaaactgttggggtcctatagatacatgcccttgctccaggaaaaactcctttctcctatctcctggcttccagtccagtgtcccaggggctctggccgacaggctagcatgagccatcatgcctcttggtatgtctcactggagtaatttctcacctatcatgttttgccatctcagctttgtcccagtgcctcttgagcttctccgaaggtaacctaagcttcctgtttgtctgcctattgcaacagcacctattgccacttccttggcagcctgttgacttggaaatagaaccctacatttggtttctgctcctgacactttctgagcttcctctctggtcttctctgctcccattccttcctctgccttttgctttacagatccccttttaaagtcccttccatctgggtattacactactcctccatttttctccctcttcacatctgggtcattagaatccattgtaccagtgtaggcccattaaggacagatgcttccactctgcagtaagaattgtgtctcagtttatatttttctctgtagacatatgtcagcttctcttgtcatagtgtgtgtacatgcaggttgaacaagtagaggacctcacggttccaatttgaagtccaaaatactatcaccatcagctgtaaatttggggaaactgagggacaaagaggttaaatcacttggatgagtcatccaactggtgagactatgaactgggattcaagctcagagagtcaggatgacgaagtgtgtgctcctaaacacttaccttaatatgagggtaagcaggcagggtgaaatattgaggacactaacaaatctagtcaccctttacctgggtccttctttttctttctttctttctttctttttttttttgtaagttgatttaataggttgtaagtttatctacgaattccaaaaagtaggtgtgttctttaataagcagtgtatttgagtatcttgttttcctatagtgaggagaataaaatatgtaaaagcaggaagacagaggaagcctgggtgaaaggctcagagaatgtggcagcatttttttttctctccttggcatcacatcaaagacagactcacagaaaaagacaggcaaccctcaagatattaatgaaatgtatcatttccctctgtagtgaggacctgcctctgatcaccagtaaagcctcaaagccataacaacacatacggtgtttatgaatttaggattttacagaagtattataagagttgtcattttccaaatagtgttttgtatgttcatcgtgtacttgctggaacattttgtgagtacatgtacaaactgtgtcactggagtttggctgggcttctggagaaaagaagctgatatatggataatggcaaagcatgttgtgacatggatgcaagggcagagaaataaaagacataggtctcaccaacgactatgtagcttcaagagctggtggaatgaggaagacaatgtggggatgttgagacaaagagacataaaagcagtaaaccacaagggacagatggtagaggtgtgtcaggggttgcaactgtattttataaatggtggtagaatatttggcctagtcacccaacattaatgttctaagcaacctgaaatctctccacaaaagaagctttctatgaaattcctatttcatacactccaactgtcccctaaggagtcattctaaagaaggaatacaagagatccatcctgagttctaattctcttctctctaacatgtggacacttatagatattacctttttccttgagctcagctgcagcatgcatataaataagaaacaaatttacttgtctacctcccaaatagtctttcattgaatttcacatattagttcttgttactatggaagacatttggggctaaatattccatcacaaatgaaatgctacagccgtttctctctccttctgaatagtatttgtgacagattagccagctgctcatgaagtttcaagattttttgtttggttttgtttttttttttaatgtattagagttttctctacttctggtaatttctgacattacaagtctctcaaatcatacctctatctcttttgcttctgcttttattgaaaaacaattatttcttgcctggactattttactcctcttctgttgcatttcttggggcctgggtctgtagtaccctctcactgcagtgtcttagtgtcattgccaaagctgccctcagagaactctatgtagtgatttctagtttttctctccaggtccctggccatgcttcttattgcctaatgaaccaggatcaaggagttcgatctctgcattagcctctgatcacagcccctgaacggccctatcttatccttcgtgcatcctctctgtgactctcagaaaggctgtcagtttcctggtcagtcttttccctaataacctagggctcatagcatgctccataatgccctttcttttccctcaagggatctttgaaaatatctctggcatataacaggaggggcctggatctctagtaccttctgtgaccagctgcagagactatcaaatccctgaaatgactgcctaagaatgcaactcccaggccaccccaccctgcaacatcaatttaaattttcctcagaggaaatgttatcatttcttggtcagcatctgccactgtatgtggtcatttgggcgactgcagttctgcaaacttacctctagacataagagatgtttaaaatagacacttagggatttactaactgataaaatcatagaatgatgtgcatgtttttttggaacttttttgtactccctattccttatgtgttatctgctgagctttgttcataagattggtctgcacatggttagcagggactaaaaaccacaaagtataaagatagagacatccacaagatgcttccataaagcatgctttcctagtgctttcgggaacttttgggtgcttctgtctctttgtttttttcttaaataataagttttatcttctgtccattattattgagggtctagcatttatggagaataggacagcaaatcaatctataagctcttttagttttcctactactgctaaaacaaattactacaaacttagtggcttaaaacaacacaaatgtattatcttatagttctggaggccagaaatccaaaataggtcatagggaataaaatcaaggtgaatgcagagctgtattcctcctggaagctataggagagaatgcatttcctctttttccacattccacaaaccacctgtattccttgactcatgaccccatgtcacttagatccctgcttccattgtctcctctgacttggaccctcctgcttcctttttacgaggatcattgtgatcacattgggcccaccttgatcatataggataatcaaccctccccaagggtcttaatcacttctccaaagtccctttgccatataaggcaacatatttataggttccagggattagaatgtgattctatttgggagacctccccaacccccacttaattgtaaatttgaaactacgtgtaatacttttcacatattgcattgaaaataaacatgttaatatttttattaagacaagaaagttgttttttaagatcacaacaagcagttacttggaattttcatgaaagaatatttaccacatagtcttaatacatcttggtggctagataccaaattgtggtttgctgacttctttacactgattatatgtatcattaaaaatggatgagacctaaaactgccagactccatccaatacaaaaatacaagtatttgtaggaaactcttagaattttcacatgtaagaatatgtcacatttctgaaaaaaattctacccagtgacaccatttcttactatgcctatgtgttttttcagcgttagtatttgaacataaacacttttccctataaaagcctataagccaatagcagctgcagaagggagacctgcaagttgttggcaggctctggggctcactcgggttcctgacccaggcctttctgagtctttcagatgcttcacacttccctgcacatcctacttctgtgacacccccgaagttgcacttatggtccaagctaaatgctacctcaggagctcagaaataaagaacattggagtgaaaaaaaattccgaattatgcttgtaaaccaaatatatatggatagtgtgaattgtgcagacaacacattcaaatacatttcatatggtgaagtctagccaacctcaaatctattagtctgatctacttcatccactacatttgtgtaagattacccttctttcatagtaaacacatatgtaaaatattttaatgtgtttttgttagattcattttaatgtttccaaactgtttctattaatattaataagtaccattttatatgttttctcctatatttcttgttttcatccaggactactagattccagtaagaataaaattaaacattagaggtttgtcttccatattgtttaagaaaattagtttccctttttaaataattactaatatttgaagattatgaatcataaattaatcacaagtgccatacctattattttagaagcaattgagcaatataaatggtcttcagttttaccagttcttgatctgtagtaaattccagcggtggtggggtctgtgaaataatgaagaaaaaaattattttaaaaaaagagaggaaaaatgatacctaaattagaaaatcgttggttttatttcttgtatcaaaatatctgataattttaacattcattatgtgttcttttaagaactgatgctcatcagttttctcatcagtttttctgtttttcacttggcatttattgatattttctattgcctgagtaatttaagagcctgcaaaattaacctgcctttcaatttgcacatgtacttattatggtaaaatcaatattttcatcctaggattggtcatgtactttgcagcctaatgataaggagaaaaataacctcagaagagtgaagctgtgctggccagcaatggagatttgatagggaagaaaggtgtcatatcacctggatatagccaactaacagcttgatatatatgattccaagccaaaacctacatttagtctctctctctttctttctctgtctctgtgtgtgtgtgtgtgtgtgtctctctctctcatctttatactatagattataaaatttggatacgtaaatagtcatcccacttatttctaacacaattctgtgataataatgccttttcagtgtgtagctttcattgttttcaaagcacctttatagcccttctctcctttgatctttacaacaacccagagaagtgggcaggagagacagtaatcttcccattttgacacatgaagaaatctcttcaagcttcactgtctttgaggacctctgggtaatgatgtcatctgtcctgaaactgccagatgacttttgctctagaagaaggctagggagaaaaaaacaaaacaaaacaacaacaacaacaaaaaaacgaacatttaggctgggagactgggctgtcttttcccccttcacccctaaaaatctactttgcaaagagagcaacatccactcaccatccccaacactttctgttccccttccctgatttctattttttccacagcacttactactttgggttgtgctgcactgtatttcatttatttacttactgtacttgttgtctggcttccccaccagaatgtaagatccttgaaagtaagtatttttgtttgttttatacatatctccccagcaacaagaacagtgccactggtagaaggcataagaaaatgccagaatgagtcactgagtgcagactggaactgggaacaggaacagttagctggtggtccacagggaaggttctctccttttccttggtgacagtgagaagtcttatttgcaagaggaagagagcatgacttagaataacagtttggctttaggtgggacctatactatgcaacatgtggaacttggagggccttggagaagctgagcttgggagcaggctcacttgcctggggaagggaagtctctcagcccattctttagccacctagcaatagttgttagtcagtcctgtttgtctacccacactagcacatgggaggcactgtatttgtcaaatgaatgaatgatgaatgaatgaaaccagtcatttatatattgaagtaaatcagtgtcatggaatgttttatgtttaaatgaagagagaaaactttaatcagattaaatataggaaggatatttgggatctagaaggccaacccagttgttcaatcacagttgcctccatgggggtcaaccttaagcgttgtgcctgcaagcaatcacacttctctggtggaaaagccattctgattctggggccctttttccaccatttcccttcatccacagcaaggagcttcagctctggagactgtaatttgcacaaagcaattcagggtataaaagcaaaactacacacttgcaaggtaaagataccaattcattcgactctaaccatcaaaagatacatatacacatatatgacatgaggaatactttagtcaccagttacccttcctgcaagattagtcattagatcccatgataggccttgttaatgccatggagagaaaagagataattataatgagttaaatttagaaacaacagtcattttttgtggattagaaatagtgaaagtcagtgtctttctatcagtctttcacatcaaaagctacaggaaaatcataagaaataatgaatagaagaaatatgtactatttctaattgaaaaatgtcttttatttcagctcccttgtatggctacctgcttaaatatattcatgcttatgtttaatgtctcctataggttcctgctataatcttcttttttttaattgttcttgggttttaaaaaaatgtttgtttgacaaataataattatacattttcatgtgatagatagtgatgtttcaatccatataatgtataatgatcagaacagggtaatttgcatatctatcatctctaatatttatcatttccttgtgttagaaacattcagtatatttcttctagctatttgaaacaatataatacattattgttaactgtagtccttccacagtggtataaaacattataactgattcctcctatttagccataatttttatatcctttgacaaatctctccctatccctcccttccccctaccctcccaagcctccagtttcctctgttctactttatacttccaagagatcaactttttttagcttctgcacatgggtgagaacatgtggtgtttaactttatgttcctggcttatttcacataacgtaatgtcctccagttccatctatgttgctatgaatgataggaattcattctttttatggctgaatagtattccattgtgtatgtatgccacattttcttgatccattcatctgttgtggtacacctcagttgatgctgtatcttggctattgtgaatagtgtggcaataaacatgggggtgcagaagtctttttgatacaatgactttctttcctttggataagttcccagtagtggcattgctggattatatagtcattctatttgtggttttatgagaaacctccatactgttctctagagtggctgtactagtttatgttcccaacaagaggtataatatacagttcccttttctccacaccctcaccaccatttgttattttttgtcttttttataatagccatcctaactggggtaagaagataccacattgtggttttgatttgcattttcctgatgattagtgatgtcaagcatttttaaatacatttgttggccatttgtatatcttccttttataaatgtctgttcagataatttgaccattttttactcatattatttgggtttttgctgttgatatgtttgagttccttgtatattctagatattaatcccctattgaatgagtagcttacaaatattttcttccattctataagttgtctttttgctctgttgatgtttcctttgctgtgcagaagctttttagttttatataatcccagttgtttatttttgcttttgtttcctgtgctttcgaggtcttgatcataaaatattttcccagtccaatgtcctgaactgtttctcatatgttttctcctagtaattttatcatttcaggtcctacatttaggtctttgatccattttgagtggatttttatatagggtaagaggtggaagtctagttttattcttctgcatacggatatccagttttcccagcagcatttattgacaagactgtcctttctcaaatgagtgttctaggaacctttattaaaaatcagttggctgtagatatgtgaattaattgttgggttctttattctgttccattcttctgtgtgtctgtttttatgttagtactatgctgttgtagttcctgcaggtttgtagtatatattgaggactggtagtgtggtaccaccatctttgttctttttgctcaggattgctttggctactcagagtcctttgtggctctattcaaattgtaagtgtttttttctatttctgtgaataatgtcattggtattttgataggaattgcattgaatctgtagattgcattgggtagaattgtcatttcaacaatattaattcttctaatccatgaccataggatctttccatttgtttgtatcctcttcaattcctttcattagtgttttgtagggttccttatagaggactttcaccttcttggttaaatttattgctaggtattttacttttttgtagctattgtaaatgagattgccttcttgatttctttttgttagttcattcatgtacagaaatgctactcatttttgtatattaattctgtatcctgcaactttactgaattcgtttatcagtactaagagttttttggtagagcctttaatttttctttacataaggtcacgtcacctacagagacaatctgacttcttcttttcctctttaaaaaaaatctttgtactacctacctctatttgtcaaaatgactttttctcctttataatgtggatgcctctttattttgtttggtctaattgctctggctagtacttccagtactatgttgaataaaagtggtgagagtgggcagccttcctattctagttcttagaggaaaaccttcagcttttccccattcagtaagatgttagttgtggtggtctttgttttaatacaacctacaaaataaaatacatttatgtacatatctacatatatacacacacattaaacataatgtgtatgtatacatatatagatatatttatatttatatagacctaaatacatctgcatagatatatgacacgttcatgataaaccagtttgactgtggtgtggcccacacacctttgcttgcctgtttctcctcccacagtactgtggctctccagagaggctctcatatataccctgctccaagagccccaatatgtgtcctgttctgcagcaggaccgcttatggagatgctcttcatcaactaggtagtgctcatttctgtatgttcttgaaatctggaaaacctcaagacagaaaatgaatttatttttaaagtggaatttaatgcagcaattagacagatgagaaatatttttggcccaaggcatttttgttcacaccttataaaggagcatttttggttctgcttacaaatgactttaccacagtgttgaaagtgtctctctctctcctcttctcttctctctctctcctgcttaaaaatgactttaccatggtattaaaggtctctctctctgtctctctcaattctttcattcatttattcaatatatacttaatatattctatgtgcaaggcacagtgcgaataactctcgaagatgttttacactcataagacatgtgcccaaaatgctacagcattaatttgccacatgtattatttggacaattcagtagatgccatagaggttctaggagaaggaatgtttctggaccaaggatcagaataacattcagggaggaggtggcaagcatacaaaaggtggaatgaatagatgtttgagacaaagtaaattttcaagtttacataaaaaagaacgtttttctaagagagtagtgggaaagtggaactaaagacttgtagcaaacaagttgtgggtaattccaaatgtgggctgaggggccttagatttctgtattgataggtaaagagagccacaccaataacagacaaacagagagccaaatcatgagtgaattcccattcacaattgcttcaaagagaataaaatacctaggaatccaacatacaagggatgtgaaggacctcttcaaggagaactacaaaccactgctcaacaaaatgaaagaggacacaaacaaatggaagaacattccatgctcatggataggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcattgccaagacaatcctaagccaaaagaacaaagctggaggcatcacactacctaacttcaaactatactacaaggctacagtaaccaaaacagcatggtactggtaccaaaacagagatatagaccaatggaacagaacagagtcctcagaaataataccacacatgtacaaccatctgatctttgacaaacctgacaaaaacaaggaatggggaaaggattccctatttaataaatggtgctgggaaaactggctagccatatgtagaaagctgaaactggatcccttccttacaccttatacaaaaattaattcaagatggattaaagacttaaatgttagacctaaaaaccataaaaaccctagaagaaaacctcggcaataccgttcaggacatagccatgggcaaggatctcatgtctaaaacaccaaaagcaatggcaacaaaagccaaaattgacaaatgtgatctaattaaactaaagagcttctgcacagcaaggaaactaccatcagagtgaacaggcaacctacagaataggagaaaatttttgcaatctactcatctgacaaagggctaatatccagaatctacaaagaactcaaacaaatttacaagaaaaaaacaaccccaccaaaaagtgggcaaaagatatgaacagacatttctcaaaagaagacatttatgcagccaacagacacatgaaaaaaatgcttatcatcactggccttcagagaaatgcaaatcaaaaccatgagataccatctcacaccagttagaatggcgatcattaaaaagtcaggaaacaacaggtgctggagaggacgtggagaaataggaacatttttacacggttggtgagactgtaaactagttctaccattgtggaagacagtgtggcgattcctcaaggatctacaactagaaataccatttcacccagccatcccattactgggtatatacccaaaggattataaatcatgctgctataaagacacatgcacacatatgtttattgcggaactattcacaatagcaaagacttggaaccaacccaaatgtccatcaatgatagactggattaagaaaatgtagcacatatacaccatggaatactatgcagccataaaaaaggatgagttcatgtcctttctggggagctggatgaagctggaaaccatcattctcagcagactatcgcaaggacaaaaaaacaaacatcgcatgttctcactcataggtgagaaatgaccaatgagaacacttggacacaggaagcggaacatcacacaccggggcctgtcgtgggatgcagggaggggggagggaaagcagtaggagatatacctaatgtaaatgaccagttagtgggtgcagcacaccaacatggcacatgtatacatatgtaacaaacctgcacattgtgcacatgtaccctagaacttaaagtataatttaaaaaaaaaataaaataaaattaacagaaaaaaaaagaatgtctttaagagacggacattgttgcagagcccttttactagggttaaactggagtacagagaacattagagtggggctttagtgaggtgtgtgggcctgatttcagggagtatgtaaaggctgggaaacatgaattgtaaggcagagatgttgggggctaacagagagggagggggtcaaaggtaaccaaggtgtcaatcctagatgtctggtagaatagtgtagcatttaatggaatcagaacatcaggatgaaggcagtattaattgcctacaggtgataaaagttgtccacagaaaatatccagcaggtagcaggaaagacagacagaattgggatttgggaaagagtctggactaaagatgcatatttgagaattgctcatggagagatgagaattgatgagatgtggcaatggataagatgtttggaagagtgagaggaaagagaaatgatgagatgtggcaatggataagatgtttggaagaatgagaggaaagaaaattaatgagagcagaatcctttttgtttttacctaaattttaatgatgagccctagcttttactgtcctccctgttttagctgactctgtataccctcagtagttctcaactgagggcaatattttttttaagtatgagaaggagagggtgtgataccactggcatccctgggtagaggccagggaagccactaagcatcgtgtcatgcacgggacagccccacaacaaaggattctctggcccaaaatgtcaacagtgccaaggttagaaacactgctctgtgtttgccaaaagaaaatcccttcagtgtcttgtttagtcaagcaaactgtctcctaaatttggttatctcctacaagaaatggaaagcagaaatcctttcagaaccaaatacgctctcccacaagggtctctaattcttcctgcacacttctctgtagaagaaagactaaatattcaagaatgacaatttgggagcagattattttttataaaaccaagcaaacactcatcttatttttcaagtaattccaactgaacacatatatggtaaaagccactgggaggaaaacgaggaaagggctcccacatgctcatatctcttctggatgttcacagacatatatgttaagtaaacagcatacccatgtacttgagcagcccaggtctgcctttgaaccttctttcctgcttgccatggacagcattgatctacatgggctgtgttgtgcttgtacttcattgcacagtttccaaatgtttctgcacgtggaaataatattttatttttgcaacattccttaagggatgtctagttgattcattgtgataaaattggaacaataagtacatgtgaaagaatctaaatattcatgaactgttcgacaggccacttaacttctctgtgtggcattttaggacagtgcttaagggaggaaattctgtgctattctgtccagaacatctctttctctgtttcctcatccataaagtgaggatgataatgtgcccatctcatagggttattcgggaggtagagtaagctaaattattagccacatccccaaagttctggaaccatcataacaacattattcagcattgcttgcttagcatttcaccaaaccaaactcttcatattttatcatattgtatactttgaagtgacgtgtattaccccacacggatatactgatttcttcccttgtcaatgacacaaaaataatcatgaaatatttcttacctgaaaaatgtagcatttttactgggatgacattttgtaaatatgtgtgggtatctttagaatgcccccagaccaaaaatattgatagagttttaacattaattaactttataaatagtgagatcaaagaaattttgcttcttctttgcttggttgatttctaaaatgttttcactggaattaagttaatgtttaaattaaatatgagaaaacaacaaatatttaaagataaaagttgcatgggtttttttcagtatttattttagaaaaacctgaaagttcatccataggaaagtagaaaaattatgacatatttatatgatggaataactatacaacagtgaaaagcaatgacatttttatatttgttgatatctatagatctcaaaaatataaggttggatgaaagaagcaatatacaaaagaatacataaagttatactacttgtgtaaatttagtaagagacattatgcaatactataaatggactatggatagcaattgtatctggtaaagaaggtagaggaataggatggggaagaaaagggagacctcatctttatgaaaaatgtatttcttttacaaatccaaatgaatacataagaagcaaaatgacaaaatgtgaacatttgtgaattttgggggtggatacatgagtgtttgttatattattctctgtacttttctgcatttttaagacttaaaaaagaaaaaaaagactttcattaaattgggcttggatatagaaaaaaagaactgaattgactgcaaagtaacaactctaaaattaggataatttgccaagacctgtactgctcaaaagcaattctcattcccattccagtaagaggtttagtgttggatattatggatattcatctgactctgaaatatgtgcctatatagaataaatgattttactgtttgagtagagactctaaagataatacactgaaagatgcttgcaaaatataggaattgattttgataatttgcaagacctgattacaggtagtctgacacttgtcagggtttacccaaaatagttctattgaacataagctacccttggataagaagactgaagcacaattaaattctatcctttttgctcaaggaaactttaggattggccctttgctgcaagactctgttggccttccttcttttacgtggaaatagaattcttatactccttagaaaaccaaagcaaggcctgtaatctttcttaacatgcatgtgtaacttccattaacacgtatcccagataatattccagcactgctatttttgttgtatggctctcagatggaatgtagaaaaacagccaggaatgattttcttttggttccaggtcccatgcactttatttcattttccagctgcccttcctccacaaaactgaaattgagccaggtttgttttctggctctaaatttgatcataaattgtataaatttataaagtaaattttataaatgttttacttagtcgacctccatttcaagtatgtgaaacccccaaactcaggaatatgttcaagtggtaacttttttttctttacaagcagggtacaacatgaattttctccagacactgtaagcatagacccagctcaaggatggtcaatgtgtataatggtttctttcctccccatcactaaccatagtggctattgctcgtatattaaagtggtctttcctgccaatcttagaagcaacctcaggattttcatcaacattacacgctcaattaatctgaattaatacccaagaagaaacctatttactcttgctgcagatgtactccagaatgtatggaattactttctgcttcataatctggctaattaaatattgcatcaattatattggtcgaggccatttttccctttcagtttctaatagtagagtaccatcagatgtctaggaagcaaaattgactaaaattttgtgattcttagatcacaaaataaggaatatattttttcatcaatgaaatttcactcactatttttatcatgagtagagtaaatttatcaaccatgttatttattataatacatggagtgaattattattatgtttcagacattgtgccaagtgtcatacatgtatttcctcattttatctttgcaacaacttcatggagtaggttttataattatacagataagaacactgaggtgtagagagattaaggaatttgtccagtaaaacctgaaagtggcacatttctgtttcaaatccatatacctcccaagctctttaaccattacgctacactcagtactcactttctaattatttactccattttactattgtaactctttggtttatttacatctattgtgtcttcataatggaatgactatataatagtatatcactgtgctgcttctcagttccacattcacacatcacactggtagcttgaaatgagccatagacagggaatttatgccacagaagttggcaaatgctacaaattagggttttgttttgttttattgagacccagttgttaaacatttaccagaatgccactgaccacattggtggtgttcttgttatttttgtttgttatttttgcagtttgttttgccctcattagcttcctcactaataatataattttgagtagaagttaagattttggtggatgaatctaatcagagagtgagaagaatgatgagcttcattagattatctagtcaagctgcaaattacttattcaaaaaagcctgtattttaagaacagaaatatttattagatggcagatagaaaagtagaaaatggggtttctgagaataaactgatgattatgtgaccctcagataagtatctaaaattttttattgtatttattagagcaaaactggagaagaatttacaaatttggtgctctctctctgtgtgtgtatatatatatatttgagacagggtcactcaatcacccaggctcatcatacagtggcatgattgtagctcactgcaggctcaaattcctgagctcaagcaattctcccacctcagcctcccaagtagctgggactacacatgtgcgccaccacactctgctaatttttttttttctgtagagacagggtctcactgttttgcccaagctggtcttgaattcctgtgcttcagcaatcctcttgcctcaaacttacattcattttttatgtaaacactttgatatattttataatctccagctttctgcaatgtctgggatcactgtctatacaaggtaatttattgtttcaatttctaaaggaaagtggtgagattttgagagcagagctgggcctgttttatccttttatttccattctctgtcccaccctctgtcttttgataatgcatagcaatttgtaaatactgataaataactggaattcatctagccataagattcatagctggtgttctctttttaacttaatatattgtatttcctgcaagtctgatagaatatggaactgggtggaaaatttgcatatttctgttctcatgtggaattgctaaataatattctagttcaccttttatataaaccttcaaatgaaccacttagcacctcctggagaccactattacatcaaattttcaaattaataaaattacgtcattattcatttgttcattcattcaacaaatttttgatgaagtaaaataatagtataagcataacaactgctatttattgaacacttaatatgctccaggttctaatatacatactttactggctgtatcctacacaaaacacacaacaacatcatgaggtagctgttaatattattcctacttaaaatatgaagaaactattatttggaaagttgaagttacttgtccagatctgaatccagataattgtttcttaattctgagctcttcattgtctagtaccttgcctttgtatgtaacacctgtactaggtgttacgtggaatgtcagagaaacttgtaatattgttgtgaatattgacctttcagtctcattggagaaaatatacatggtaatgattacattgaaatggtgagtatgtattcatttagccacaaaaatccatcaaatgtaaaaggcataaatgaaggactttcttctcagtaatactgggtttccattgctatactgcttccttttgccagcataagatattcatatatcatggaaaaatagatcagagaagtcatgttatatgttttttaaagatgtaatatgttaaacatatatatgtttaaacatgttatatatacatgttatatatatgttgaagcatgttatatatgtttaaacatgttataggttttttaccttaaatatttggaaagtacactatacattgaattaatctggctaaatagaaacctgatagtatatgttatggacaccaagttattttttttttggattcttcatccttttttttattattatactttaagttttagggtacatgtgcacaacgtgcaggtttgttacatatgtatacatgtgtcatgttggtgtgctgcacccactaactcttcatttaacattaggtatagctcctaatgctatccctcccccctccccccaccccacaacaggccccgacaccaggttatttgatagctctttcacggtttcttcaaacaccaccctctgtcaccaactctctaaataggatatcaatgtccgagacttcagtagctcttttcctatggacaccagtattgattgaatacttcctttgcttcttgtgcagtgtgctagaaagttgtccccaaagtagaataaaatagatctccatactccctgaaaaaaataatattttgtaaaaggaaatcagtaaatgagattcagtaatcactcacagatattccctaccatctttgctgtgtctaatgtatataaaacataacttaaaaacatagcttaacaacactgctctcaaattatatcactttaattttcatgaattatgtttatatattttgtatcatataacctaaagaaacaccaacacttaaaatagttacagaccacaaatttgtgagaaatttcacttcacaccattttaaatagttggtattctccttataaatgttattatatattttattctctagacgtctgttagaatatggagctgaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaatatggagctgagtgtgaaatttgcatatttttgttctcacctaggattgccaaataatgttttagttcactttttacataggactgagtccaagtatataaaatgatttttttcatggttaattttaactattttatggcctttcgagagcagtaggttttaggtatttttctggactgtgtatttgactaacaaccatacagttcttgtgtgaaaattatttagaaatacactttcttgcagatactacttccatttgcttggaaattgtcttggtatactggtgttattatttttattttctctgaagagatttcatatcattttatacattacaagcatttttgttttatcatattgagcatattctaatagctgctttaaaatatttgccttataattccaaaatttgtgtcatctttggattggcatctgttggttatttctcccttaaaagtagatcgtgttttcctggctgtttgtcaaataattttgaattctatcctggacactgcagggattatgttgtggggactctggattctattacattactctaaaggttgttgatgtttttgctttaaaagacaattatcttggttagactcaaactgtgaaccatctcccctgcagttattggtagctcagttcaccattcagagtacttttgttttgttttttatttattttaagtttttgattgacaaattataaatgtatatttttatggggtacaacatgatgttttgatatatgtatataatatggaatgattaagtaagctaattaacatatctattacctcacgtaattttttatggtgagaacacttgaaatttactttcagtaatctcaaaatatataatacaacacattattagctctagtcaccatgttgtgccatagatctcaaaaacttatttctcatatcagtgcatgggtggttcggtggtagaattctcatctgccaaaaatttatttctcctgtctaactgaaactttgttcccttcgaccgatatctctctatttcccttccctcccaacctctggtaactaccaatctactctgtgtttttatgagtttgactgtttaactcatccaaataacagaattatctttttttaaggctgagtagcattccattgtgtatatataccacattttctttatccattcattcactgctggatacttaggttgtttctatatcttgacaattgtgagtaatgctgcagtgaacataggagtgcaggtctctctttgacatactgatttcaaatcctttggatatgtacccagaagtaggatacctggctcatgtggtaattttatttttagtattttaaagatcctccataatggtttttcataatgcttctattgtgtcctgtgcttgcatacttaaaagaatagcaagagacttgagcggaatttatacacaaaacttggagtcctctttctcaggctctctcctttatgaagttccccagctcactctccagtggctctttcctcatgttgctccagctaccctcagtataaaactgtgaagatctgaaactcaacccataccagtcacttactccaagtattgactccccttcaaaatcttcctacttttgttcactctccaagccccccggctagttgtttttctgtattttgaccagttgttatttgcaagaggttcaattaggagcttactcttcaagattacaaatggaaactcctatactgattttatagagaaaaacattttactatttgccagaaacaccttgcaataatataggaatgtatgaagtttatgatccacggactaggcagtggacagtcttctgtgagcagcagctctgataatgtatgcatattatggcaccagcacacacagttattttgatactgttaagcttatggatggttgttttacatgaagtctacggttatgttttacatttgcccctggtcctcaccttcactgagatgctcacttaaagcactaaagtatccagactattgagaattaattctgctctcaagtaactacggagctttaccaccatgttctgagtaattcattacaatacgtaatatagaattgccaagaaagtccaacttaaatctcacctactgcctcagtcactgccatgactgcaagctaaatcctacacctcttcatagtctccctttctaaccacactgcatattgctcactgcttgtaaaactatcataatttctattagttttgcattaccactattttgactatgaacccttaatggtgaagacaagctatgtgcctcctattaacatattgaatcaaaaacttctacctagcttgaaaacaccttcttgaactgcatgcatcccattcttccaacttgttttactgctgtaattatggacttgttcctttccttattacgtcataggtatagcatgtcactctccatgcagacctttgttgcaaaatgcttaggatattgatgacaactggagtggataatttagaaaataaatttaaaaaaatgcttaggatattgaaagaaatacctctaaatttctacattctttctcatgcatattcctcctaaaacgaactgttaaagagtatagtgccatatttcttacatgctctttctattccccataatctcttagccctttttctgccaatgttataccggattattcctttatatattcctatatatattccttatatttcatataagcatgaaaatgttctttctctcatttggatatgtaatcctaattaaacaaagtcccagcattttcttaaaagatatggagctcatctgtcgacttgtaccaatatcagattaattactgtaattattaagaaacatttgaggaatgttgacattcaaatcaactatagcataaaacatgtaccaaaaagatgatgacgttaaataacttttagaagactatgaatcttggttgtcaaggggtccttaattgctatcacattgtctgttgcttaatgcacataaagtataaaagtaactttaatcaaaactaactcaagaatagaacaaataagaaatataataggattagtaaattctattaactggacattcacacacatcacgaagcaagggttcaggagagatcaggctaaagaggtttctggtggaggagggtcaactctaatgaaaacattggaagtcgatgggatgtggaagcatcatctgttgaaatgacttccacaatgagagagaaacatctttctctcttaataaatcattacgtctccactgtccattgcactttggcccctgtctttttacgatagctggcaagtattcactgtgcctgtagggctagacagcaataggaatgataaaaagaagagttgacaactatgattcattgaatgcatactgcatgcatacatggtgctcatttgtattggccagacaatttgtaaaaccgttatagtaatcctcatttttcagaagaagaacctgattctcaggtcacaatgtagtttatctaagatcatactggtggaagtggcataactgggattataattcacacccatctgactcttaaatttaagctagtggctgaactaatttacactcctaccaacagtgtaaaagtgtttctatttctccacatcctctccagcatctgttgtttcctgactttttaatgatcgccattctaactgtcatgagatggtatctcattgcagttttgatttgcatttctctaatgactagtgatgctgacctttttttcatatgtttgttggcagtataaatgtcttcttttgagaagtgtctgtttatatcttttgcccactttttgatggggctctttgtgtttttcttgtaaatttgtttaagttatttgtagattctggatattagccctttgttagatggatagattgcaaaaattttctcccattctgtaggttgcctgtttgctctgatgatagtttctttgctgtgcagaagctctttttaattagatcccatttgtcaatattggctttcgttgccattgctttcggtattttagtcatgaagtctttgcccatgcctatgtcctgaatggtattgcctgggttttcctctagggtttttatggttttaggtcttacatttaagtctttaatccatcttgagttaatttttgtataaggtttaaggaaggggttcagtttcagttttctgcatatggctagccagtcttcccaaaactgttcattaaatagggaatcctttccccatttcttgtttttgtcaggtttgtcaaagatcagatgattgtagatgtgtggcattatttctgaggcctctgttctgttctgttggtctatatatctgttttggtatcagtaccatgctgttttggttaccataggcttgtagtgtagtttgaagtcaggtagcatgatgcctccagctttgttctttttgcttaggattgtcttggctatatgggctctgttttggttccatatgaaatttagtgtagttttttccaattctgtgaagaaagccaatggtagcttgatggggatagcattgaatctataagttactttgggcagtatggccattttcacgatattgattcttcctatccatgagcatggtagaagacagtgtggaaattcctcaaggatctagaaccagaaataccatttgacccagcaatcccattactgggtatatacccaaaggattataaatcattctactataaagacacatccacacatatgcagcactgttcacaatagcaaagacttggaaccagcccaaatgcccatcaatgatagactggataaagaaaatgtggcacttatacaccatggaatactatgcagcataaaaaagaatgagttcatgtcctttcagggacatggatgaagctggaaaccatcattctcagcaaacttgctctcactcgtatgtgggagttgaacaatgagaacacatggacacagggaggggaacatcacacaccagggcctgtcagtgggctgggggctatgggaaggatagcattaggaggaatacctaatgtagatgacggtttgatgggtgcaggaaaccaccacggcacacgtatacctatgtaacaaacctgcatgttctgtgttctgcacatatatcccagaacttaaagtataataataaaaaaaattaagctagtaaccactgcaagacacagtgctttttggagggaatgagctcatcaaataaggacataccttgtaagctctctctggaaagattcaagttatagatgtaaaaaagctttgaaagccagagagtgctacaaagatgcaaggcattgttcctgtttatttacttttctttgtttttccccttttctgtagtcacctttggtaaataggagaatcatctttaaaatgtgcagttctcttcaggttattctctagatccattctataatgaaacatattcttcagtaacctaagacagtataaaatagtagaattactataagataaacccctaacctgtataattcaaactgtacatatcaccctttattttctattaatctaaacttttgtaatgcatacccaaacttaaggatcaactagtaagcctgactcaagtcttcaccttcaagtattgcataaaagcaaaattataccaatgaaaataaaaggcctccataaaaatcctgcaaagtacacaattttaaaaagtaaaacaaattgtaaagtaatcagtcctataggaatgacatccctaacctttccctaaattacatgaaggttgtgacatttcgtggccactggtacagctaaatataaacggattattctgtgcctgctccctgtgcttttgctgactgacacaacaattaaggaaacaagtttccttcgtaaattatagctccatgcagctttgagtaagcagaaagtgtacattagaaatatttttagcttgacgtgaaactttccaaaggctcctaattaagcagttaagtccaagaaactataattgcaactgccaaaataactgggaaatcataccttggatgggatcaatcttaaactaaaactattgtttggaaaatcttatgaaaagactttattattctttaacatcctctttaatagaagggtacttctaatattgcccactttctgagaaattcaggtgcactgtttatttgcagagtatgtatacagtgagtgtgtaaacaaatactagcaaaaagaatgaccgtaagcattggtcatttgtcactagaaaataaacctccagagtcttgtcctaatgaacactaagatagagcatcaccaacccatgggtcagatatggattctcaccatggattcagctatcagaaacagtagaagagatctttttagaacaccatctcacttataccttgatccaaaagctatttaacctccatagatgtgtcacattttcaaaagaatggtagcagagttttatgcagactatttctatacaactcagatatcagatattgttatatgaaggtaatgattattatattttaaacactttcagatgaaaacatcagttgcattcatgggaatgttcagagtcagagcatatatgaatttaaaataacagtcatctagctcctgttgtcataacaaagtcatgttacggtcactgatgcagttaccttgataaatctgtgaaggtgtttagaggattttatattcatgtaattttaaataaataagcatattaaagtggtgtttatctcactattatttttatttgaatttcgttatgttattattttgattcagtttaatcccaaattagaaatgttggtagcagattaagaggcacaaagtgggctgtcagtaaaacttttttgacagctgcatttatggaatgcttatcatgggcaccaggtaatgcatgcatttactcactgaatccccactgctaatgttatagccatttctactcagatgaggagactgagggtcagagaggttaggaagcctgttcagggtgacacaatacaaagtgtcataaattgggtttgtactcaaccactctgcttattaacatcagcagtatgttaatgggtgaacgattgttaagtgtcccaagaatgaatgcaaactactccagcttagaggaaatcatcaaacaacagaatatagtgtcaaaaaatgagacttaaaactaaacaaacacatcacatttgtttcatatatatatagtttcagaataggtcccctggaacactctcatcctatactaatggcatcaccatttctcaaagagttgtggagctatccttgggaactgattttagaatcaattaataagccactgtcttacacaatgtagcctaatggcttcatagtctcaccactcttcttctaaaattgaagtggggcctggcacagtggctcacacctgtaatcccaacattgaggtgggaggattgcttgacctcaggagtttgagaccagcctaggaaacatagtgagacctcatctctacaggggaaaaaaaaaaaaaatagccaggcaaggtagcacatgccctgtagtcccagctacttgggaggctgaggcagaagggtcacttgagcccaggaggtcaaggctatagtgagccaccattgtgccactgcacttcagcttgggtaacagagcaaggctctttctaaaaaaaggactgccctgactgcttatgtaccttccttcccaaacttggctctgaatgacatttggctgttaaaagtgtcaaattcatcctcaaatggtgaaaatgtgccaattgtcaaagtagttaaaaggtcctattgcaatttactttaatcaattccaaaaatgttttgagtaatgaaggcattattataaatgtgtaatccattaagttggaagatctgatgaggatcctattcatttggataaataagttatttaaaaagacccccaaaacaggcctcattcctttaaagtccatatgtgaaacttctgccttgctccacattctgtgctaggggatatatgggttgaaatagaaagtaaagtggatagttactgatgctttttttatcctagaaagttgtaaggttgacattgtctcttaaaaaaataataataataaaataaattaaaaaaaaattcccttgcactccaataaagttgttgttttctttttttctttgagatggagtttcactcttattgcccaggctggagtgtaatggcacggtttcagctcatgcaatctccgccttgtgggttcaagcaattctcctgcctcagcctcctgagtagctggattacaggcatgtgccaccacgcccagctaattttgtatttttagtaaagacggtttctccttgttgttcaggctggtctcgaactcctggcctcaggtgatctgtccaccttggtctcccaaagtgctgggattacaggtgtgagccactgcatccaacagagtctttatatggttgtggtggtgattgggggtggacaacagcgatttaccagaagtggaagagtaaaggatttaattgagaattggccttaggcaaagcttaaaagtcaaaacttggtctttcaaaaccccgttagatctccccagagcctctatttcctctcccaatgagctttgctcctcctccaatcatccttccatcccctgtatttcaatgcttgctgtcagaaaagtactagctaatggcagcttgccattatgtatatgaccaaccacttgtatttgcattagacaatgaaactttcagagaaggaaaaagcagactaagacatagaggaaagcttctatcctctgcacccactcttcttcatggagacttccaaaccaaaccatctctgacacttagagtggtagcaccttccttagatcgggaaagccaaatagcttagaagattacattaaatttactggtataatcaaaataatatatcacaagccatgaatatctgaagagacccttgaatttctggcattgtatctccatccagaaaagctaaaaaaaaaaactcccaatgaaaagcatccaattttaaaggaaatacctgaaattagtctagttcatgtccccaggaggcaaggacaccagagctgtggtatttcctaagcacttgaaaggccaacagtgacctcctcatgtaaatatctttatgataaactctcaggacagccatttttttttttcttacttaaagttccgggatacatgggcagaacatgcaggtttgttacataggtatacgtgtgccatggtggtttgctgcatctatcaacccatcatttgggttttaagacctgcatgcattagctgtttgtcctgatgctctccctctcctcatccccctacccccgacaggcccaggtatgtgttgttccccttaatagtgataaagtttacgcatgacaagaatgtaacattgatcaacattaacactgactaatgctggttcattaataacaaatatatttagttaacaagattaaaattaaagttttcttgtgcaatttggaatgaagagagggggaccctgacctagttttgtaactcaaataactttacccatccctaaaagtctatctaacccaaagaaaaatgacagacaacttataaaaacatcacttcagccttcagacatctgattgacaagattaaacatatccacatgactccactccactatgaagccatgttgtgggaggttattgaatcgtgggggcgattacccccatgctgttctgtgatagtgagtgagttctcacgagatctaatggtcttataaaaggcttctcccgctttgctcagcacttctccttgctgctgccatgtgaagaaggacgtgtttgcttccccttctgccataattgcaggtttcttaaggtcccctcagccatgctaaactgtgagtcaaataagcccgcttcctttataaatgacccagtctcaggtatgtctttattaacagtatgagaacagactaatataatgccatatttgactttctgtttctgagttgcttcacttaatagcctccagttccatctgtgttgtggcaaatgatttcgttctttttaatggctgagtagcgtatgtacacatacacacacacacacacacacacacacacatatgcacacgcacatgcacaccagattttccttatgcagtcatcctttgatggacatttaaattgattacatatattttattgtgaataatgttgcaataaacatacaagtgcaggtatctttttgctatcacaatttcttttcctttgggtagataccaagtagtgggattgctggattgaatgctagctctatttttagttctttgagaaatctccatagtgttttccatagaggttgtactaatttacattcccaccaacagtatgtaagcattcccttttctctgcatccttgccaacatctgttattttttgtatttttaatgatagaaagatatttctgattcctcaaaaggcactgtttttaaataggtttgagaagtccagttgagtcataaactggtgccatgtggtttcatgttgtcatgtgaaaatttgatgatctgcaagaactacatgcccatcagacagattcagggaaaagggggcaagcagacagaaataaaaaattccagcaatttaaaacttaaacaatgtatcaatgtttctttccacatagccctctatgtttatggagagagaggtcctcttcaagaggattcatcaacaatgaaagagtctttgaaacattgatcctgtcaggtcttgatcctatcgggtcttgactctctactcatgaatcttttctctctctactcagtggtggatttatttctagtaattcataaatggctcccagagtcaccaacttgttggaatttataatacacaccccaaaataaatcttaaacattctactatttaacatttttctgcatcaaatatattccttatctaaatatattgggtctacagagaatgttttttgaagacgtcaacttatgctggtttcctccttgcacacttagtcaatttatgaatttttaagacaagaaattttataatattagggtcttcttttacccaagataaaaaatgcttatttagaagaataagtttgtatgagttctaggaaggcacattgtcaggtaatagatataaggctggctctgtcttacatcagccaatttcatggagaacagaattgctgtccagtacaaatgaaatatgagtcaaagtctggacttgagtttgaatctaaagtagtttacttatctgagatggcttgcacagttggcacgatctataatggcattcatttcagagttgctcaaagtcggctttctatgtaaaagagaggcagagctatggctttttagctcttgctctaagattcagatctattaaattatttttattgagcgcctactacacacacagcagcagcactctgtcaatttcattgtaactcctggaaaagacatctctggtatgactcttgtccccggatctcctgtgggaataataatctttcacacttacttagttcctggagatgctgtgataattgacaagtgaatgtttgtgaagtacttgaaatcctcagatgaacctgttatgtaaacatggaagaatgctgcctttccaggtcacagccatagctggagcttctctaaacaaccaggttttcctggttggatgctacttgcctaagactgttattttgagatagctggtgtgtgctttattaatatgtatccctgactcttggcccagtggaagacaaagatatgatgaccaaattatattttacatgggctaaatatctcctaatctctcatttcttttgaatggagtgcctcaaatcttggtgatgattcattatacatttataaaaagagtgagagaaaaagaaaacttgctttttgactaacagatactcctcgtgttcaggaagattcttgcaaggatattaaaaccctcaaaataatagtctgcttagaagtaggttcacatataataaaagggagaaatttctcaagttctatcaaatttcaaaataatttaagaaatcatcacattaaaacaatgtattatcagattaaggatggtattgttataaccttttcaagtagttcaaacattagaaagctattcatatgaaggttttttaatggactcagtgaacatcttgcaaatttattttgtaagctgctgaaaatccctactagtttaacttgtcaacatacatctgaaattattagttcaacgacactttctacaaaatacaattttgtgtctcttgtaatgtgtgtcaacagttatctgtattaattagcactcatcagtcaggaactgagctcatttccagctattaatctgggaccagctcaacaaagactcccattatctaagcaagcccagctattggtccttcaatctaaatgtcatagttttctgggtaaagctttattcccacttgtttttttaatacctaaactattattgtcatggcttgcaatttaccaaaaagatcattttctgaagaaggcatgtagaaggcaaaacacaaattttacccaaagtagcttttagacattttcagtctgtgatatatattcaactgatttgagtcccatcaacttctctccaccctctacattcatttacataaaatctaagttattctgtaaacactttaggggcaaattaatactttaagaaattacctatacttattaataaagttaagaatagttattatttgtttggtaaaattttattttacagagttgtttttcttgaaaataattgagatactttttccacaacaagatttttatatgtagatatcaataaatttgttatatgtagattgatatcaataaatttcaccttattaatctagatacgtataatgtaaaaataggtagctagagatggagatagttcactgcatatataactacacatacacatactattagtagttactatcctttctgtttctcatttttcttcagtaaaattaattaataaacagcaaggttctctgtggccttcctaacagtgtttaaaatgaactctttagcaatattaaagagaacacaaacaatttaagtatgagtaaatgggacatatttcatgatatttatataaacatgaatgtctacctaccccagtgatgtgctggaagttgctcatacaagcttgtgagagctggatgttaaattttctggattttagaaaggaaatcaatacatcaaagatatatctactcttccatgtttattgcagcattattcacagtagccaaaatatagaatcaacctatgtgcccatcaatggatgaatggatttttttttaatttggtatatatacacaatggaatattattcagccataaaaataatgaaatcctgtcatttgcaacaacatggatggaactggaggccattatgttaagtgaaataagccagccacagaaagacaaatatcacatgctctcactcatatatcggagcaaaaaaaagtggatctcgtgaagatagagagtagattggtagttaccagagaccagagagggcagtggagagaaggagatgaaggggaaatatatatatatatatatataaatggcacttaatggtaaagatgttaaattttatatgtatactttacctcaataaaaaaaagataaaataattttttaggaattttatgagcccatttttaaacacacacgtcaaacaattatataaacataattaaataaattacattaaaaacaataaatactccagactcatcactctctaattattgtattgcctatgttcttgggattatatattatctctacatgatgaaatattatatcatagagagctaccattacagacttcttcccaacttcacagtcagtgacatctctttttaaagcttacaatagcagaagtatttataccatggaaaatggcaaatgctgtgcattagcatttatttttcctggagaattgattattaaataattagtagcacaccaccaatttatcctagcaaaattcttaggtaaataattatgttgatcctttatatcaatttatccctccctcctgatagactttagtcaaagcgaagaaagtacatcttatgtccccttcttccaatagacagttatccaatagacagttgaataagacatatgtatttctcttaaattctgtaaaaagtgctttgagattttgtgattctaagccctctttctaaatttgaacttcaggtgggatcctagacaatactgaacatttctttccttttgggaggctgcgggggagacagtatctccttctgttgcccaggctggattgcggtggtgccatcgcagctcactgaaactgtcgcctcccagcttcaagcaattctcctgtctcaaccacccgagaagctgggactacaggcacgtgccactacgcctggctaatttttgtgttgttattagagacaggatttcgccatgttggccaaagtggtctcgaactcctggcctcaagtaatctgcccacctctttttgaatgtaggccagcaaataatttttgttttgcacccttctgtggggcagccctggctgatgtgcagccatgttgagtgattgtcctgcatccaacagcaggaatgaagcttaacaggcactgaagggaagtgaagcaaccctggggaaggagaggattcagtataaatgtaacacaccaaagtaattcatcagtagtaccctttccaacaatagcccaagtctttacagttccatttccattcatttttattttgtagcaaattatcatgtttcttataaacatttagagaaatgtatagttggattattattatgcacactgaaacttaaaggtatatttatgactttctgcacacctcctaggtggaataaatatgccattttttgtaaaccacttctaacagggaccatgacagaccaaatcatgccagtgccctactctgtagtgaagtatctgtgcaatgaggttacaatgacctaataaacggatataccatgagaacgcttaagaacctgcatgcaacattacctttgagatttaaatgagttcttctctgaaaatataatgcagatctttccaacttagtagaaaagcatgcttttagtttgcttagtagaaaagtagtaacattagaaaaggggggaaatagatgtatgaatataaataaatttttttttaaaatttggttgtattgaactttcaaattagccaactaatggtacatataaaataattataatcacactttacttagacagcattaaatatgggatgatcagagtattatctgtgatcgcaaaactgttaacagattatgtagctttattagaaaaaaaatttctttttactattaatatgtgttcatttatgtaaaaaattcaatattactatgaaattctgctgaaatttttaaaaataatccaaaaaagtttacgatgtctatcattaagtcttaaaagagagaataagtgtgaggatatgttaaaggattcttttattatacttcagtcctttgaggcattgtgctttctattcatcttttttataatgtcaaaacatgaaaaaatcatatctaaatgacttgttaaggagttagtaacaacctctctctttctttgtacacacacacacacacacacacacacacaccatggtttgtgtgtgtgtgtgtgtgtgtgtgtgcgtgcgtagattagagcaagcagattaactttataacgctggttgagaagtgtcatttatgagttcacaattttccaattctaattacatagccttgtggaaggaaagacataattatcatttctagtgtccctggcctcactgagcaaatggctcttgatattgacattttgtaccatggataatgatactttcccttcatttagtggaacaagaagtgctatacaagcactcactcatcaatgaccattgttttatcatcaattatcacacattagaaaagaaacagcaccaagcctcacccaatataaattattatgttctcaccaagcctcaccagtattaaacattcaaatttagttcaggctttggataggaagataagaaactatgccatggtggaccaaatttttttaaaccagttctagcattttaaacacgataaattaaaactatttgaaatttaaacgtttatatctaaggaacatgaaagccctggctaaaattaactagatacttaaaaaaaaaaaagttcatcatctagttacactaaatacattattttactaaaatgctaggttaaaagaaggaattattaaaataaatggcaatacaaataaagaaaggtactttgtgtttttgtctatatcagtatgcatacatacatgcacaaaaaataacttaagcaaaagtaagtagatcttaattttatacaccacagtccattatatttgtagacaaagctagaatacaaaaattttattgtttggtcaagtatttttatttatactgacaagacaccaaggaaatgatgttcatatggtttaatgtagtttggaaaggcactcgtgaaattttggctaatattagacttgggggagaaagcactattatggaaaccaagggcttggaagtaaatggtctatgagtcagaagcatattatgctgtagaaataatgagtgctaccagctgagatataaaattcaccatgcagatttcaccctccggtatagagattttaaattagattttagctaaaggcctattttctgaaaatcttaactaaaattgttgcctgaaatttgtcagtatatctgaatttatcttaagacttaattaaccaagaagttgaatatgggatcctgtataaaaccattgtaattcacatccatacctctcaaaagaagcaaaaatgagaagttttgtttcctatgaattgaggaaagtatacactcttactgtgtaaattttgaatgaacattttaaaatatctttattaggcacagctgcatacaaatggtatttctattttggctctgttagcaattctgttgtttctatcattgactttttccatctttcttcaagcattctggaaagagtccttctaagaaatcaacacacataaaactggtttagattacagcctacctggcatgtatttctttgctcaattttttcattgcagtaatcttgaagttgacaatgacataagcctcttaccttaaaaggttcaaagattccctacatgaattttagtttcttagataagagtttttttttcataattggaaaatgtataatttgataagaatttaataataaaataggccaataattttaccaaatccttgatagcaatatatatgtatgtatacatacacacacacacacacacacatatatacacacacacacacacacacacacgtgtgtgtatttaaataaagatgctttccagcagggtagacaagttgggcaaaggaaatatggtatgagctctttcctttatgactcctctgccccattgaatccttataaaaatattagactagtgatggaaatttgtcaacagttacagaataagaaaatacgttaaatctgaatatatggtactgaatacggctaataattctttaaaaaattatctaatgacaaagaaatatttgtgcattaattaaaattgattgatgaaagtgcccaggatctagaccgttgcattgtggaggtccccatgtccagcagatctactccatggccaactctggtgatgtagctgcacacaccccaggttgtgctacggtagaagaaccccagaccctgcccctcccccgtggggctggagatgcagaatgctggggatatgcctgagggttatggactcacatgcttaagcagaacaaagaagtacatatcaggcccagaataggggaagatactctgtcacaaagtggcaagcccagcacaggctgtgaaggctcttaactcccactagggaaatatcacaggcccatagcactcatgcggccatgcaggggccaacaatctgtgcatgactgcctttcccaacagaaagatatatgactagaagaaaaaaaggactattcaaactattcttaataaacttttttcaaagaaataaagcacttattctctaggtttctaatgttttaagttacagtatactaaacaaatcttcattttattcttttttttcatttccctaggcatttataactggcaatgagagaatttttaatgtttatattaaaaaattttaaaggacacagatcaatcataattttttccattgattattaagatcactttgcacagtttcaattttcaggcattttcatggtcccattttactgtgcaaagactgactatatgcttctaatgtcggtatattttacaggaagggcagtttacatacaaaacaagtttacaggatgaagccttttcaattgcctcagtaatgaccttgatattctgtctttgtgattaagcataaaactaaaagaccttagaatgtaagtgagcatctatccagtgaaataatttgtgttttttgcatatttacaagtcagggaagacaaaacaatggcagctttgttgacccagtatgttgatttgtgacctgaaatactggaaattttctcagtagatgttacatcacatactgattattagcagttatttactgatagctcaatacgtatgcaagagaggagacacaagtgcatggcatggaccctactctcaaagagttcacagttgaattgaagaataaaagtatgttcactaatttacacagtaaacatttcttgaatgcctactatgtgctgggcattgggcaaactcttggtattcatgagaaagcaaaatgcacaaataactctgcctcatagaacttgcattcctcaatagtgagtaagaaaaatatatttgagtgaaaaatggtgtagaacaaaaaggagaacaaatagggcttaagaggttgcgagaagtcattagagaaagcagaatttgagctgaatcatagctagtagaactatatatggagtacaccttagaataaacttattctaaatttttcccatggcatttaactttaaaatacatttttgctttgaaaaaattcatttataaatatagagaaaaatttcacagatgctgagctatgctttaaaattgtttctatatttctatgaaaatatatgtgtggcatgtctctacatccatagaaatttatttcaaaagttcgtttgcatttgcacgctgagatcagatgttcctgtgtttctgtcacttcatactcttttttccaagaaaagagactgttttgctgacacatataaatttttggaggattagaccattttcctattgtggaacatgtatacatatttatatatatttatatttttccaatataaatattggaaaacatttttctgaaaatagtaaccttcgaaatgtgattttttttaacattgttgctctccaaccctcatatttatattttcagtttagtacattttttctttatatttaatttttccattattttattttaaacattctggttttatatcccgtttatttgtctttctaagaataactttcttatatatagcattctctgttgtctaacgcttccattccaagatgttctccagttctgtatcttgattgtggtggtggttataaatctatgcatgtaataaaatttcataaaattatgcacacacattcaaaagagcataaaaactggtgaaatttaattaatatctatagtttagttaatttcattgtgtcaatgctggtttcttggttttgatgaagtgttatagttatgtaagatgttgccatggcagaagctggatgaaatctacacagaagctttcgatgctagttttgcaatttttacgagtctatacatatttcaaaataaaaagttttttaagaatattctctagttttcatccttattcagattagacctgtttatgccatataaatgtaaaggctttatatactcaaagagcatataacttcctctttcaaaaactccaaggctctctgatatgacacagacagttttattataatagagttgtattataatatttgaagttttattataatagagttctataataataaacttttccttttaactacatatgcctattccataatgccttgagaaaaaattccagtcaatggcattgaacacatctattgatagaaattatatttttttaagcatgggtggcaaaagttatttaatgaatcatcttccaatgtgcagaaatagttgacaaataatgtacccttgttttccccatatttttcgtatttttttcaatttgcctatatcatacatcactttttccaatatatgattttatctttgcttctcctaaaatgccatttctctatttttctcaaatttaactctgtattttttcttgtgtcttgtgcctgcttccctcacttattccagactttttttttcttttggagccagggtctcactctgtctgtcgcccaggctgaagtgcagtggagcaatcacagctcatggcagcctcgacctccccaggctcaggtgatccttccatttcagcctcccagatagctgggactacaggcatgcaccaccactccgggataattttttcatgtgtgtatttttagtagagacagggttttgccctgtttctcaggctggtctctaactcctgggctcaagtgatctgcctgccttggccttccaaaatgctaggattacaggtgtgagccactgtgcctgacctgttcctgatttttaaatacctggttgtcctcttcttttgtcatttctttattattatgtaatcctattcaccaaaaaaaaaaaagctttttccccttttgttgtctccatcctcaaaaagtgattattgatctcttctttatgtaagatactaggcaggaccccaaagggaagacaatgccctctcctgaaaagccaaggcccagtgaagagatgagagacaggtccaatgaaacaaatacaaatggtatgaataaaaatacaaatgatgtgaggctcctgatgctaagtgtcacaagcacgatgacacttctccagccctatttccatttctactctaaattaattttgtcttcttttgaagtctcacctgcaaggtagcagaccgtaaaaaatacctaaccctctgaactacttaaactctattccaattcggttatttcaacaggaccttttcaacatgctcagtctttcttggtggcggaaagattttaaagccctagaatacaggaattggagtcgtgacttcaccctttattaagtgtgtggctttggcttacttaatctttcctaggcttcagtttcctcatctgtaaaataatgggagtaatgatatagaaatgttctgaggattctgtgagacaattcgtggaaaacacttagtaacataccaaaaaattagtcagcacagtgtatattatttttcttctttttttaattatcaaggtcagtgacttttagagaatcaatgtattcattttctactacaagaactttaatcaatagtatctattttccttgtaaaaatctgttccagagatactttccccttccaaagcattactgtatttcatacactttgaggtatgaatataactcctatgatctttatttctgtttattcttggtcttaatgtattcctggctcatcactgtccttttaaggcatgtgtgtgtgtgtgtgtatgtgtgtgtgtgtgtgtgtatgttttaggggaatagaggaagggaaaggaaaagaagtcagactctactctgagtagttttccctttgattgttatgttttgtccatttcatagacattagtaattatatatacaatattagaagctttatctgaagtgttctgtggatattagggttgagagctcatattttttaagatagcaatgtaagtattgctatccagtcctctaaaatattcccagactgataggattagaagagtggccaccaggcaatttgaaacccttcaaggacgtgatgagaatgaagaagtccagccaaacagggaaacagcatgtgcctcatgaattttcttttttgttaataatgactcaagaagaaaacaggtggttgtaactatgcagaccaagcagcaaaattccaaatacagaaaataaacctcagagattcctttaaaggattatttaaacacaaacaaattcctaggggacagtaacaaaattgaaatatgtagaagaaagaccagtgtggtgtgtatggaattagagaatgagttgtgagtgtgaccctcagaatcccgggagcacataggcttccagagatgaaatggccaaagaaagaattcaccagaatgtccctaagtaaaggtctccagaaaaaagtttccttggaaattcagttcagattcctcctgaccttctgcaaaagattctccttagtgtgtgtctggatatcttcctcagaaatgacttgattgtaaacagagagaaaaggaaattaatggagcttaagctttagggcctctcacttgagcttcatgggaccctgtaccaaattgtctgttgtaattttgaattcttcttctggagaaggctcccaaaatgatatatgtttcgggccccataaaacctggatacatatgtaactaacctgcacaatgtgcacatgtaccctaaaacttaaagtataataaaaaaaaaaaacctggatccacccccagctgtcaagtataaaaactcctttaaaccaactagagtaagtcatctctcctgaggtctctagctttttctttctacccttctcactgtgtctgctcctttttcctgccctctgccagttttctcagcctactcatgacttcccggccctactaaatctttagtacatgtggttctggctggcagtggtgctaagtctggctcagactctatgtgaactttcaaaccaaactcccacaggcaagttaactgactcctgtccttctgccccaattccaaattccttggagagggacctgtctgtctagcacaagctggttgtcacctggatccagtcagctgtagctgggctaactggggagggtcctgtcatgggcccatagaactgcttcttggaaagtgagaggggaaattctctaaggaggagtaagtgaggaggccataaatgtcatgtctactgtatttaaaaaggaagttgactaagtgttttcaatctgccaaagatacactaagagctgaagagggaggggcactagcaaataacttgcttcctcattatgattcccgtagtgttccaaagccactgctttcctgctgtctctttttttagtactttttaaatccctcagtaagttgctttcaaaagattttttctaattaacagaatatgtcataagctcattctagtattctaccacccttataatcaagttttgtccagtgagtccattaggctaggggaaaaaacctagccaatgtcttcctacttttttatttatttatttatttttgagacagggtctcgctctgtcacctaggctggagtccagtggtgcaatattggctcattgcagcctcaacctcctgagctcaagcaatcctcccacctcaccctcccgaataactgggactacaggcactcagcaccatgcctggctaagtttttaattttttgtacagatgaagtctcactgtgttgcccagattcatcttgaactcctggactcaagcaatccttctgcctcatcatcccaaagtgcaggaattataggtacaaaccactgcaccgggccaccaatgtcttttaaatatctaaaaatttataattgtttgtttttctccttgcactgttattcataggaatgttgccaaaaaagagaaattgtattattttccagagaaaataggctaaaaactggaagcagcttatggcagactaaatgactcagttgctactgtgtgtataaacgtaccctgtaaagtgtagaggatgcatttctcagcaacaggtgtgccttaaatgtgttagatgggaacataggaaaagtatggccccaggcttctaggaaaaaaacagccttttcctgcccatactaaatagccacttagagactagagtttttccagacccttacatgttaatcctttttaacaagttaccagatagctgaacacaaactgggtcaagcaagtctgtttctcagaaggcaagatgtcccatcctaacaccataaatcacactcactttagaaatacgtttttctttgatccaaatgtcttttcttaataactcattcctaagatttccattttcagattcctgtttttgcataagattgcatgaaatattttttgccattacacacagtgcattttattgaaaggactctaaagggcttagggaaaggaaaatttccctaaactgcaaagaaagtcagctaatcattctgaaacataataaaaactagtttttaaaaatagctcatgataggtaatggggagtaggtagacccaaacaagattggtcagtttctacctggacaataaagtaaggcattaatttccttcagatataggtatttctgtagcagatattttttagaatttttttaaaagttgtgtaagggtgttttatttatcagaaaaaataaatgtattttgaactgtttgaaatgtaatccaaaaattacagctgaaaacatcaattatttaaatttatgttacacaaataattgtaagtcttgtgtactggaagtaaacaataaaagtatgaattttcttttgaccacccctttcccctaccaggggaataatggctccatggcagaggcagtttgtacctcagtccatatacatccccttcttattggcattgcagagggattgcagcctccccgcggcaagtagctcaataaccaaatattgaaactgtctgagtctgtaccctgctgcccatgtcataaattcttgtatcttaaggtatcaattttttatatgctttacttttacttatgctttttattcctatgccctttcccttgtactctacacctacctgaaatgcagcatgcatgccagccatgcctatatcccatgaacactacctccaatgctacctgactctctacccttccacttttctttttattatcattaaagtaataatgggccattagtactactcaagacacaaagccaaggagtttacaaaaactaaattactaagtactgtcctagcagccttcctaacttaatgccagttccaaaacggcaaactctttgcccagaagcaatgtttgttcactgagaaaatctgggtcagtacatggccttagttaagccacttgttttttctttatctcattttcccccactgtggaattagcctggttattggcaaaacactctgatatttttattaaatattaaaatgttagcagtagccaaagcttgagtgaatttgattttatgaagccatgcagaattatttggagatgctagtttctctcaataataacatcactacataatttaatttcatacacacacacacagggtcctaaaagtcttagcacaattttaggcttgactaatttagaaatataagtgctacaaacttaaaaaaaaaactccacataatttgaaagtttaactagacttctttctcatttgtttacttttgtgaattttgaataataaaattttagttttgattgtttttgtttaaacatttgctactttcagtcagaaaaactgacatgtatttcaaggatatgggaaaactagcattgtaagaattacagagctcttcacatctgagtcaatatttgtacattgctttaaatatagttcatgtctttcatccaggaaacacttgttgagaaccttctacctgtaaggcctacattacatcagttacatttcttcatttaatccttactgcatctttggagttagatatcataatcctcacttggaaaatgaggaacttgaagtctaaaggagtgaagtgactttaccatgatacttagaaattgtatgtggaaatcaggacctcaatccaaaatcctccaggtctgcatctcaagttctttccacactcttgcattatcactctccttgttgatgttctgcgtatagactctatttcattcaagtgtggatatatctaaaagtcctcatgaaaatgtatattgaaaggcagtctgggccaaaatacagaaaattcataaaccaagtacctcatagatataatctcctttatccagcataattaaaggaactaagcagaattagtggattcactacagaatatcgaacctatctcaggtcatataatggtcctgtcaccattcttctctctgtaagattcagtgcattatctctttgacaggctaatccctaggatgagctcttttgatcataagggatcctgaacaggatgttttgccatccagaaaaccagcaccactgagacgccagctggagacatgtcacgaaaacttggccctaattccaaagccaacagtgtgttgaaattagggcatatcatttgcttagttcctgactgcatactttacaactgacaactgaagattactaataatgtcttctactcatgtgtacccctcatccaggaggaatccaagtcattttatcagtgtgtagcagccatttaagtctctgattatagagtgcttttaagtcctcagaatctttattgtggagcagcgcttttctgcagagaaggattctccattaaagatctaaaccttataagcacttcctggaaccatactgcctgtgtcaacttgcctggtagacagacaaacattttattgaacatatactatatcttgagagctttacattatgtaatctcaattaaccccacagtactttcaaaatagctgttattaaacccattttttaaacaggaatactaagacttaagtaaaagtaaaatagataacttgcccagaggtcacataatataaaatagcagaggcaaggttgaaatcatgtttgtctgattctggagtcttcatgtttgcaactttattatgtcccctcagaatttccccatcatgcttattctagtttcctccgccatctccctttttttttttttttttttttgaaacggtctcactctggttgcccaggctgaagtgcagcggtgtgatctcggcccactgcagcctcaacctcccaggctcaggtgatcctctgacctcagcttcctaagtagttgggactacagatgcacaccaccatgcctggctaattttttgtatttagtagagatgggggtttcacaatgttgcccaggctggtctcaaactcctaaactcaagcaatccactcacctccacctcccaaagtactgtgattacagacatgagcgactgcatctggcccagccatctccatctttatcctcctttataagaatcttaggcttatccaaacaagctaaaagagatgatacagttgtgcgtttatagttagacacatagatctgtctccaaaccacacttaagtcaaaccctttagttcatttcagtccctgctatacatccacatcaacaattagttaatttaaaagcatgaaaacagtttcagaatttagactgtgacctaatctaaccatattgcctaaggaccttgaacctcataacctccgtcattaacattctcaacaccattaaagatgtaattagaatatctcctttaatttggaaaactacatgaacttcttaattttaaccacctcccctttatctgcatgagctcaaattatttgctggcaaaatgtatttaatttttttttctgtcaagcccttatgaatttaattgattaagctctgtcactgccacaactgatataggcatatattggatatttgagaggctcacctattagtttaatagttcagtgataagtatatgtgtatacatagaattgaaggaagatagtttgaaattatgtatgggaatcagcatttgctctatggaaggaaataagttactgaattgtaatctaactaaatatatcacaaaaaatttgcttagcttttgctttctcagagtttctcacagttttctttatactcctctttaaaaaagtaattgtaagaaaatactttggttttgtttaatttgagaattatttaagttagaatacttgatacctgaagctcagagtctctcttgccagcctgttaacaactttctttggtcttaaggtgccttaaaagaaacacagaatgttgtagaacaaggagaattataaatccacattggtgaaaccaacctgcattagtgctgtgtgtgtttagggcatacttgaagaaaaatacagataaatggaagcatattccaaacagagccaacaagaaggagaagggatttttaaaacttcacaaagaggtatagttgaaggaactcaagatgtttaacccaaagaaaagaaattgcagaggtaatagagcagctgtttccaaataactggagattctggctgagtatggtggctcatgcctgtaatcccaacactttgggaggctgaggtgggagggtcacttgaggacaggagttaaagaccagcctgagcaacatggcaaaaccccttctcttaaaaaaaaaaaattaaccaagtacagtgggacatgcctgtggtcctagctactgggaaggtcgaggcaggaggattgcttgagcctcaacacacaagacttcagagaggtatgatcagccactgcactccaggctgggcaagagtgagactctaaaaataatactaataatactaatactactactactactactactaataataataataataattggagagtcttgtggtggaaaagcaatttagacctgttatttgagattccaaggaacagaccagggccaatccgtcagtcacatagagttacatggactgcatgtaacttcatgggagtcctccaccaggacttccagacaaggaggtaaatgtgggctgaaattttgccatgctcctatggccaagcactgtggcttggattaggctgtggtatgcagagtttcttttaaaaaaattgatctgtttagaagagatgcctttttgtaatgtgcccaaaagcactgtgtgtgttatgtagactctgatttcatgttcacagaattaaaacatttctaattagtcatttcttttcatgagataaaatcagcttcctcaaaaactagtggccttttgggtctctaagccccaagaaattggatgacgacttaatagaaatttcattctaatcatgatacacacaggcctattaaccagagggagtctgggagtggcccagacctgagcctcaattctggcactggcagtggttgttcaaagagtggacctagctgcaatggaaggaaatgaattcaggagactgccatattgcattcagtgagtgttatgattggcaaccggtgactctgcagttgcagctggcatcaagaaccaggcaaaggtgacagtcaggtagagcacaatcatgggaaagagagcaaccagtaagctctatgaacagagctaaatggatggcagtctacatggtagctgagctcccataacgagatggtgttctgaggagatctgcggaaggtgaggcagcccccacttcctaaggaaggtaatgaaaatagggattcaagtacaagaaacaaggttgagggactggggataaagtggggatggttaatgggtacaaaaatatagagatagaatgaataaggtctagtatttcacagcacaacagaacaataatttactgtaaacttaaagataactattataaaagagtgggactgtaatgttcctaacacaaagaaatgataaatgcttgagataatggatacccaattaccctgatttgattattacacattgtatgcctgtatcaaaacatcacctgtaccccacaaatatatacacatattatatgtgcccataataatttttaaaaattaaaaagaaagaaacaatgtcaagagccactttctggtcaagacttagtctctgataagagaaaaacacccaataagaattagtgcttacctatagtgcaggatttgtgatgaggctgtctccccagttgtcaaaccggaattccttctatcccggacatgtggggatctgagcttggggccgatggacactacaggcgagggtcattgacttacttgagagcaggaaaccaggcgatttggaaaatgaaaatattaggttagcatttagacaaaatggtcctttaggtatgttctaacccttacatattctgattctgtagtaatagatggacttttttgaactttagtttttccattttctcatttactttggttaaatacatgagtgtcttttcccctgtaggcttcctcgctcatctttgacaagcatcgcctttgtaaagacagaacattttgacacagcctttttgatattcagtcacgtcaagatgtaaaaatgtttttacattgaaaaggatgaaacttttgctttgttaaagaagtactttttaatgacaaaaaaaaatgggggtggtgttttcgagtaatgtgcctaagggatgttttcactcctatgccttccttcaggatattccccacagggggagcgaggcccagtgtcgggtcaaagctggacatggggtgcaccacaacttcagggcagcccacaaagccagggtgcgatgagggtcaaagagaatttggataatttttgtgcaaagaacttggtatttaaagaagttaaaaatataatggtttgctctttaaggcatatcaaaatattcccttgccaaaattgctgcattgaaaagtccacaccactaaaatggccctgtcaaaatttcacctgcacatgctcatactgtaaagtacagctatttctgaagtgctggtgttttgattattattctgtttgactattatttaaaaatgttaaaatttagaatcatggtataattattacattgtataatcagatacctggatttttgtcatgactgcaatgacatcaggataaataaccctgctccttggctccttggctccttgggtgatgtatttgtcttttgtcttttgggttttttgttttgttttgttttgttttggagacaagctctctctctgtcacctaggctggagtgcagtggcatgatctgcagctcactgcagcctcaacctcccaggctcagatgatcttcccacctcagcctcttgagtagctgaggctaatttttgtatttttttgtagacatggggtttcgccatgttgtccaggctgctctcggactcctgggatcaaatgatcggcctgcctcagcctctgaaagtgctggaattacaagtgtgagccactgcacccagccgggtggcatattttatgtctcttccatactgatgtgccctataatcttggctaaaaaaaatacaataaattcggcatctttattaaatagcatccaaatacttaaagccactcattttttaaactgttttattataatctgattgttctaaaaaattacttatttgaatgcctatattatttatttgaatgcccctatacctaacatgtaaccaggtagaaattttaattatacagtgtactaataatccagtaatgcagatttcttatgtatgtcatcatgataactataatttatactatatatgtggtacataggcttttaaaagtcaaatattcactagaagaggatgatggttatttctctgctgcttcagttttcttgtgttaaatttttcctttcatgttttaaccatttgggactaaaatcttgaaaagaataggttttttagcttccaggtagataccctgagaatacacacacataggtccaggattggagtgactgatgcttttcatacagtaatagtccctgttgagcatcctctatgccccagtcctgcgtactctgcccactgcctcaatattatcaccacgagcttttgagaaaagaacaagcatcctcattttatagaagactgaaccaaaagaggtcttcttcattaaattattttttttagtttggaagaagagatcatttaaatatatatcactgttatggtttgacttttaattttttggttcaccatgtgacatattctgattttgattctgcaaaacctagtaggaaattctgggaaacaaatgaagtagattgctagtttttcccttctcttgttattttctactctttgtaatgcatttacatattaatgtagtaaatgctgtgatgatatggctgccaactctttcatcatttaatctgttaaataaacaaacgtgctttggaatcaatcactaaagaaatagctactcactaaagttagagatttattttactttgagtataataactcgcttgtagttgtaacaagcaaacttaaaccaaaatattctaaattatacttgtcatattaatccaaaaagaacaatatttaacctaaatgtaaactaaaagccaacatgttgatccactaattacagaataataaaagccagactaaaatcaaagaaactgccccaggttccttgtaatgtactctgactctgtacataaagttacctctcccaccttctcccacccctctgagtattagtccaaggatacatctctccatctatcaaaatctgagattgagcaggcattcatctgtaacctcatattttttcctcagacagatcgttgaaaagataaatgttctaactgggagaaatggagaaaattttgctctttcctccctcttccaggataggaggcttccctaaagaacaagaaacaaaaacaaagaaagaaagagcagcaaaacaaataaacaaacctaggtgtccaggaaattatgcatgtttcttgacagagtttcttcagtctttgaaatggacagatggatgaatagatggaagagaaaatgattttatgtaatagctttatccaaacatgttcacatgtacctctctcccttccctttacttcctaaagaagtgcttttagcatgtgtctgagtcatgacctaatgtaatatgtgttgttattaacctgctgacatttttaaattctaattttaagttaaatcaatcatagtgatctctgttataatgtcacttttgctaatttgccttccagtatatttgtcataagagcataaggaggtctactctgtagaaaatggaccaacaagggtgtgttgcacatgaggacgtggtttgtcttgtgagtctcagcaaaaaacaaaatgttaggacctactgctctgaaatagcaatcatggctggtacttgctgaataatttctaaatgccagaaattgtttcaagatctttacatggattatttcatttaaacctctcaaaagctctgttaggcaggtatcgttattcctattttataccctaatgtgcttaagtaattcagccaaggtcacacaactggtaattcttagagccaggatttgaacccagaccatccagcacaggcctacactttgctgatttacaacgaggaaaaattttcatttcgcgaattgtacaaaaatagggggatctacattcaaagcaacttcattattcaatgaagagtattgttcaatactctcccatctctggagagtattcaaattatgaatactgtcaaccaaaaaaccttgaaattgatgtccgtattttacattaaattatttttatagagaattcattcatacagatattggagaacctaaacaatccctgtgaactttccagatagctcttctactaaaaatcagaaagctatgcatgatttttctgctctaaaagtgtccagaaatgagagtgctcacatttttgtagcggcccactaaagcattttatacacttagagaatctcctttcttttaaatctaagccttcctaggattaatatatcttgcattttcttttcaatcaatgagattttgttttcattctctataaatactttatattcagataatttttctaatcacctcttctctctgttattaatattgctgaagctaaaataaaatgtaccaattgaatatgatatttgagtttaatgtttttatttgtatttacttattggaatgagacatgctcttcaccttgggtaatttaaaaaccattattatagtttaaggttctgtgttacatctgtcgccaatatggtgtgcccttcctgaagtatactatcaattttgtaaaacaacctcaaatcccagtaagtaaagcagttctgcaggtacttgtacaatctgggtgagattttatttgaccccatcaaaaatctttctctaatacaatcctccaaccttttatggacaggaaaagaacagaaatgcttacatgatatttctgcttccagatatcagatgtgatttattactgagtaaggcaactggcacaatggctttaactggcttagaagagcctaactgtactttctccttaatcatgttagtggcaatcttagtatttaattacatttccagagcatctcaataggagtagtgtttttcgtacattaaaaataatctagaaaaaactgttttcttgtttcccagacaaatgagatgagctagtttctcagaccagaaacattctaagataataatttaatatatatgcttatattttaaaattcttctcttatgtgcatataaacgtatatcttttgcaaaactttaatgacagtcagcaagtatgttgataattacgagttgagaaaaggctgtataaaccattacactcagtgatatataaactctggaatgtatttttgattaaagctcctcactttacttagatataagtaaagatttatatctttacttgtattttatttatatttatatttctaaaatccagctgatattatatttaatgttttaattatgatatcctttaagcattaaaaaccatagtttttaagctaaatgagaatgcccttctcaaacctgaaaggacaaatatttttgtcctttgccatattgagagtaggaaaataaaggaatatcagggttttagttttctggaaaatacattatgaataattttacctaattagataagctagacatggttatgtataatttcttagaaaaattttacaaagtgaattcattcatctacctagaagagataaatatgcactaaatttcttagatcagataaggtaacaaagttgtagaaatggggataaatagagtttgggacctggatggtctatctacataaatatttattgcaaatggtttaacaatcatacaatgagattttgcaggaaaatttattttcactttaatcactgaaataactaagaccaaaacagaaaaacctattattcctcaaatccaatgggaagaattaatgagaagaaaaagagccaaaaggccttttgtcaaataaataatgataccataaataataataataacagctacattttactgagtgcctgccataaacctggcactgtgcttggtacctaacattgtcctcattcctcacagcacacaagaaactgagtgtcacactctacttgaagggcagaacaagatttcggtccctagcccatgtgcttcattgagttacacacttctctgaaatacttgtatttaaaagtaagcacaaaagcgtaaaatgattacatctgtacaaaatggaaaaacacatttctcaaaaacatatagcagggtttatattgtagccaattattattttctttaaataacattgtacacattttttccaataatgttaccgttaatgaaaatactttggggatgtggttctggaattgcctgaaaatcctacagcatattccctttgattgtctaaactggtggactatatttgtctggggagattgatttcatttttaaaagcagcctgaaggcatttaaaaccttgttttatgcataaagtgatgattaaagtagttaatacaatattgctcaaaactcttttacagaaagtccattatgacaacctcatcacagtgaactcagccacagccacacaatcccttggctttgttttatgcagaatctctcagatgcatcattattcctctatagcgatcaatttaattgagcattttatccaataatatgaattctccaagaatgtcatttgtatcacaggaataaatcaacattcatttcacttagattttcacaagtaaacttttctccatgttggagtttccagtgcagactctaattgtttatttccaggttttattggaaacaacatatttcatcaccagttaccagttttctcagatacacattattttgtcgaaagaacacaacaaatgtcaagttgtcactgtttgttaatcagtcataatgtgtgaaacatcttggcagaaacttctttcattcttgctttgttttaaatgaaaatgttttgttatgtaattttaattactcaatcatcatcttcccagtaaatctattttttagtagcccaaatctatgtccatttcactatttctattggtcccttgggttcttcatgtatttttatttgaatttttgcatcagaaatattaattgaaataaatttaacatataatgaataatattatcatcactaatgtacctgctatcaataaacaaatattaattttttgttatgattattttagtgttttgaaaaatatttcaggtaaaatttcatgtgctatcttcccttcctcagtttacatttctatatttttattactgtttacatggtaacccatatatataatgtatagagttgtttgtgttacttttcttttttatagaaattatgtcacatgatataatattttctgtaattgctttttcacttaacctagtcaattggctttttggtatcttaggggagatgtctttttaatacagaaaacaacatttatagttagttatttgtctctaaattattatcctgtttaaaagagttttaattataaagcctagtttttcataagattttagagtaaatttacaaatttaaaaccagtaatttcgtggataaattaatatatcagctttaattattcttgaattaatattccattggtttatgcatttaatagggttaaaattccctatatatttgaaaatatctaaagaaaaattaagcaagctctcttaaacatttttaatgaaaaccacaaattggatatatctgtttctagcacttcaaacacccaggaagcagactctcaaatactcataaaaacaataaaatcttcctaagcactcaaacactgcttgtaaacaataagcctaagtggatagttctaataaatcagattgccttgagcatctaaatattgatttaaaattaaggtaaatctttttaagtatttcaattaaaatctcatcttttatgtcagattcctttaaatgcctctctttaaaaagcagatagcacaagttaaaattaacaaaaaagatataaatcattattacacttggatttcatacaaaagtattatactaagcatttgtttcatgtctttttccatctccatcatgtgtcatactatcaagagttaaaattgtttatcacagaagcaaaataaccatctcaaactggctgtttagttagagatcaagtttacagagtacagaattaggaccttggtatgtttgcagatttggattatggcgagagatttgagactaaaacacaggaacctgagtgtactttcttacatggcagagccagtgatcactgggatgggaccttcctcacactaccatctgctgcggtgtcaagtagtcttttgcagagaaatggtttttcatggtctgtcccgtatgcatcccttaattatcactctcacccatttttttttaattttgttttactttaatttctgggatacatgtacagaatgtgcaggtttgttacataggtatacatgtgccatggtgttttgctgcacctatcaacctgtcatctaggttttaagccccgcatgcattaggcatttgtcctaatgctatccctctccttgccccgacccccccgacaggccctggtgtgtgttgttcccttccctgtgtccatgtgttctcattgttcaactcccacttatgaaggagaacatgtagtatttggttttctgttcctgtgttagtttgctgaggataatagcttccagcttcatccatgtccctgcaaaggacaagatctcactctattttatggctgcatagtatctcatggtgtatatgtaccacatttttttttatccagtctatcattgatgggcatttgggttggttccatgtctttgctattgtaaatagtgctgcaataaacatacatgtgcatgtatctttatagtagaatgttttataatcctttgggtatatacccagtaatgggattgctgggtcaaatgttatttctggttctagatccttgaagaattgccacactgtcttccacaatagttgaactaatttacactcccaccaacagtgtaaaagcgttcctatttctccacatcctctccagcatctgttgtttcctgactttttaatgattgccattctaactggaatgagatggtatcttgttgttttgatttgcatttctctaacggccagtgatgatgagcttttgttcatatgttcattggccgcagatctcatacagaactttttaccacagactccttgaatttttaccttctgactttttctgatggaactgaggcaaataaaatacaatacagttaagtttcagttaagtatcttctgtagacgttattaaaaatccataggccgggtacagtggctcatgcctgtgatcccagcactttgggaggccgaggcaggtggatgacttgaggtcgggagttccagaccagcctgacctacatggtgaaaccccgtctctactaaatacaaaaaattagcggggcatggtggcatatgcctgtaatcccagctacttgggaggctgaggcaggagaatcgcctgaacctgggaggcagaggttgcagtgagccgagattgcgccactgcactccagcctgggcaacaagagtgaaactccatctcaaaaagaaaaagaaaaagaaaatccatagatgcctttgctttcatatatcttctatcattgtcccagcttgtgtaacattatgaactcacgacctttgacaggattatcattttcttttttggtactctgattgtcacaaccccaggaggctttttttccccccttacagaaccattcccagacatctttgaaagcattctcacttcctggtaacaattacatagttcaaatacaactttgttttctctaccccatgacagggaatcaattactcttcaaggagtcctggctgggtacttttatggaatatagagaccaaaatctgggcattaggggtgcaggtcaaattgttactcatgagaaagaaatggtgacattttcccagcctacttaatgactgagctgggagagatattttttcaagttcatgtgaacttcatgaagttcattttacctttaaattagattttattaaggcttgttaaaaacttttttgttctaatataaaatgtcttttctcatttgtttccctttcagactatcgttctttcaccattctgaatatgccattttattagttgctatattaaattatgtgattaaattatgagaatgtctaacctttgtataattagatgtgatttgctaagatcgtgtatccctctcagctgccgctgagtctttttctttatataaatcataatgttatagtcatattttggataagcattatgttttcaagaaacattatatttctttctatgttatatataatttttgactataagagacaatgctgtaaacaaatatccttatgtatgtctctatcactatctgccagtttctctggggtctaaatccagaagtataatttttaggttataggttctgctcacttttaattttactagatattgacaaatcacctttcaaactgggctgacaatttgcactccctccaagagtggtgagagatatgagatttccaatttctccttattcttaccaatacttgatactgtcaaatgttttaattttttgccacttctgataagaaatcactcctcttcattgttttacttttcactcccttcattacaaatgagattgagcatcttttcatgtttttatttcctgtgtagaatttctgtttaatgaatttcttgtccatatccttgcccatttctgtttttgtgtctttttcttttcctaaatgatgtttcatattctaaatatttaccatgtatgttaatatacatcttctcttagacactttacttctaccattgtggtaccttttattgtagagacgtatgtgtctacatagacaatttaacagtttgtttaatcgtcttgtgttttgtgtcttatgatacaaaaaatactttcttgccctaatgtaatgaggttatgctcctaaattttcgagatgtctcaagttcttttttcacattcaggtctttaaatcatttggaggggtttttttgtgtgtgattttttttaaagtctaatttattttgtattcctttccagtggccactgttccaatatcatgtttagtccattttcctattttctttgctggtttttaataccaagatcaatatatgctcgagtagcctcctaagctgaatattcttttgcacagatctgcttttcttctatccctgtagccaccaatattcttgattactacttatttataacatctggtagaacaactctctacttcctgatttctttttcttaattgttatgtctaatcttggatctttactctccatatgataatcaaatcactttttcagtctgccctttccccagggaaaactgtttatggtttgtttggaaaatgacagaatttatagaaaaattcgaaagaacttatctccaaaaaatattgtgtcttcatcttttcaagggacaaaataatataactaggtggcttataaacaacagaaatttatttctcacagttttaaactctgggaagttcaagatcaaggtgacagcagattcagtgtctggcaaacgcctgctttctggctcatagatgaaaccatctagctatgtcctcacatggtggaaggggcgaggggtctccttatgcctgttttataagagcactagtcccattcatgaggcttgacctccatgacataattacctcctaaaggcccaacctccaaatatcattaccttgagacttcaggttttgacatacgaatttgaaggggacacaattattcagaccatagcacttgctatccatgcacttgtgtggccaaattccggtcttctgtgagtaacaatgaaggttacagacatatgtgtgtatctgttatatttatgcctgagaatcttaacccttttgttgcccctgtgaatagtgtcttattattctatttcattttctactttgctattgtggctgcagagtaacactactgatttttatgttttggtcttatatcctggcaaccttgctgaattacctaattagctttactaggttttatattatcttggatattatatataaataatgtcaacttttttctctaccgtgctaaaactcagtttcttgtcttattgcttttactagaatgtccagtacagcgttaagtggtaggattgatagcccttaaggccaaataccaagagcaaaaacatgaacagttggattgatccaagattgatggagcagagaggattaaagatgtcgacaagattctgtatacaactggacagtgctgatatgatgatggtaattatgatgatagccaacttttaatgagtgattgtcactacattacagaaacagggctaaatattttatatttgtattgtacttaaaccttaggaaagccatagaggaaggaaactcttattatcactatcttagggataagaaaatcagtcctagcaaagtttagtggcttgctcatggccacacagctatcagttgatgaacacagagcactaatccaagctgcaggttcaatcccttagaatcctcaatggtagaccatcaactagttctttagctctatgaagaacagaattagaggtaatggatttcaatttggccataaatggttttaagcccattttcacttcttcttcaagtatgtctctgattattttctctggagttttttaaaacagatagaaacccatgttttttagatttcacttaataaacaattattgcacaccaatcatgtgacaagcatgataagatagtcaaagatattatctatcaacatttcttcaaagagatttcagtgtactaaagcagatgaatgaggatgtgaccaactataatttcaagcagaattttaaaagtgttacaagtaaaagtacaagcaaaatgctaccttggataaaagtcagggaatagattatattacttttttattttattttattttatttttgagactgtctcactctgttgcccaggctggagtgcagtggcatgatctcggctcactgcagtctccacctcctgggttcaagtgattttcctgcctcagcctcccaggtagctgggattgcagatgcatgccaccacgcttaactaatttttgtattttcagtagagatggggtttcgccatgttggctagcttatctcaaactcctgacatcaggtgatctgcccgcctcgacctcccaaagtgctgggattacaagcgtgagccaccacacccggctgtatgtagattaccttttgagactgttttcagtggtgattctgcaattcagtcattatttttaggatttttgattgtttattcactgattaaaaaaataaaaggatggaaatgagtaaatttatctggacacttgcccatgcacttgattttttaaatgaacagaataaagaaagcaaaaagacagtatactttcccattaagtaataattttgtaaaatatgtgatgccacttcaaaggccaaaatatcccaatttaaattttaaaagacctgtgctatcacagatatatttaatctctgaattttagtcctgctgtacaaagagagcatcatgttaaaagtagatgtgggtggttctaagattcatttgcataattgttagtaatgcagagcagggtacgggcatcaactaggaaatactctttataaaaggcctgaacttgcacaagcaaatcttggggaaacttcctctgaatacataagataccataaaaataaaaataaaaatgtccctaaatgcagtggaatgagtgagagaatccatcagcaggtgatgtgttcagggaaagtccaagacatgatattgtataaagttaagagaatcagatttaaatgctcaaaattttggtccttttactttgcttttctttaacttttgggtattcatttttctaaaaatcaacattttaaaattcacttttgagggtttgggagtcattatgtacatggatggacatattgcttttattttcttccctttgatcagcacacatcatatacattctaggaacggtttaactcatgtctctgcattctgctgggttggtgctgattatgaggtgattttccaaagaatacatggaagtttgacaagagtgtacgcgtgcatcatcataagagctttatggtctttaattttggaagcaactttttttcatgtgggaaaaatagatcaatatcccattttatcttcaacttgatttagataattttaatgtgactaacaagttatgactcacgcatgtgttggtctgtaattaatcacaggcctaagatccatcagaagcccactcttctgtgagatttccaatagttgtgaaccttatgttcaccaatcttcttgctttattcttaagaggtgtcaagtaatcattgtctgatgagagcaactgaaaataagaacagtacccatgctctgcactctcaaaatgtttaacaacgtgattttccctcttacactgtttctatctatttatttataataacattactttgtagagtagtagttgatgcctcctgttctcaaaagaacaatgttgttgttgttgttgttgttgttgttttctgggtgtgctgtctttgtaaaacaaagtgagaaattataacatgaaaaatcctgataagactactttttctgctgagctcatgctctattaaaaaaaatccctgaaacatccattgttggatttttatagattcctcttggaaattcagagccaaaaacttttaaaaggtttaagaaaagaaataaaaagaagaggaagtccaacatgaagcaaatacacttgggatggagctgactcaggaagacaggagtcaaaaaaatagagcatttgcaaggaacagtgagagataacatcagaaagacagcattgtatatacacaggagccaggggtgcagaagaactgaacagaaaagttcccattgctacctgccggaaaatcttatgctgaagctcattacacagcagccaatgagtaagaataagaggagaccaggcggccacctgggctgccacaaaatataaggaaatagagagaacaaagaatacaaaaagtaggaacctaaaataaggcagattaagaagagtgaggtggtacttcaaatgccaaagaagtacaagtaccattgaataagtacaagttgctgctgaaaggatgtcattaatacaattaaatgcaactctatatgacatagtgatcattatggttattgcttgtaagaatcaatattcttaaggacatatatgatagtcttctttagtttctcagaatttatatgatgagattaatctctgccacatcaagtagatcttcaaagatataactcaatttaaaaacctgatacatatcaaacaactgaggtttgaattatttgaccaaaaaattttacatcatgattagaatgatgttcttgcctgaagatactcccttgtcaatctaggatataacccagagcctacaaatcctggtaaaaactacttttcacagctcatgctatattaaaaatccctgaagcattcattgttggtttttatagactcttgaaaattcagagccaaaaccttttaaagggtttaggaaaagaaatataaagaaaaaagaaggaaaagtccaatatgaagcaaatacacttgggaaagaaagaagtcatcataatagagcattcacaagcaacagtgagagatgagagatagcatcagaaagagtattgtgtatgcatagagggtccgtcctcagagatacatcctcactttccttttgatgtgttcaagtgaatctctgaaaccatgtatagtgttgagtctatagcaatagaaatcattataaaaattcaaagaataaaatactttttttttttttgagacagagtcttgctttgtcagtcaggctggagagcggtgagacaatcttggctcactgcaacttcagcctcctgggcttaatcaatcctcttacctcagcctcctgagtagctgggaccacagatgcacaccaccatttttgcctaattttttgtattttaggtagagacagggtttcaccatgtttcccaggctggtcctgaactcctgagctcaagcgattcatccaccttggcctcccaaattgctgggattacaggcgtgagccaccttgcctggcaagataatttaaatttttaaaatgtaggtcatggctaactaatcataataattattatactccactcttcctacacacaagtcacttctctcagcctcagttaccctatctttaaaatgaaatattaataatggcaaattcataggatagttatgaagattaatatgagacaataagcataaagtatcagaacaactagacaatttgctaaataagaaatgattcaacaaaaattagcttgtattatttttaatttgtcagcttcataagtgcagggacgatttcaattttgactacctttatatatacagccagcttcatacatcagtgcattagtaaataacagaaacttattatttcttgactaaataaattatgacatggtaagaaattgttcctgccctcaggatgaacacaatcaactgaaaaagataaaaaattcgacatttacaaaagaatgtactttggtaggctgaagcaggaggatcacttgagcccaggattccaagtccagcttaggcaacatagtgagacactctctctaaaaagaattttaaatttttaaaaagaatgtactaaatattataaaatgggaaatttgaagcactatgagaaggacttacctttctaacaatatgaaggaatatgtactctgaaaatcctttttataacatcacttacaaaaatacatagttgagctgacaaaaaaataagagagccccttaaaggcctgaattaaagagcgattttgaattcagagagaaaatagttgacatctgccatgtgcttctgccattgcctagtggctgagagcttagatcacacatgcacaagggaaaggaagcagagccttctagctggtaagagggtcccaagtaaagcaaaaactgcttaagggcaattgctgcaaaaaaataataaaattgggtgagggaaccacctcagaaagggagagactaaaaaaattaatctatttcaaccttggatctcactggagggaggaaaaacatctcctagctcttatatgagtgtcaacttgagttcacattatctgtgtgttcccccaaacctaagttcacacctcacataagcaaaagaaaatcatatctgggagaataacctttaccccaagactccaagaattctaacaaatgaatacccaaagagcatgagctagcatgagtgagggtcagcaaaagaaacaaatgacagactcagaccatcaaagattgcagatagtgtgtcaggcagtttcagaatgtaaaatagacaagtaaaatcttcaatgaataaaagagcattccataaatatgagtggggagcaagggaacattagagatacacaggcatcatacctgaaagaagaatgaatataactcatggaaattattatgtgtatgtatgtgtgtgtgcctgtttagtaaacattagcatcttagacacaactgaagagagaactagtaaagtaaaatatagacatgaagaaattacccagaatgcaatataaaggggaaaaggatgaaaaatatgaaagagaagttaaaaggtacatttaatcagaattccagaaagaatacagaattataaagaaaaggaaatattttagaatatgattattaagaaatttccagaattgaagagaaacagcagttatccagttcaagcagccaaatttattccaaagtggagtaataaaaagaaatccatacacactatagacaaactgtagaacacagaatagtctcattagaagccagagaaaataagcagacaacataagaaagaatgacaattagactgacaattcttagcaataacggaatatagaagactgaaataattattttaaagttctgagagaaaaattactgacaggtgtaattgtatgtctttcaagcacaaaagcaaaacaactttgtttttggtcattccaaaaaataaatattaaaaactggaactaaataatttattacccagaaaccctcacatgtgtattttcctaaaaggtctacttcaataaaaaggcaaattgccccagaaaggatgtcttatctaaagacaaaaaagaatgatgagtattattatgtaattatgagcaaatagatggaaaaagctaattgttacagtgttaaaaactactgtaaaacaattgcaaataaattttaagaggattatcagaataaaaatgttctaagaaagaaggaaaattttcttaaaggaagatgtattagtccatttttatgctgcagataaagacatacctgagactagaaagaaaaagatgtttagtggacttacagttccacatggctgggaaggcctcacaatcatggtgaatggcaaggagaagcaagtcacatcttacttggatggcagcaggcaaagagagaacttgtgcagggaaactcaccattttgaaaaccatcaggtctcatgagacttattcaccatcacaagaacagcacaggaaagacccacccccataattcaatcacctcccaccatgacacgtgggaattgtgggagttacaattcaagatgagatttgggtgaggacacagccaaaccatatcagaagatctgagatacaagaaagtatgatgaatagataaatctaaacaaatgttgactacaaataattgaaaataatatttaatttgcacattaaataatacaattaaaaagcaagacaacagcatatcagttgttgatagtggtggtgattaaagttgtgttcagaggtccttgtattattccaaaagtgggtaaatatactgattaaatttaaactttattgagttatgtatgcatattaggaattagagtaagcactaaaattatagagtccaagactgcaattccaaaactagcagacagaaaaactaagaagaggaaaaaaaacctaattagcttgaaaagacgaaaaggagaaaatttttaaaagcacaaatatactgttaaccaagtgagtgaaaattggctaaatacttgaattaaaagacaaagaatgacagataatacattttaactaacaatattatgtttataagcagcccacttaaaaatataacacattaatattaaaaataaaattgtgagaaaaataactaccaagaaaacaaaccaaagggagctgatatagctttaaaatcagatgaaataaagtttaagaccatgaaaaacattgtcagagataaagacggttaatacataaagtaaaacgttaaaatttggcagaactacaagaagaaactagcagatcccgtctgctaagaagtagaaggtaagttaatgcatcctaggcagtacaaggaaggtttttcggaaatgatgaaacctgtattgggactcaaagatgcggaagttggcaaaataaatagggtagaattgataaaggaaacaagtttacaaaagcagagaacatagcatttttgagaaactgcaagtactttaatatgacgctgtgcacagagggcctgtaataatgaggagtaaatgaagaactagcatactagttttatgcactgttagactttatcttgaaaaatgcagaaaatcactgaagaaccttaagcggacaagagtcatagtcaaattttactttgagaccagtaattctggtggtgctgagcataatggcttagaagggatccagactgcatttgcgatgaaccatacatgtttctggtctcagaattgggggaccataaagtagtgacaacgactgtaaaaccaaatgtcagtccacatgacctgggccttactgctctttgtaatgcccagataataaatttccagttccactaagtgttagtgaatacccatcacttggccaaatataggggtgtcttacttttctgccatgttgcattcctgagtagtccttcattcacattttttaattcatttaatatttattgtgcaaactactacttccaagcatacttttataggcactggggatacagcagtgcgcagaagaaaaaattccctatcttcatggagcccacagtctgtatgtacatctatgtgtctgtgtctctgtgtgtttgtatatgtataggaagatacagacaataaacattccacataagtaagttatataggacattaaagattagtaaatactatggaaaaataaaagagagtaagggagatggacagtgcctgagcaaagaaaagattacaatttttaggtgtcatgagggaaccttgctaaggaaatatctgaactaggacttgaatgcagtaaggaaaaaaccatgcaaatatcgaatgaacagtattccaggcagcagcaacaataaagttaaagaccctggagtgtgattgtgcttggtgtgttgaagaacatcaaggaagtcactgtggctggaacagaatgaggcagaggggaagcagattagataggaccttggagcctcggaagccactgggaagctttgatcagagagctactcaacagcatataactgatgcatttatagtgtgtattaggaatagcctgaaatgtattcaagtaaagacttacattctcccttcaccttccaccctcctttcttgccatctctgattattgaaggtataaaatgaagcagtaccaccaaggccatggtaagagaaacaaactcaccttgactcagcatctactatgtgccaagcgccatgctagaaactatagttttatctcaattcagcagcaaaatcagtctatcaggtttcagtggcacaaagaagagaacacagaaatattttagtcaattaccaaatggtaagctacaattttttaaataagtcccccctgcataaagaaaagataaatttttaagttgatggatttctgaattactctgatttgatcattagacattatatgaatatatcaaaatattgcatgtacctagaaaacatgtacatccactatgtatcaataataaatttttaaaagcccccaagccttcttggacatttgctaagggcagtgtggctgtttgcagccctatatgcagaaacctccatgaatatgtagggtacaaggcagagagaactgaattcagtcagagctgaatggtgcttggaaggtgcccagcctcccaagaagatgtctatttaccctcagcgagcagtcacagtgccctctgcccaggagggcaggattagctttgaagcagggttgtttgtttctctttttagaaaagctctgttgaaacataattgatatatttaaaattgcatatatttaatatatacattttgatgggtttggacatatgtacatatttgtgataccatcaccataatcagcatactaagcatattcatcacctgtcaaaattaccttgtgttcttttgtggttttgttttgctttgtgataagagcaagtaacatgagctctatcctcttaacatactttaaagggtacgatgccatattgttaactataggtactatattgtacagcagatctctagaacttactcatctggtatgactgaaactgtatatagggtttttcatttctgtggcaactctatacatgaaagagctgtttgtgggggaagttattaggttgcattaaaacaagtcattgagaatagcagtggggttgtggtgtgtggcagtggctgctgctatgggaggttgtgtgcctagtggtcatgaattgtgccaccactggcaccatttgagaatggatggaatagtaggacacaccaggatcaaaaccatcttgccgaggttcttattcttgatcgaaatagatttgtatttcataaattatcagataaaaacctttgtgtcttaactaaaagtaaagtggaggtcccagtgacaagctttgcaaaagccccacatcacataagcatatcatatcagaagacagtagaaagaattgtgaacatcaagattgacaccaaacatctggcccttgtaaagagaacatgtagccctcccaagggagttccagtaattggaatggaatgaactctatccaagtatctgcaaaactcctaaatcagattaacaaattattgtccactgttgtggaagaattttgggaaatgggaaaggtgctggaagactagagacagacaaattttattgttgattctactatgttaggcaatttcaagagccaacaagcttcatattgatcaaaagcaatattccagaatggatttaataggtgggtatatgagtactttgaaaagcaagtgtccttgggatcctgtctgtgctcaccaataacaaatcacattactcttactttaattccttgtttgacagatttactatgtccataatgctagtattgcacagttaaattcagatttcagtaaagtagttgacaaaatctaacatgaaagtcttcagaaaatgttcatttattcaattctacacttgagtatgtgtaaatggttggatgtgtaaatggttggatgaacatactcaaaaagtgtcaattcagatattctagagaattatcaatatatgaatgaagatatgtggataaaggatccttcatacccagatcacctatgattttaatactcttacctgattactatcactattaaccatggctaaaaagcctagaaaaaggtgacaaattaaagtgacttaaagaaaacaccatataactaaaattgcctgctccatatgccccccaaaatggttacataatctacagtcatgtaatgaatgcctcaaaaataatggagttgcataatttatgcaccgatgttagaattcagtgccacctaaggtgcaactctaccatcttgtttaatccttcctaaaataaagaaatatataaacatatactgattttagatgctgaattttaaaacaaaaatataatcgctattatcaggcaagactattctagaatcccctatcatccattctctatttacctcaaaaatctgatagtaatctaggcaggaaggcttgaatgtccacacatttggatataggctttcagaggctctcagatcttggattatagtaattattgctatgttaacaacactgtgaatactacactttatggtcaatttaaaggaaacttagggtcatttttactgtgtgtaatggtatgtctttctcattagatttagagcctaatccccatgtaagaggctactctcatttgcattagctatatatacaccatcacagaatgatggacaaagatttctctctcccctcaaaaaggaaaaccattaacatttactgggtgcttgctaaaagagcatcattttaggatctctaagtactttaattaaaacatagaaccttccttcaggaaggtaagaactcatctccatcagcagcatcactttatgcacaactgaaagttcctgttcttaggctcttactgctctaggttatcttagactgctctagtagatctaaaataggtcaagtttgatcagataatttgtagtgcctcaattggtcagagcccttgacatacataggtcttctctagttttgaggaggaacattgctaactcacatttgtgatgaaagttcacccagatccctctagcaaactatgccggtggcttcactacagatgtacctctctggcagattcggagatttcaagcaaatgtatcaaaccctaatgtgctatgacaggaggatttcctccaccaatcataagtagaaatgcctgggagctattattcaacaggaaacaaagctccttcatctgaaaagcaatttgcagaccgacactcctgctacagcaatttttatcatgagtttgtactttgaatggaacctaccttaaaaaaaaaaaaagacaatgtatcttatatcctggatgttccagattttgaaacagaacattcatagcagaaagtatcagttttcggaagctcttctgctctgaattaaaatatcagagttgggttttttttcctgtttaaacaagaaaaaagtatactgcccataacaaattatattgtttatcagtcatataagctcttaaagcagaaccatatgaatacagtccctgtaaagttatagtaggaaaaaatagacatatggacatcctgggggaagaggcggccatgttcattttccatttgcctaccccagaacattccatattgtgtaaaatttttccatgcatgtgcatctccaaaaatgaaaataaaaattataaaacagctttgtgagcatgctgccagcagaagagtagggtagagctggatgcataatcaacctttttgatgtaaggactgctggcaagcagtgtgggccagcagagcacatgggaagctgaggagcagccatagatacactggagacttctctgtcccaggctgcattgagatgtatgcatcaggctattgtggtttttttttaatactaattctagatatttttttctttgtaaaataaggctatcaaaaagaggagcgcagaatgtttctgccagtttgtaagtgtgtgacaatgggcaggaaacctggctgtcttcaacagaaagggagtaggaaccaccaggagaatggaagagatgcttttgcagggagcgtgagagaaaattttgacacacatcttccccagcctaatctgcaatgcaatgctttagggagagccaggcaccatgttaaaatctggttaaactaaatattgtactgttttctttccttggtaaacactgacttggtaagaaaaaatgatatcctttgtatatgaatttgttctcctggtaataataatgaatttagacctatttttccacaccatttttgctgcccaggcagatattatcaagccagctcactaagtttaagtgagtaatccacgaacattcatttatttaataaactttaattaagcatctactctatgccaggcacagtgcttggtacaatcacaatagaaatattgcctctactccaagctcctgcttattgaaactataccagggaggcttagctttcccaggttatcctgggaccctaaacccacagctcctagcagggattctcatcctttctgatgttctaatactatataattaggtatataattgggtgttgtgaaccaccctcactcctaaaagtatgattagagtttgtttgtcctatacattaaaatgaaaataatttggtgtagaactttatagtagacttcaggataactaaaaacgttctcaaacactgaaatctaaacaaccattctgcaagagcagcttttctgggcccttttaacatttatcatctctattgactcaaatgagtcaaagcaattattctgacacttgaaattttacctttaacgtttcctgggaaacatagcttatactcacctctacacttcttgtgggttcatttaaagaggaagtaatctggaaaagagccatgaataacagaattacccagtaccttgatgttttctcatttctctgccggcattcagcccaacagctgtcactgtacctctacaggaacttagttcttgtatggcaacttgagtggcattgagctctgatagaaggtcataacatctttgttagaaataatatgcaaatttttccaagaggttatgtctcaagtttctattctaaaagcaagaaaagtcacaaaacaaatttctttgtagatcaaatactaagaggtgaagaaaattaatttccctctggcttttgtcttggttgacaattcttctgggataaggttgattatttttatgattcctcatggagactgtcagctctgcctgattaactgaaaactagcataaaaagattgtataatgaacattattcatataaaattattccttttagaggctaaataagaaaatttgccttacatagagggaaatttggcactctatgttggttgtcttactttgattaccaaaaatcactttttgagtcctgtatgataactcccatattttagagtagcaattgatctcataggaagtaaataacatagccacacaactattatgtggtcagacaaggatttgagtgcagtaattattagctgggagtgtccatgagcacgtgtgcacacacacacacaagcctcagctccacacgttctgattcagtaggtttaaggtggagccccagtaatcccagactttgggaggccgagatgggcggatcacgaggtcaggagatcgagaccatcctggctaacacggtgaaaccccatctctactaaaaaaaaaaaaaaaaaaaaaaaaattagctgggcgtggtggcgggcgcctgtagtcccagctacttgggaggctgaggcaggagaatggcgtgaacccaggaggcggagcttgcagtgagcagagatcgcaccactgcacaccagcctgggtgacagagcgagactcggtctcaaaaaaaaaaaaaagaaaaaaaactccataggtgattcgtgtgctcctcccagttaggaaccactacccaatatgctacttcaactacagaagggctgtgaaatgacaagaatgctccccaaaacatctgattaacaattcaaaaacatgccatggagaacacgattttttaaaataggactttttgaaggaaaagaagaaagggtgcagttatatggattctttaagaaaaaacaaaaccaaggagaaccagggttaggaggaacgttaagtaacactttgaattagtcattaccgtgtacagtgtaatgaactcaatttctgagttgttgaaccactgaggaatatgtataatatatattcaacatatatattatttagagtcaacatatattatatatatatactatatatattcaacatatatataaaacttacccataataggcctaatgcatttatttaatgtttatgtatattaaaagtgttagtctttttaaagaatggaaaaaggactttagaggcttttctcttacatccaaagtaatataaattcaagggatttataaagtattacagatcagaaaggctttgtgtctattccagaaaatgaagttacttactagaaatttcagtgagatctttactagatggattggacaaattataagatagttggacactgtagaaggattttttttattttaaaacaatgtgcctaagtcacaaaacttaatagtctcaaaatagacaatggattgagttccaaaagtttatttcttagcaagtctattaaattataacaaagttatgtacaaattataataaagtacccaatgagcctttgtaaaggaggtcacaatgtagttgaaatgtcatatactttccttgaaaaatacttgaaaataatacttctatagttatttaacagtatttaaaccaagtctttaattgagtagccatagtagatataaaagcacgttggaaatggcagacaaaaagcaagttttaactttgcatgttgactgtaccttaaaagtaccctatgtggattatttacctagtaaattgtattaatgatcatctccattaaatgtttagaggaagattattgaagaaaaacaaaaagtaatatctacttgtaaaaaaaaaaaatacctacttgtagtgggtctcgaatttcaattaccaagaaactgaagagtttatgtaaaatgcagattccatgctgtaattgcggagattcagagtcagaaggtcagatattggaaattttatatttctaacaatacacagtaagaagcactaaaaactcgtccataactgtactgctttttgcttgtcccagtataaattttaataacacccactcccagtctcagtatacttatttggatgataaattatggtcaacagaggtttagagtatgcagaattctctgaagtcttccaagttggaaaaagtgccgctcctagaattggtaggactccctgccaccctgtagtcactggtacctttgctgtgtggtggtcacagagccatctctcaaaaactcatagaaaatgcaagtattgttgaaaccactccaaaagaggtctcctttggtgttctcttactagggaattctgagtcctggttttttgtttgtttgttggttggttggttggttggttggttttttgtttttttcttgtagtaaattcttatctaccatgttctcatattatagtcatcttaggaggtcattccgagcaacatgaaaagcaagaagaagagccccaacatagaaaacagaacgtatttgggtaacgatgggaagagcagagtactccaggcatagaaggagaaagaaggtaaaagtgcagattggaccactttggggcccaggataatgggggaaaaaattggaattacatggcttctgtgatggaaattattggaaaaaaaatttattaaaaaatgagggtctagcagggcaaggtggcttacgtctgtaatcccagcactttgggaggccgaggcgggtagatcacttgaggtcaggagtttgagaccagcctgccaatatggtgaaaccccacctctactaaaagtacaaaaaaattagccgggcatggtggcacacgcttgtaatcccagcttcttgggaggctgaagcaggaggatcgcttgaacctgggagacagctgttgcggggagccgagattgtaccaccgcattccagcatgggcaacagagtcagactccctctcaagaagacaagcaaaaaaatgagggtcactcagagatgaaacttttcttaactttttcttggttaactaagataacacatatgaaaatacttggtaaacaaacaaacgaacaaacaaaaatagaaccaagagaagaaatagcgaaagaaaaggcaaaaaggaggagagggagtacgcaagctgtggctccattaggacaggccctagaagtaaggaagggaggaccacagcctaaaatcatggctttgttggggatgggggccagtggaagggaaatatttctgaaactaattttaagagtaagtgaactccctagaaaatatttttgtcttataattgatactgtgcttcttctaaaaaatgaggtagtatctattctctctacacttcccaaatcctgtcagtcctgttcatactaccaaaacagaccaaggcaggaatggttttcttgaatattttgttcatcttccatgacagatgtagaacttcaagtactaaaagtttgctgtttaattaatattcaggcaaaatacattttctatctgttaatgaacaatggcacctgaggggaaaatgtctgtatacatgagggggaaacgtttgtgtaatgagattttttttttaattttactttaagttccaggatacatgtgcagaacattcaggtttgttacataggtatatgtgtgccatggtggtttgctgcatctatcaacccgtcagtgaggttttaagccctgcatgcattagctttttgtcctgatgctcttcctcccctcgccactccccacccccggctataggccccagagtgtgttgttcccctctctgtgtccctgtgttctcattgttcaactcccacttaggagtgagaacatgtggtgtttggttttctgttcctgtgttagtttgctgagaatgatggcttccagcttcatctatgtctctgcaaaggacatgatctcattcctttttatggctgcatagtattccatggtatatgtgtaccacatttttttgtccagtctataattgatgaacatttgggctggttccatgtcttagctattgtgaatagtgctgcaataaacgtaagtgtgcatgtatctttataatagaatgatttatatttctttgggtatatacccagtaatgggattgctgggtcaaatgttatttctggttctagatccttgaggaattgccacactgtattccataatggttgaactaatttatactcccaccaacagtgtaaaagggttcctatttctccacagcttctccagcatctgttgtttcttgatttttttaaataatcaccattctgactggtatgagatggtatctcatgtggttgtgatctgcatttctctaatgatcagtgatgttgagcttttcttcatatgtttgttggccgcataaatgccttcttttgagaactgtctgttcatgtcctttgcccagtttttgatagggttctttgtttttttcttgtgaatttgtttaagttccttataaattctgtatattagacctttgtcagatgggtagattgcaaaaattttttcccattatgtaggttgcccgcactctgatgatagtttcttttgctctgtagaagactgagacattattaaacagataatttcatggcctgatatttcatttacattttaacaaaaagattttctcctgatattccatgtttttctcaaaattcatttctaataaccatatactattccaacttgtacatgtaccaatatttcccagcaaccatcatcctttcttgttacatttgagattctttttctctcaaatattgctgtgcattggctttttccttctctcagatcgtttactaatgatagaattatgagagtgcgattatggggtcaaacaatatgagtagttttgaggtgcatgatacatatttccaaactacttgaaaatagatttatacacacattctgcactgtgtaaaatttttatctcaaatttaattattttgataataaaatatatttttcttaatttactttggtttacttattaggtcaaacatatttacccatattttctctttctttgacgttttcgtcttttctttttttatttttccatagattataggggtacaggtggtgtttgattacatgaatgagttctttagtggtgatttctgagattttggtgtacccatcaccagagcagtatacacttcaccctctgtgtagtcttttatccctcacccccttcccacccttcaccccaagtccccaaagtccactgtatcattctttctctttttttttttctgagacagagtctcactctgtcacccaggctggagtgcagtggcatgatctcagctcactgcaacctctgcctcccaggttcaagtgattctcctgcctcagtctcctgagtatctgggtgtgcaccaccacgccctgctaccttttgtatttttagtagagatggggtttcaccatgttggtcaagctggtctcgaacccctgacctcgtgatccacccgccttggcctcccaaactgctgggattacaggcgtcagccactgcgcctggcctattgcaccattcttatgcatttgtgtcctcatagctttgctcccacatatcagtgagaacatatgatgattggttttccattcctgagttacttcacttagaataatagcctccaatctcatccagatcactgtgaatgccgtgaattcattccttcttatgtctgagtacatatatatatatcccatctcatatatatatatatctcatcctatatatataaagaaactttatatatataaaaagaaactgtggtatatatatgatgaaatatatatatataaactgtggtatatatatgatatatatatcatatatatgatttattttatatatattccatcatatatatatatatactccatcatatatatatatatttatatatataccacagtttctttattccctgttgattgatgggcatttgggttggttccacaattttgcagttgcgaattgtgctgctataaacatgcatgtgcaagtatctttttcgcataatgactcctttttcactgggtagatacccagtagtggggttgctggatcaaatagtagttctgcttttagttctttaaggaatatccacactgctttccatagtgttgtactagtttatattctcaccagcagtgtagaagtgttccctcatcactgcatccacgccaacacctactgttttttttatttttttatggccattcttgcaggaataaggtggtatcacatggtggttttgatttgcatcccctgattattagcgattttgagcatttgttcatatgtttgttggccatttgtatatcttcttttgagaattgtctattcatgtccttagcccatttttttaattatgctttaagttctagggtacatgtgcacaacatgcaggtttgttacatatgtatacgtgtgccatgttggtgtgctgcacccattaactcatcatttaccttaggtatatctcctaacgctgtccctcccccctcccccctcccccgaccccacaacagggcctggtgtgtgatgttccccttcccttagcccattttttgatgggatttatttttcttgctgatttatttgagtttgttgtagattctggatattagtcctttgtcacatatatagattgtgaagattttcttccgttctgtggattgtcagtttattctgcttactgttccttttgtcatgcaaaagctcttttaattaagtccccgctatttatctctgtttttattgcatttgcttttggcttcttggtcatgaaatccttgccgaagccaatgtctagaaggggttttccaatgttatcttctagattttatagagtttcaggtcctagatttaagtccttaatccatcttgaattgatttttgtataaggtgagagataaggatccaatttcattctcctaaatgtggcttgccaattatcccagcaccatttgttgaatagggtgtcctttccccactttatgtttttgtttgctttgtcaaagatcagttagctgtaagtatctgggtttatttctagattctgtattctgtcccattggtctatgtgcctattttataccggtaccatgctgtcttggtgactatggccttatagtatagtttgaaatcaggtaatgtgatgcctccagatttgttctttttgcttagtcttgcttgggctatgtgggctcttttctggttccatatgaattttatcattgttttttctaattctgtgaagaatgatggtggtattttgatggaaattgcattgaatttatagattgcttttagcagtatggttgttttcacaatattgattctacccatccatgagcatggaatatgttttcatttgtgtgtatcatctatgatttctttcagcagtattttgtagttttccttgtagaggtctttcacctcctcggttaggtatattcataactatgtttttgcagctattgtaaaaggggttgtgttcttgatttgattttcagcttggtcgctgttggtatacagaagagctactgatttgtggacattagttttgtatctggaaactttgctgaattcttttatcagttctaggaactttctggagaagtctttagggttctcaaggtaaacaatcataccatcagcaaacagtgacagtttgacttcctctttaatgatttggatgttctttatttctttctcttgtctgatcgctctggctaggacttccagtactatgttgaagaggagtggtgagagtgggcatccttgtcttgttccagttctaagagggaatgctttcaacttttccccattcagtattatgttggctctgggtttgtcatacatgacttttattaaattgaagtatgtcctgtatgtgccagttttgttgagagttttaatcataaagaggtgctggatttgtcaaatgcttttactgcatctattgagatgatcatgtgattttggtttttaattctgtttatgtggtgtatcacatttattgacttgtatatgttaaactatccctgcatccctggtatgaaacccatttgatcatggtggattatctttttgatatgttgttagattcggttagctagtattttgttgatgatcttagcatctatgtgcatcagggatgtgggtctgtagttttcttttttggttatgtcctttcctgatttgggtattagggtgatactggcttcatagaatgatgtagggaggattccctctttatcttatgaaatagtgtcaacaggattggtaccaattatttgagtgtcgggtagaaatctgctgtgaatccatctggtcctggacttttttgttggtaatttttacattattatttcaatatcactgcttgttattggtctgtttagggtagctaattcttcctgctttaagctaggagggttgtatctttgcaggaatgtatccatctcttctaggttttctactttatgcacgtaaaggtgtttatagtaaccttgaaagatctttcgtatttctgtggtgtcagttttaatatctcccatttcatttcttattgagcttatttggattctctctcttctcttcttggttaatcttgctaatggtctatcaatttgatttatcttttcaaataaccagctttttgtttcatttatcttttgtaattttttgtttcaaattcatttagttctgctctgatttttgttatttcctttcttctgctaagtttgggtttggtttgttcttgtttctctagttccttgaggtgtgacgttagattgtcagtttgtgctcttaccatctttttgatgtaggcctttaggactatgaactttcctattaccactgcctttgctgtatcccagaggttttgataggttgtgtcactactgtcgttcaattcaaagatttttttaacttctgtcttgatttcatttttgacccagtggtcactcaggaccaggttattcaatttccatgtatttgcatggttttgaaggttccttttggagttgacttccagttttattccactgtggtctgaaagagtgcttgatataatttcaattttcttaaatttattgaggcttgtttgtggcctatgatatggtctatcttggagaaagttccatgcactgttgaatagaatgtgtattctgcagttgttggatggaatgttctgtatatatctgttaagtccatttgttccaaggtatagtttaaatccattatttctttgttgactttctttcttgatgacctgtctagtgctgtcagtggagtattgaagtctcccactattactgtgttactatatatctcatttcttagggctattagtaattgttttataaatttgcaagctctagtgttaagtccatatatgtttaggactgtgatatttttctgttggacaaggccttttaccattatataatgtccctctttgtcttttttaactgctgttgctttaaagtttgttttgtctgatacaagaatagctttaaatgtgttttgtctgatacaagaatagcttgcttttggtgtccatttgcatgaaatgcctttttccacccctttcctttaagtttaatggtacttatgtgttagatgagtgtcttaaaggcagcagatagttggttggtgaattcttatccatgctgcagttctgtatcttttaagtggagcatttaggccacttacattcaatgttagtattgaaatgtgaggtaccattccattcatcatgctatttgttgcctgtgtaccttggttttttgtttggttttttaaattgtatttttgttttataggtcctgtgagatttatgctttaaagaggttctgttttgatgtgtttccaggatttgtttcaagatttagagctccttttagcagttcttgtagtggtggctagtagtggtggattctctcagcatttgtttttctgaaaaagacgatctttccttcatatatgaagcttagtttcactggatacaaaattcttggctgataattgttttgtttgaagaagctgaagattgggccccaatcccttctagcttgtaggatttctgcttagaaatctgctgttaatctaataggttttcctttataggttacctggtgcttttgtctcacagtttttaagatactttccttcattttaataatcttcatttagataacctgatgacaatgtgcctaggcaatgatctttttgtgatgaatttccagggtgttctttgtgcttcttgtatttgtatgtctagttttctagcaaggctggggaagttttcctcaattattcccccaaatatgtttcccaaatgtttagatttatcttctccctcaggaatgctaattatttttaggtttggtcatttaacataatcccagacttcttggaggctttgcttatattttcttattctattatctttgtctttgttggattgggttaattcaaacgccttatcttcaagctctgaatttctttattctacttgttcaattctattgctgagactttccagggcattttgcatttctataagtgcatccgatgcttccggaagttttgattttttttatttatgctatttatttcattgaatatttctcccttcacttctcatatcatttgttggatttcctttcactgggcttcacctgtctctagtgcctgcctgattagcttaataaataacctcctgaattcttttacaggtaaatcagggattcttcttggttcgggtccgttgctggtgagctagtgtgattttgcgggggcatgttaaagagccttgttttgtcatattaccagtgttggttttctggttccttctcatttgggtaggctctgtcagagggaaggtctagggctgaaggttgttgttctgattattttgtcccgtggggtgttcccttgatgtagtactctcccccttttccagtggatgtggcttcctgagagccaagctgtagtgattgttatctctcttctgggtctagtcacctcactcctggctggtactgggggttgtcggcacaggttccaggctagtactgtgggttgtctgcatggagttctatgatgtgaaccatctatgggactctcaactatggataccagcacctgttccagtagaggtgtcaggggggtgaaatggactctatgctcgttcttaactttggtggtttaatgctctatctttatgctgcttggcctcctgccaggaggtggcactttccagagagcatcatctgtggcagtatggagaggaaccagtggtggacagggccgtagaactcccaaaagtatataccctttgtgttcagttacctgggtgggtagggaaagaccatcaggtgggggcagggctaagcatgtctgagttcagactctccttgggcaggtcttactgtggctgctgtgggggatgggggtgaggtttccaggttaatagagttatgtaggtaggaggattatggctgccactgctgagtcatgcagattgtcagggaagtgggggaaagcctgctgtcacagtcctcacccagcttccacacaatctgaagggccggtctcaatcccaccatgcccctgctagcagcactgagtctgtttccaggcagcgggcaagcagggctgagaacttgccccaggctacctgcctcctagccgcaaaagaaagtaggacattagttcttcccctgcctgtggagtctgcacgctggatttgcaccctcccctgagttctgatcaggaggcttcttgaccagttcaaattgttacaaacttcagctggagatttccttttccctgtggtgctttccctctgcctctggcctccttcctgaagggtccccatggtgccaggcagtgatggcctgcttggggacccagcaagctcccagggcctttcccgctgcttcctctaaccctgtatttcacttggctgtctaaattgactcagcttcaggtaaggtcagaatcttcacctgcaaactaggcctttagtttccccagtggggatgtgtgttcaggggcggaggatctccctttcccacttccacatttgggcacacacggtatttggggtgtcttccaggtcctgcaggagcaatccacttccttcagagggtctgtgggtcctttcgagtttcctgatttattcctgcagttgttctggggcaaaaattcaagatataagcctccacacactgcttcatccatcagagttggggctgcagtctagttctgcctctcatttgccatgatggattattttctttctgaagttttctgattatgttatttatttactagttggggtcatgtttttcttaaagattataagaatcttgtagtcaatgactgtcacattggtgaccgtgctttttttccatctagattatatggtgccttttagattttagtgtattcctttgaatcacgtaagaatttcaaatgtttattactttaactgtgttatcttgtgcatgcttataaaagtctacccccggagaggagggagaggatcagaaaaaatactgttggatactaggcttagtacttgggtgatgaaataatcagtaaaacaaacccccatgacacaagtttacctatataacaaatctgcacatgtacccctgaacctaaggtaaaaattcaaataaataaataataaaagtccatcttcaaattgattttctataactaatcatttatatttttatttagactgtttggaggtttattatttacaactagctccaatatatatggaatgtatttttggttaatgctgtgatacaaagacttcacattattttctctttataaatagccacttgtcctacaatttattaatccttcctttctctactatgaaaattgtggctatttatcttactataagtaaaaggagcttggtgtttatttcctcctaggctatctccttttcttccttgacattcctatcaatcatatgacatgacagaccatcttaactattataccttatatttttattaaaaataagctttcaacacagtttatgacaagtcagtataaatgattttactttacttggagaagagattctgaccaatcttcatcggcaaaataggttagctgaggtttctaagcaatcccactaaagactttttataaaagtgagtttgggtacttttttttaatgagaaggaggtcacttaaaagatgtaatgttccaaatccacatcattaagagaataaaaacttagtggtgcctttttctgttaattatttctaaccactatcatgctgtgacatcagtggagatacaggcttttcttttcttaagaaattagcacatacaatgaaccatgacaataattatcataacccttgaaattttaatatataggaacattgccacagtgttatttttagacagatctcctaaattgctttctactagtctttcaatgacatataccttgaaaatttggaacatttaaaaagagctcaaatacacagaaatagaaaatgaaagagtggttaccataggtggagagagggagaacatggggagatgtacaccaaaggatacaaaaagcagatatgtaggatgaacaagtctagagatccaatgtacaacatgagaactaaaggtaataaaattgcgttgtgtttggaatttttgttaaacaaatagatttagctgctcttgtcacaaaaaaagtaattatgcgagataatagatatgttaatcttcttcactatagtaactcttttgctatctatatgtatcctataacatcattttgtaaaactcaaatataaacaataaaatttgtaatttgtaattttgatctttattttccccagacatttaaaaatatgtcaaagaatatacttcatccacaggcagatttttcatatccatttaactatgtctccagagagcacttattaacagaagctaaacatatggaccttctaaaattaagaaaacctttttggaacttgaaaagacttttgaatagggctagaagcaacaagccatagtgaattattcaacaccaggatatcaaagaaatggaggaagtaatttcgtgctgtagaagcaaagttctgtaaattgatatgtgatgatattcaggatagtttaatttggtagcctggaagagaatcaaatgaattgaagaaattcttataaatatttctttcttcttttttaaaattaaagatatctgctaatttgaatatgccacctgtgctttactccaatgttcaaatttctttttataaattgcaaaaaatgcatctaattttacaaatattcctcactctctacaattaaaaatatatgcatataatttaatattcttatgaaatcaaatatctaaaatagaaaaatcctaacacagaccttactttatgatcatctttgtgatattctaaatcctcagttattttaaaattgaaacaacggggaagttttcaaataaaagatcttatttcacttgaaagaaaaatgtaggtgtaaggggaaaagttataggtaataagatttaatggctgtgagaaatagacaaaaactgatagtgttctctagagaaaatagctttggggcagacagaagagagatgaggtgtgatactgagtgaagttttaaaaataaagaaaacagaagcagtaatagcagagaaagaacaagaattaaagagaaaatttaatcagaggataacgtgtgaagagtccccaaactattttcttgatcaatatgacgggaaattaagcgttaaatttttccaaagtgagaataatgatctttgaccaacattagcttgtttccatggttagaggctaggataaggtaatgtttgtagtggtttaggtggggagacagcctgcattgaggctctggtccagagctggggcctcaagaaccatgaagagagctaagcagttcaagaggatgttttctagaactcttgaaacctaatggaaacccaaagactggaagcaacaatgttcaaagataagaccctcactcatcatgtgcctatttggaggtttcttagcttcctaatatagaagacagaattcaaagcagatacctaaaggaatatctgggagatttctaaattaatagactgactgtatctaaggcagaaaataaaatgtttcaaactgttaatcacaggcaattttacattaagtgagattaaagattttggacatcctcccagccaaaatttagacatcaacccacttttactggataaaacaaaatgtgataatcagtgagaacagttccaggttgttccttgctcttgaatgtgactgactttctttaatgtggagttatatatccattgataaaatgaagtcatccctttatcaaaatatatgcatccctttatcaaatgcaactcagttattttttttacttgaattgcacggttacaaacacattactaccaccagtttgtgaatacacctaaattgcaggaatactatttaaccataatgataatctgattattatttataatattaagttctgggattcattatgattttatttctcacaaatttccaaggaaattccaaattgctaagtttagagctggacaggacctttaagttgaattcttttaaccttctcatcttatagttgaggaaataaaatgatacagtttacatttgttcagtgttaacacagtgaggggtagaaaaggaaacatttgccagtgcatataatgcttatattgaatattataagaattgcattttttctactgctgcctatggaccattctcttacctatcattcttcacccgattagccattagtgtgtacacattcataaacctaaaccttttcaattatagtaactcttatagaatggaaaggtaggggggtgtgtgtgtgtgtgtgtgtgtgtgtgtgtgtgtgtgtgtgtggctgataaattattgacttctgtgtactattctttacccatactttatcacttcttacctggacctccttctcttctaactcaaatacccttgcactctaaattttgttgctgtgtctctggataactacataaagaagaaaccgaaagaggataaaagtgaacataggtatcaatttatatataaagagggaagcatgaatctgacttggtactcactctatgagcagcacggaaacaggtatagggatttatcagcttcatatcagctgaccaccacaagaacccataaatggaagatacatgttgttttagacacttgcaagggaggataagtgaaagagaggcctgagcaaagaagctcacacacagggcctgtgcctatgactccagatgaagcccaggtcaggctgtgaacagctctgttagctatactaaccaagaagtttttaactgtatcccaagggcaatggaaagccgatgaaggctttacagcaagaaaatgacaagacgagatttatgttttggaagaatcctcctggcttaaatgtacggaatggagaaagagtggtgcaaaggacagaatgtttatgacacccaaccccaaatttatgttgaaatcctaactcccaatgtgatggtattaagagattgggcctttggaaggtaattaagccattagggtggagccctgatgaatgttattaatgtccttatgaaaagaggccagagagctagctagcctctctttccgccatgtgaggttacaataagaagttggtagtctgcaacccggaagggggcctcaccagaaccccaccattctgacaccctgatcttagattttcatcctctagaactgtgagaagtaaatttccatcatttgcaagccaccagtttatggtggtttgttaagtagcccaaactgacttaagacaagtgggaaggggctgagtagtaagaccaatgcctagaatagtgcttggcaaataggagatgacaaatgaataactgttgagtatgtatgacagcagaaaatccaattatgatgctgttgagaaatccaggcaggagaaggcatcactggggccagcatggtagctgtcagtgagtgtgcattaggattaagtgtttaatgcaagtgtgcagaactaagaacatcctatgtttttatggtgtgtccaaatccggagtaaagacaaagttttttattttgtttgccaagatagcattttccttttagcagtttttcttctttaaagatattgtactctttcaccactaaagttgcattacctctgaactggcagttttgctgatggcttctgtggtctggaggcttgcccatttattttctgatttcccctttggcagtgcacatttctgctctcattcttcactgcaagcttcaaatatataagcgttctagttactaacaaccaagagacaaagagattgggggataaaagtacaagagcaagcagattcatacctgatgagttattggagtgtttcccttaatcaatgccattgtcatcccaaatgttggcagatcaagcttggataggatccagtatactcactgtcactgaaaatagttaattacttggagggcattatgtgtggtggtagcacagggctatgtacatataggtaaatcaaaaaaaaacttaatgggcatattaattcataactttttcgtagtaagcatcgatggattagatctgtttactgaatttatagatacttccactagagaataaagcttttcaccttcttgttaatccagggtcctccttgcttagtgtcagagctgtttgtgatttaccagcactgacaactactgttttcctttttggttcatttatcagagaggtttctagccttgtgtaatgcaaaatgctcaggctttgttaccatactaatttgggtttaaattcaagtcatgggatattttagcttggtgaccatgggcaaattgtcaaatttttctgaatctggcattctcctagtataataatcacaatcccaaagaagtgcttgatgagtttcatttgattatttattttcttttaagtctagcacaatgttagacacataaaaggaatgaatcttcatgaccgttgtatcaaataaaaaagttctccaatgctatctttgttgtatttaaaaacattagataggcagaaatatttttaaatagatgctcagagataatcacaatggtgttatttgaattctatattattacttggaagactttattaacttcctttaaaaggacatggggacctttcagagagtggaaggtgggagatgggagaggatcaggagaaataattaatgggtactagtcttaatacttgggttatgaaataatctgtacaacaatcccccatgacacaaatttacctatgtaacaaacctgcacatgtacccctgaacttaaaatgaaagtttttttaatggtgcatacttctgcattctcatttatgatatatacattaagcctaatttaatttagataaaaataataactcaaaatatttgggataatagcttgaaattttaggtgtatctttccaatttctattttttcaccacaagtagatttcagtaagattttaatcaatggcagtgttgatgctaaacaagactagggaactctcaagttagcccttgtgataaaattacagaaattcagacctaaaatacatcttcaaggccactagatcatcatgagagtttacggtagtaagtggcaccatgtcaacgtaactactccctagagcagtggttcccatttgtattctgaggaccaatgggagactttgagttgtggcatggggtgtgtgagtcctgggtccactcttaactgtagaaaatcagtattatgtatcctacatatgtatgcagctgcttttcaaaagtatacagacactattgtgattagaaaaatacaaattcattccaaggcattaccacatttcagtagtgttttgttatgggttttcttaaccaacagttgtgtaaagtctatctgttctcatgtgaaatctgtagacattttaaacagtgtaggggaaggaaatatcttctcttcccatcttagagtcacggctgaggcccctgtaagaaaagacagattaacaaggaaagcttacagattcgtttaatgtaagttttcatgacatgagagccttcataaagaaatgaaacaggtaaagttgtgtatttttatgcttaggtttgataaagagtggacagtcctgagaaatatgattggaggacaaaagggaatgacctaatggtaacaaactgggggaacttaacaaggcgtgtttgttcagattcttctctgggtctgtgtgtcatcaaagataaggatgttcctttcctccaggtgtagggagggcacctctggaatgaggaacttaggatctgcttcaggggatatgagggagggaaaggtaagagtaaccttgctgcttaggctgttttgtcaaataccaaggtgacatgctttggggtagaatgtcctgaacccccaccaatggagtccttgtatttgaaggtcagaggcttggatttattcatatgggcataacaactttgaataaagaaaccatggcatatgcagatagcatctggagcgcttactcagtttaagctggggaagaaagtaatgaggaacttgataaaagagaataacagtactagagaaaagctatgaaggatacatgggcttattttcttggtgaaggaagatgatttttagcctgccaatgttttaatttattaaactaccagaagggagtactttagggaagaaataacaaagctcaacaaagggctatctttcacaagcaggccaccctgtgaactcaacctcttcagtgccaataaggaggactggtctcatgcttcaagattccaccttccccctgacacatctagcatgccgtagagttctctcttgcccattttagatgtgaaaatataaatttaaatttaaatttataacaaggaacaaattaaacaggaaaactcccattgctatgacaaaagaagcatcgagccctcaaagagctaaagagtagatcttggtttctttgctaaggagcttgtcttataaggctaagttgatgggggctttctagccactggtggccatggaattgccattggctggatccttacattcgggtctcaagccagggggctcgggcagtaatgtattatacctggggtggaggtgggagcctttggaagaatgcaggcccagcaagtctcctactcaaaggaaacatgcaaaacccagaccaaataaacacttctggctgtctggctctcttcacctctcagtagagaaggttgccttttctatggccctgcactttcaaaaaagatatagagagaaagttacaataataatacaagaaccagaacatagaactgttaatttaaaaaaagataaacagattgaagttatttagtcaagagaagagatgccaaaaggaacatcttaataatggctttttagcaaaaagtaaaaaataaaaataaaaaatgctgcagtgaaaatgcagatctatttttttccactgaggcaaaataagaaatagccagagttggcaacaagatatatttagattaggcatgaggaaagacttctcagttataagggatgtctattctaattataaagggtatatagcttgactgcttatacagtctggcttcaaggatattttgcctcttatttttaaaagcttaaataactattgattcttttctcccaaataaaaaggttcatgctttttgttcttttaaaaaaaaaatcacaacaaagaatccaacaaaattgatcaaatggcttccatagtgagtaattttcctgagtttttcccaaataaatattccttaaatctcccagaaaatagcagattccatcttaaatatttaaattttagaaaatgttatttttaatgagaaatgtatttgtctatgctaagaacttaaagatttaaagcatagcagactttttcctgtgtcatgtgtgcctcacctgtacacataatcacacacaatcacgcacacacacacaggcacactgactaaactttaagtactgtcaaaaaaaaaatttccaaccaatagaaaatgacaagtgcatttattgtatgtctgttttcacatccagtcttgcttgtatagttatttatgtaagatcttgtacttgaatattaacacataaaaataaatctggcttgaaatgttaagattcatgagggacatagatgctactaaaaatcataatcagtaccaaaattctcacctaaactagaatttctagtgcaagcagagcctcacacatgaatttgctaattgaattcttccctagactgtggatattaggcagctttggtttttatctctgatagataatcttggggaattgagatattactatagaagtggtcttttggagaaaattcatttttaatggtaaattattaaaaacggagctcttttataccacagtgacagtgtggaaacattggtagtttctatggtagcaatttctcattttatgtctttttcccagccactttattatttatacaggtttagtaataggtattaattcctaatacaaagtaaaaacaattcaggtttcacaccaagcattacatggtcataacccagtaactaccagatattgtgcctgcctttaaatatttacgatttagttgatattagctcatgctctctaagacttttcaggagaataaaccaaaagaaaatctaagcaagccggaggggaataaaaaataggaactgtgccgatgatagagagaggcagattactatgagatgacaactcacttcactcccccttacaaacagttgtgcaagtaccactgcttcctaagcactatcggagaagaaaagcatgtttgtattcagcctgattattccatccgcagatcttagcagtaaaaccttctcaagtctgaaagggagaacatttttcctattgtcagttccacgggggtagaattgaattcttccctttcatatctcattgttaagtaaattcaaaaagttttcctatataactacagtcttctgcaatattttatttaataattgattttatatacccccccaaaaaaagtttacttgctgggccatttctgcctctggcaatgatgtttccaaatgaggaatgatgcctctaagatggagcctcaagtgttggaagtttcaacttctgcagtcacttacagggcagatttgaagggggatgggtagaccctgtactgaaatacccacctagagagatgtctaatatttccacatgaatgctcattttcttgtcctcttcctgtatcatgaacatattccctggccatggaggaataaggcatcagcgttcttacacatccacaggaatgagttctatgtcccagaagagaggccagggaactggagaggagcccagggtgctgaagggagatctgatgcagggaggagttagggagcagacagtcctcaaaatttcctctgctgctgcttatcttctatggtgtgtggtagaaataaattagattgaataaatcttgagaaagcattaagccagaaaaaaataccaatacttatttcacccttactttcccttttctgttgtaaatttgaaatatttttaaaagtgtgaatgtaataacactgtaagacatgaaaaagctttttgttaaactgagaccatcaaaaacctacagagaacttaatctggaacagattctgggggatttaggagcccccccaccatttttttatttttatttttattttattttattttattttattttattttttgagatggagtcttgctctgtcacacaggctggagtgcagtggcatgatctcggctcactgcaacctccacctcccaggttcaagcgattctcctgcctcagcctcctgagtagttgggactacaggcacatgccaccacacccagctgatttttgtatttttagtagagactgggtttcaccatgttggccaggatggtctcgatttcttggcctcgtgatccgcctgcctcagcctcccaaagtgctgagattacaggcatgagtcaccatgcgcggccaggagctcccttttcataatgtgttttgccctgggaaggaaggacatgcccaagaagcctgccgcccactccctcccactccacccttcaagttactataccctggatcaggatttctcaacatcagcactattgacatttgggccaggtgtttcttttctaggggggctgtcctgtgtcttgtaggatgtttagcagcatccttactgtctgcccactagacgcaatagcaccccgcaccccttagttgtaacaaccaaaaatgtctccagatattgccaaatattcctgggaaaggtgtgagggccagggggaacagactgtatgcagctgagaatgattgatctagatgaaactttccaaactgagtttcctgtgtcactatgccccataaaaacgtggcctcttgggaactggtgcatgcactcctctctcttaaagattcctgctgcacagtagcatattaggatctctcaaagtccagcttgtctttgtttaaactcatgccaaatttatttaagtatgggacccctgtttttcactaatgtcaatcagtactttgtggaactctttgtctttgaaacactctggattgccttggactgatagagcctagtataatggacaatttggtttatattaattgttcatgtgctcaaaagtctctgaacatgagagttatcatttttgtgaacgtgtctcaagatcatgagagagaggtctttatatgaggaaaggcacattttattcctccaggaccttgaaaatttggggaaaagtcagagtgatagagaaaaggacagaggtgacagaaaagttcctaattagaacttcaaaggaaattgagggctggctggccctaccttcctttcccctccagaaaatcaagccaaaccaatcaatacaatgagagggagataaatggcaatacctggcctagagagccaccaaataaaattttcgggtcctatctactaattgggggcccctatgctgtatatacttctatgatactataatatgttagggtgaaagaactaaaatcatgcaaacaagctgaagtaaacaagcagcaattattgaaaaggaaagttgcatgaagtccagatttacaaagactagagctagaaagagaaaatttcaggagctgaagtgttgccttctcttctcccctcttgccttgtcttctctcgtcttcttttctctctttttgttctcctttctctccctccccttccctgccatcttcctgatggtttcagttctcataatttcagttagcacatgactttgtgactttgttgtgatctagggctgactttggccctgattctagatggctttttcccaaaatgacttgatcgttcatggccaaccaatggacgaggtggccttgcatcaaggtgtttgcctctggtccagtcatctgaagccaaggaaagatggggcaggcaaaaaataaatcagagggtcacctagactactcattcagcagtctgtaaggacaaaggcagctcttaaagaactcatgggagagacagaaacctcaaaacatagctattgccacctatgctgtgtatagtttaagcagtagtagtcacataaacaaaaacaataataatagcattattgagtggttgagtgctaacaacaaatatgtcaggtacttttctaaatgttttttggtaatacactcatcttattctcaaaacaagtctatgggttagatatagttatatgttgtatttttcagatgaggaaacagaggactgaagttcagttcccaaaatcaagcagttgatagatggtgtagccaggattcaaacctacacatctggctcacagtctatgctcttagttaatctgctgagctccctttctgaaaaaaaaattaatcataataattagaatgtaaaaaatataacttcaggaaagtagatgcctagattttggcaaactgttctgggtgggcttgcatttcagaagtatcaaccaatgttgaaggaagcctgcctttggttatagaccaatcatgtcatttgtctctgacgttccatgcccaagatggatgtattcttcaagagctcactagtaatttactccacttagagtttgtctgtttgtctgttgcttggagccaagagcctaagcccagcagttgtccactacaatccagagctggggcctggctgctcaccaaaagtgtcttgcagcggcactgcctctacctccattatataagatagtggggccaggcacagtggctcaagcctgaaattccagcactttaggaggccgaggtgggtggatcacctgaggtcgggagtttgagaccagcctggccagcatggtgaaaccccatctctactaaaaatacaaaaactagccaagcaggtgcctctgattctagctactcaggaggctgaggcaggggattcacttgaacccgggaggcagaggttgcagtgagccaagatcaccactgcactccagcctggacaacagagcaggacactatatcaaaaaaaggggggagggggattctgcctgtctcctcacttccagtcagtctgtccatctgtgttataagatgtacctctcttctttattggtaaaccaaaagaatggtttgatccctttaaaaatagtagagtattctgagccagagtgttggaatacgcatctaagataatccgtgaccctacgcagatcatttatactccccatagcttgctctattattaataggtggccattaaagcctctttctgaagacttctgccactcaggtgttatttcagaatcaggaaactcaaacctttaacatttttctgacatttatttgagtgaagaaaaagcctgacaatctctttttctatgttctacatttttgctcagaataatattaatagtctgtcttttagaaatatttttcttactaaataccagccaatactttttatatgtgtattttgtctgattttctaagtgcagtggttttgccacacactaaaatgtggatggatcaaccatcttctttaactagggagtcaaggggttctgcttgctaccacagcacctatctggcttcaatagatgtaatcttaggctgtacatttgagttgcgttcaattgggaacaaaaattaccttaaatgttcttccttatctatttaattaaactcaattcaacagacatttattggaccacctgaaacatgaaaaaacactatgatattaaccttagtaaactcaaagaatagtgaaacaaagccctgccagaaaggggcttattgtctagttgggctgaagggatagaggaggagacagactaaaataagagttagagtaagcagccccaagttccatattaagattgatctcataacatggggaataatatacatgttataaaatcagcatagccatgctgcttgagttgaaaggaaacagcagtaagattcaattagaaataaataggaaatgcttcattagaggccactgtgcaggaaatatagttaggagaaccagatgttcaaaatatatgaagaaagacacagaaataagaatacacatggcaagtttagaaaataatgtgaaggttgattgggctcaacagcatgtttggcgtgagtagaagatgagcaagaaatagttgaccaggggcatttctggaaagcccaaggatgtagtgagtggcaaagagcaagatagtggtgtactggggagttttggggagtagacaggagtatcagggtttgaattctggagctgctacttactagttgtatgacgttgcttgcatgagagattctctttgagcttcagtttcctcctcagtaaaattgggaagggaaaataagagaatctacttcaccaggttattgcaataattgcctcagctaaaccattttaagttctttgtagacactcagtaagtatttattaataagtactcataataagtactctaaatttgttgactaatctttgtcctagagtcttgaagtggacatttttgacagaaaatttcccagtggaccaaaacaaagctgggtgtcagtaattcataactcactgaatcactgaacctaaacccaacttggctttatgatctgaatatattaactttgtcagttaaggatgtaaagaaaaatttaagacatgtggctccctcaacttgaaattcttgatacagttaatgaatgttcctccaaaaaaggttgtgggtgggagagaacagagccaagaaaatccatttacttacagcttttggtggtatgtaactagcaattcactcaaacgatatcagaggtactatccccagttctgtaagaccaacttcgtatttgtggacatattttatgtataaacatcctaaggactctaaacatataccaaacactcagttaatcctcatggattattcaatagataagaatattattttactgtctgtgctttagctatctgttatataatgctctactttttatgcagtctttgttatttaattttatttttcaattgagaaataatattgtatatacttacagtttacaacatgatttttaatatatgtatacactttgaaatgactaaatcaagataattaacatatcctttacctcatattgtttttttgtagcaagaacatttaaaatctgctctcagtaattttcaagtaggcagtacattgtttttaatcatagttaccattacccacaatagatctcctgagtttattcctcctgtctaactgaaatgttgtatgctctgaccaacatctccccatatccctctcaccagtccctagtaaccacaattctactctctgcttctatgttctcaaatttttcaaattccatgtaaaagtgagatcatgcggtatttgctttctatgcctggtttatttcacttaacatagtgtcctccagtttcatccatgttttggcaaatgactagatttccttcttttttaaggcttaataatatttcattgggtatataggacacctttctttctttctttttctttttctttttttttttttttttttgagatggaatctcactctgtcacccaggctggagtgcagtgtctcaatcttggctcactgcaacctcagcctcctgggttgaagtgattctcctgcctcaaccccccaagtagctgggattacaggcacccaccaccactcctggctaatttttgtatttttagtagagacggggttccaccatgttggccaagctggtctcaaactcctgacctcaagcaatccacctgcctctgcctcccaaagtgctgggattacagatgtgagccaccgcgcccagccaggacacatttctttatccatttacctgttgatggacacttaggttgattctgtatcttgatgattgtgaataatgcttcagtaaacttgagagtgcagatatctcttccacatactgatttcatttcctttagaaatagaagtagaattgctagatcatgcgataattctaggtttatttttttgaggagccacagaatattctgttttccataatggctgtaataacattcccaccaatagtgtacatgggctcccttttctccacatcctcaccagtactaattatcttttgtctttttggtaatagccatcttaacaggtgtgaggtgatgtctcattacagttttaattttcatttccctgatgattagtgatgctaagcctttctttatatacctgccagtcatttgtgtgtcttcttttgagaaatttttttaatcctttgcccatttgttgcagtttttaaaatttcaacttaaattttagatacagagggtacatatgcaggtttgttacatgggtatattgcacacaggtaatgagtatagtacccaataggtagtttttcaacccaaatttgcctttctccctgccctagtagtctgcagtgtctactgttcccaagtttatgttcatgtgtgctcagtgtttagctcccacttataagtgagaacacacagtatttggttttttgttcctgcattagttcacttaggattattcttttgcccacttttatttgttttattgctagtgggtcatttgagttatacaatatttaaataaaagagaaccataaacagtttttgtcttaggggataattttttaacacaatggtttccttttcaggtcaagatgagctcagaaaaaaaggtattgaaataattcaatcatagtttactaaatgagaacattttgctaatactttatgggttacatgaataacattcaacttgggagatttttatagtattgttcattttgatttctttttctaaagaatattaatgtcaaaacaagttttcttatagttcatcttctaatcattacacaccataacatgctcacttgagatctacccatcatttttataacaatttccaatgcagctgagatgtgaactcatgacagatttttttagttttttgagattgaagaacagatttcaaaataacacactgaactaatcacaggaaactaggaagcagaaatagcaatttttctgaacagaaattaatattggaactatcaagtcagtaattttatttgaaagtgaaaactagggtcaccaaaatcccacttagaggtcgtcacctcacactgaagactaagataaaagcgcctcttaagtgggtcgccatccgcatcctagttgtgggcactctgtccttccagaccccacagcctattgtcatcaacagcacatctctggcactgtgattagctcaatgtgctatttttaaatctactattcatgctcagagctctcacgcaggtggaagacccttgccttcccttcccagagctatgcagtattcttctctctcaccctccttccactcgcataccacacacacaccttcaacacttcgacctcccttatggggtgagcaactgctgtcttggtttgcctacaactgaaggatatcttgggatatggaatttttggtactaaacccaggacattgggtcacatacgtgaggagtgatgagggtgagatagtgagggacctctggctgttcctcatcttattccttttttttccttttgttccctaaaaaaattattcatataaacaaggaagagaggatccttttactgttcaattagttcttctcaaaaatttatcattttagggcatggttttcttaatctattaaccattttctgaaaaacatcctaagatttataaatcataaaaatgtttatgtttatttgataatatgtagcagaaatagatggacctactgttgaaaattctctctcagtaaaacattagcacctcttaataaagggaataattgagtgatttttttctcagaaaggtgtctaaataagtatacccaacattctggataagaatgttctcatgtagcatcctgtaaatcagtgagaaggaaacagaggcaagataatatatatggagccttggaaatctagatgagcttacagatggatctcttcaatccaaatctgtcaactcagtaaagatgtttataaaaatcagtcaaaacagctgccaggcatctgaatcacttaattaaatgctttatatctcaactagtttttgcatcttgtaataatgtccctaagaagccaacatcatcagaatagatccacaaatattcatttatgcattcaaatatttcttaattgagtatccagtatgtgccacttgctcttctagacatgttctaagaaatatggcctcagttcctgggcttaaggagtatataatacactggggatacaaaacagaaaacaataacccattaaatacataaccagagctcataaaggctttgggagaaaataaatatgttcaacagcagggttaaaaaacaaagtgggcttgttgaaatctaaaggttggcaggcaccatccaggcaggagtgaaggattgttctgggtagaaagaacaacttgtgtgagggaggagcttgcttagtagttctaggaatctgagggagatgcaatgggaaccttgtgggcaaagggcagctgctgctgaaggtgacagtcattaattgtagagaattttgtaagccaagacaaaggctttgcattttatatgaaaggtaatgagaagctacagaagagttttacacttaggaacttagatatgcagtccatttaatgttgcataaagattactctatctacctttgtgaaaacgacataagaatgagagaaaaatagcagagagccagaagaggctgcatctgagcatcaggtggatccagaattgttctcctcaactgtcaagaggtgggggattgagagctgaggctgagtgtctgcttgcttacccctttgccttcaggggtccaccctcattcatcccaggaactaccagagatggtgataaactgctctgcccccactgaattttattggtttgggacacaaaactgactttaaaaggttaattagtattactgctgcaaggaatcagctcatgaaaagttatactgcattaaaaactagcaggcttacattatttatggaaaacagctgttgaaaattgtctgctaaagcttcatttcttcccatttcccttctctctatctggcactttattataatttctagaagttggtgtactttttaactatgatcattatttctgatcatacagttggtgatgtaaacagtggtacctaatgactccctaagcctcaaattatattaaaagacaatgagcaatatctaagggctaccaacaacactaatattccttagaatttttcatttaattatttgaagagaaaaacttgtaattgtgaaggtttgaaatcctctttatataatatttctaagggaaagataagagttgtagtttgctgaaaatctgttcaattagttcttctcaaaaatttatcattttagggcatggttttcttaatctattaaccattttctgaaaaacgtcctaagatttataaatcataaaaatgtttatgtttatttgataatatgtagcagaaatagatggacctactgttgaaaattctctctcagtaaaacattagcacctcttaataaagggaataattgagtgatttttttctcagaaaggtgtctcagataagagttgtagttgctaagaacaatgatgtgctccaacaagtttctcattaccatggtgacttctcttcttttaagttcaacaaatcatcctttatacttgatagatgtttagacagagtcaacacttagaggctgcatctaaaaaataaaaatgcctcacaaaacattgacacaaggaattaaattttataaaactggctaactttgggcccactggggcatgagggggaggatttataggtgtttcagtagtacttagtgattctttattagccatgtggaaatgctaaaagttttacaacccgaattctgtagttttaatttgtggcaaatatccttggactaagtcccactgagattctcaaatatttcaactatgacaagcttcaaatttttttcagaaaatatgacttgttcatatctcactttggaaaactgtttgatttgtttatactacaaatcggagaagcaagtcatctcttattttgtgatgaattgtttttgtcatgtgttctcctatgacttagagatcctagagatttctacaaacaacagcttttagcctaatctaggtgacaatgagacaaacacaataagaattttaaataaattcagtgtctcacaacagaatcacatcaatctagagaaatgagaaaatgggtcaagtagataagaaaatctaacttcctactgttggaaaataaactatttaaagatcatgatataagtaatatgaataccagctcaaccatactctgtatttttctttaacattacatactttattgcttccattaattgaattttctacgattctattgaatttaccagtctatattgttttaattaagcatattggtataaatttgcagtcatttataggtgaccaatacaaatttttttttcacttgttttcgcaaaagatagataattctggactcacagatctctagacactgttcctggtcataacaggtattcaagaaacattggttcccattcctatacctaacaccttctgcacattacaggaagaaaaacatgtgatccttgaaaaacttagtctggagaataaatacatgaaaaggagggaaaatagaaaaattacatgctaagaaatgtgtactgcttgagaactctttaagcaacaaaagtgttgtctctattaaaagcagacaggtgaggttacctgagaagaaacccgtgttttcatgttcatctctttaacatggggcaggtccttaggtacaaaacagatctgaacttcttgctttctgttactcttaatttaactggctaaatcagtaatatgactttgcttttagacagttatactagacagatattttattgagtactctttgaatttagaaaaacaagggtactaaaatatgcccagtgatgtaggaactatgtgcagttggaaggactctttgccaaaactctaaggaatcttgtggattccttacaatgtgtttcataattgctacctgggttacatttgtactaaaatcctttcttcataggaatgatcttagagttaaataattttctattagtcttttaactacctcctctctataaatttttaaagaaaattcacttaaattacttttagtatgggagattgtaagcagaaggccccatagattttggatctgtggtagcatgggaaattttcttttctttctttaaataagccttattttagaaaaacaaatctctagctagctagctacatagatagatagaagtagacagagatatagatataggtatggagtagactctaatatgtctctatgtatatctatgaggaaaagtaattcttagtctaattcctatggaaattagacattagaataaatgctaatatacctagcacagttctctactctgcaggtgcccataagctctttattttttattcattaattcttcactcaaccacccaggatttattaaacattctgtgccaggcactctgctgggtgttagagatataaagataagtaagacttggtccctgtatttaaagactcacaaagcatcctaaggctagctccaattccttaagtcatgcgtatagaagtatagagagatcactatgattatataattaatcagtcctataaaccatattttaaaatcctaacctcataaatgctgacccataacagaggttcctcataactagctgtaaaaccataaaccagtcctttaatttctcaatgcattaagaagtttgatttgtaaaatgtggtactgaaactaagatcccttttatatttgtaggattgatctgaaagtgactactgattgaatgccatgttgatgtggatgaagagaggagttgaaagcttgtcagttaaccaacagaaaaaaattaaagttcggtggaataagaccaaatggacaatgaactgcccactccctaaacctcccacaggcacataaagtgactgccaaaaagtgcactctcagttgtctgggcacatggaaatatctggcacagtctcttatccattaaaatcctaaatatattaattaagaaccttgtctttggaattgcagaaccaacttcatgtgtttcatgtggctttaaactgcaaaattgtcaatttataagcttgcagttgtgccaatggaatacataaagtacataaagtacaatggagtatataaagtacaatgtacataaagtacataaagtacaatggagtacataaagtactctagtttgaaccagaagttttattaaactattggatagaagaaaatggtccaagataagaacatgcaaaatccagaacatgaaaaatgctcattttacccaggataatttaaaacgtatacaatttgttagatataattgttgatgaaattaataaagaatatcaaaaagcccattaggtagatatttgttaatattaaacacagtcttatgacaggaaatatcaagaacaaggactgcattttattcattttttgtttagatgaaacttacataatttaacttttctttattccataactgtcaggaagcttagtgtaagatttgatgctcattcctagtaactggtaactatttgtgctctcctccttttcttacatttgatgttattgtttagtgtttgtcccactttatgaatgaccattttttaagctttcttaagtcatctttgcagaggtcatatttaataaaaaaaaaagtctgcctttgtctcatcatagagctgaacagtgttccttatgtggagtaggagcttaacacatatttgccacattgttaattcattgtgaaggatttcataaataaacctagagaaaaagatatccactaacgtattaaatattttttaaaagcaagttcatctgaaaggagcaactatgtcttattatcttaaaacttcaaaggaagtttttctttaaatgtaaaacatacctcttaattccagaaagactgatccttcatttggcttttgtgcattttagccagtcttggctttctaaatcatgttgaaaacaaacagaccatttgtgccatgtttgctgttaactaagtaataaaccaagaggatttagctaattttttgaggtcattaacatgatgaagttaatcacctgagttaagacatatggacattttaccaaaaaaaaaaaaaaaaaaaaccgctcaaatggtccttgaaataaggttaaatagatctaatttatgttaaactttaattaaccatatgcactactgcgtgataatgtgcatgcatatgttgcttacattaattgctttcataagttaattactgcaacacactttggcttctgttcatttaaaacttaacaaatgttcgcaccagctgtggaagtgattgaaggcaataaatgaacgagtaaaccattggtttacttgtttaaattaaatctgctatctcaagctgtcctgtgtcttaatacattagaaaagacacttgggaatcaatgatcatgtaattcctattttaatcactgttagtcatacttaaagtaatagggacattgaacttttacgtttgttggctgacctctgctttctatagtttactgggccatcattgactatggtttacttttattacagcagaattgagctacagtttcatataattagatatttgtctggtccttgtataaaagcatacagactctgtcatgcctgatgtcttttattgcccactttaactggatactaaagtttgtgtttaaagagatgatttatatagacaaagaacttcttctaaaaaataatagaattctattttattgaaactaaagtttacttttttattacatcatttgtctctctgaatctgtagcatgttggccaatatagtatgataataaattactactagaatacctcatatgaaaacttatatttttcttgactattaatttgaatcacttttttaagaatcaaatttcaggatatctggttaatgatggtgggttgaacacatacattagcctctgagccccttctgaaaccacatcaaaatgaatataaagaggtcttttaaagatcctaaatcactaggacacaagaaataaaagagaacacaaacaaccctggaaagcatatggacaagtggtaactgacttagcagaacctagaaagttaaatcctaagtcagcaggtgggaaagccaagaaacctgatttatattgcagaccaaaaggcgaggaactagtggctccaggcacctctggaagtggaagcgaagtgaggctaaaacaaaagccttcttgtaaatttccttaagaggcatttagacacccagggccccttcccaactctgcatgcgaggtaattgcctcacactttgcctcacactttggcaaaaattggaggacgattctctggaaggcctgccagagagagcttccagattgtagtccccaaaggctagagttgagggaggaatactggactgaaaacaggcaggtaaaatgaaagttaatacattacaggtaagctctccctcacttgactcccaaaaacccaccaggcactggaagagccttctctcaggaatctgcagcccaagaataaacacctgactgcatagaaataagggcagaggggatgtggggagttcctcatgaaaagacccagccagattgccctaaagcccatctagctaacagagcttccaattagcatctactcttctcagtagctggcttatctgaggatggagtttacaaggtcttaataatagaaacattgaatatgaattataaatctgtcgggtgagtgagagctgggacatggaaaatatgtgtgtttgtgtgtgtgtgcgtgtgtgcgtgtgtgtgtgcatgtgtgtgatgagcgtggcagggaaataaggagaaagggagctacatcctcatcttcctaataggaagacaatagatgaggcctaagcctgaataactgagaagcagcaaataggcatcttatttagattttcttttttaaatcagttagacctgaaagcagttgacttgggagcaggaaactatgtgcctctctcaatgatatgcatgtatcactttgacaaaaataaacacttaatttaaaattataatagatgcttacatagttttcattttaaaaacaaactttaaagagagtaagagaaagctgttattctttttttaatcaatttcccatacttgttattttataacttattttcatgtagatcctcctgattatctgctattttaagacctacatagcctaggaattagcatttttggacgccttgtcctacatcatctcatatacggtagcttaaaatgcatctatatcctgcataaattatatgtggtataaaattaaagagagtttttgtaatgttgctttttgaactattatcacttcaagaaactcatctactttatgacttacttgttagcattgtcagcttttctgtgctgtattttatactaaaactgtttctgaaaatgcctgaaaaatgtttcttgaaaattcatttaacattgtctttctcaactaagaatatatctgccaattgactatgatttttataaaacattaattatgttgctttaaaacaggtttgaacataaaaaacaaattcaatgtcattctagagtaataaccctcaagaaaataccaggacaggagaaaaatctgaatttttaataagccaatatattttggagtatgataaattaaaatcaccttcagatgctgagattaaaaaaattctggacagaacttaccatgttaaggatttaaaagttttaattacattaggatttaccttaagagatattatgataactatagataagagccaaaaggagacccatgagattagcctttcctggccggaatgttttatctctctgcatctgattagtttctatcatctgttgaaggattatgcctttgcttctgtcgggatgccatccataattcttacaggatgaacttcccagtctgttggcggtggaggggatgagggaggttaggaggcagcaccctttttcttctggagatttgcaccttgcttctaaccatatcgtgtttgctcagtctctgctctgagtacttattaatgatctgtcatctgtcacaggtaattcattctacttgattgtttcaaattagctctagtgagttgaccattacttatcttccactccataaacctaaatcttgagatccttaaaaaataagtaaaaatcatgctgcaaaaatacaatgtataaatcaattgcatttctttgacttataaattgttactttctttaatttgattacactgaggtcatgtgtctcctcctaataataatagtagccatttggtagaggattttatagtttacctttgcattcacaaatactgatttatcattactatgagccgataattattctagttttaggcaaggtccctgatctcatagaatttttttcttgaaagaggctatacaaacaataaacaagcaaataaatgtaattaaacaagtaaacaaataaatgtacaccatctctgagcccaggagttaaaggctgcaatgagctatgatcatactactacactccagcctgggcaacaaagggagatgctatctgtaaataacaataagaagaagagataaaaactgggtgtttaaggaataaaggcatgtcagaggcatgaagatcctactttagcttgagttacggggtttctctgagaaggtagcatttgaaatgaaggcagataatctgctgaacatacatctagggacagagtgttccatgcagagccaatagaaaggccctaaattaattatggcaacctatatatatcaatgatgatggtgatgatgactgatgatgacaacaatgataatgataaaaaggaagataatgatgttgatgacggtggtggtggtaatgatgataatggtgatgatggtggtgatggtggtgatgacagtggtgatagtgtgataacagtggtggtggtggtgatatcctacatttataagtgtagctcaataaaactaaataaaatgcccacggtcacacaattagtaaattatatagatccctagacaaaattatttagtgacaatgagatttcaaaggtgatctgaactttggccttttggctgttatatcagaagtgctttagataattgccatatctttgcaggaatcccctaatttcaaaattcatctttaagtgtttcctaaattatagggactaatcctatgctgaaggaatcctagtactccatcttggtaacaggaggctctttctcttttgtctgggctctcatagctcagctatgttttttcactccactgatcaacaatgtcagtcaactctgaaagcttggttttaagcatctcacttcttattcttgcaacagtcactttagtgtccccaatcccactaaatctttggcccactgaaacctctaatacagtgacactgacaatacccatcacctcactcaggtacttactttcttcttttaactagtacaaattccatgtaccttcactatgacactcccttgcaatgaatccgctttctcaacaaaacttccaactttaactgaatccatatattggccttgttctatcttttttttttttttttttttttttgagatggagtttcgctcttgtcaccaggctggagtgcaatggcgtgatcttggctcgctgcaacctccacctcccaggttcaagcgattctcctgcctcagcctcccaagtagctgagattacaggtgcccaccaccacgcccagctaatttttgtatttttagtagagatggggtttcaccacgttggccaggctgatctcaaactcctgacctcaggtgatccacccacctcagcctcccaaagtgctgggattacaggcgtgagccacctcaaccaaccagcgttgtcctatctttgtcttgtgcctgagaaactaaacattgggaaaatcacataatcatgctgactggtatccctttaaatttatgaccatatgtctcaaatgggtcctcattcccctgctaagcatactgccggcactcagaagcagctgcatcaaatcttctcttctttgcatgattagttgtttcttttatcttgtatcattctcaccagctttttgacatgatctaatatatccctttaaaaacaaaacaaacaccttggctctgttatccccatccagcttatgcctatttctctgttcctctttatagcaaaacctctcaaagggacggtctccacttccttcatctcccattcactgtaattcattcctactgaggttccactctcatcttttcaatgaaacggtttttgccaaattcaaaatcctcactgtaccaaattcaatgacatctcatctgccctcctctcactctacctcaaagcagtattccatgctttggatccagcattccagatcagcctccttgaaactttcttttcttgcattctaagactcaacactctccaggttttctcttccctcctaggagaacccttctcagccttcttaataatttcccttaaatggtctcagtcaatgctatgtcttcaaatcccatctcttctggtaatgcccttttttatttgcttctctgatctccagactcccaactagaagcctctctgacatttccacttacttgtctgagagtcttctcaaacttggcacagccaaaacagagtcaaccagagtcttgatgtcacccaaaaaatcagagaaataatttccttaatcatctcatctgaaataacctacccacctattctctatcccattattcatttttgttttcttcatgtcactatcagaaatttttactcacttttttattttcttgtgcctgatctactttcccaccagaatgaaagctctgtgggggcaaggacaaggagctcatctgacttattctggctttagtctcagagcacaatacgatgcctgattcatagcaaacactcagtaaatatttattataaaattaattagaaaatgaatgaaagaaaaattaaacacttcaactttaacattaaatttaattcaaagatctaagtgaggggttttcctaaaatgaggaaaggtagcatagaattagatgttgtattaaaatgcatcacatgcaaagttttaaatatataaatgtatcatttttccaatctcttacaactgaaattataaccacagaaaatattatattttgtattctataattcagttatctgatttttaaaattaattaatctacttaactcattaaaatataaatgctgtaacaaattcttggcttttgtcaaaatctgtttcttgcctccgtcttccacatgtaattcaatttctctgagccttggttttctcatctttgggcttgatgacttccagttttcaaattctctgactctgtcttaacattatcatcatacagatgtgttcttgttcatggatttgcttgtctctgtaattttctcacattttcatttgtgtattttgcataattgagatagaactgcggctgtaactgtaactggagctatatgcgtctccagagagctgagagtacaaacaaaatagctaacttataaaaacaactattcatattgataaattacacatatgagctgaggatttaaaagagtaaagtaaaattttattgtagtaatttacaaataatgctctataaaaaggaattagtgctttacgaacccagagatgctttaaaattctttaatagtcactctctcctcaatttttttggatctccagggaaagcaggacttgctcctgtgtgatattctgtaagtcctggacaaattcagctgccaactgaagtccattttacttcaggcaaagaactatgtcttcctttgcttgaaccagcaagaatctgccctgagggacaggataacaaagcttcacaggcatgcacccaccagaaccacatttaaaggaaagttatgcttgcctctaccacagaaccatatgtctgtaaaatatagcacacattaccaaaataaatataattttgatcaagttaaagtatgtttcaataaaaagtaattttcttttcttctataagccttttaataattctttcctatatcagtttggctatgtaaaagcaggtggattgtgcatcctctcccaaaatgaagaacaaaattgaacaatcagccacacaaagaagtcctcagaaagctgcatgctctcaaatttgccaattaacaagagaaaaatgtgtgttactcttttaagttctctgttattatgcatgtgtaaacctcattttaaagtaaaattttttttattttaatacataaaatcaatacagggttaaagataatgggagtttttatttaagttctacataaaggtccaaatatatttatgtagaccccaagttttctcaatagtctatcaccctaatttgaccatgatggagttaatactggctatgtagtcaaaaggctttataacttacaattgggaaatgtgagcatatcactcactctttctaagtctgtttttatcatgttcaagaagtatcaccctgccctgaccaccttacaaggttgttctgatgaaatgagatgatgccagattaaaatacttggcatacaaatgaaaagttggatttcttgagcagagagcactgtgtccctagtaactaattaattcattaattaagacattaatttaataaactaaagcatttcctgaggcactggggcttcaagaataagtaggacaaaaaaatagattcatggttgcctaagcctgggaggtaggaatgggagtggaggcaaatgatcaggggacttctatttggagtgatagaaatgatttcataagatgtggtactagttgcacaattctgtaaatgtactaatatcataaaattgtacgtttatttatttatttttcttgagatggagtctcgctctgtcacccagactggagtgcagtggcatgatctccgcccactgcaacctccaactcctgggttcaagcaattttcctgcctcagcctcccaagtagctgagactacaggcatgcaccaccacacccggctaattcttgtattttttttttagtagagatggggtttcaccatgttggttaggctggtctcaaactcctgacctcaagcaatctccctgccttggcctcccgaagtgctgggattacaggcacgagtcaccacgcccagcaaattgtacatttaaaaccattgaattttatgatatgtatattatacctcaagaaagcttttttaaaaaaataaagcatggttcctaccatcaagaagcttatagtcaaatggggaaaactgacatataaacaaaagaaggctacagtatgctagagaaatgtggatgttgttgttgttggcctaaagttatacataattgaaacttcaagtgatttaagtattttaaaagaaacgttaaatacttctaacattagtaatactgtttcagacctagaacagatttcgtgctctattgtaagacatacaatatctaaaacttgcaaaaactcattaaccctgtaccacacttgtcatatatgagactgtattttaagaaacaaggccttgacatgccttgtctggaaatgttgccaatattgtcaatttgatgttcgttgagcattacagaacgctcagtgcttttggcgagcgggtggaagctgggttgaggaggagcgtctgtgccctggcacacttgattgcttgaacccagtccctcagggacactagctggcagggctcccgggtcatcacaaagcaagcaggacagaaggggtaggcagagcagagactgccaacccaccacagctgggggctctccttccactcggagtaagtctgcaattccagcccatgcgttctttctccagagacacttttctgctttagggaaatgcaaaggacacccttactctgggtttgaaattggatttccaactctgtcaagcatcctttatttccagaagttgtcctagtttaaatcctaagcctccaaactttttcttcaacgtacaaacaggtcctccttggagagacacctctccactaagcacctgcctccctgaacatgtattgtatattgttttcttccagcctattccatacacctcagaggagagaagcctcatgtatgcttccgcactgattaatttatgcagtctttcactcactcaacacatacttgtcaggccttattatctacttaaacttgatgcaagcctgcaaatcagagagtatctctggtatagaccacataaacctacctacacatctcccaactgagctggtatttggcccctggctgccccatgagaacatgttcccttagcagagagtaggcatttctttcttttcacgtctatgaagatgagtaaaatgtaaaaatgggtagaaagattaatagcaaccatcatttacccattggttttctctgttttgtaactaaatgtgaaggcagcacataaaaaacgtttattctccatggtgtctttctctctgagtcattttaaggtttgaaagaaatattcattcttcttaaaatgcctctctgggccctagttttctctcttataaaatgaggttgttgtattcacaacctccaagcactctttaagcttgaacattctttgatgttctgaatcatacccaaaattcagccctttatttcccattgagaggtagagatttgaagcagaaccagaaagggcctgcctattcccaaaaagaagatttaataatttgacaatgtctaccaaaggaaactgaatcattatgcattattatcattatgcattattattgagacggttattatttcagccaaattattaacatttcagcaggaaacttttttgcctggctctgatacttgttttcatgcccaggacaggtgttgcctaacctggcctgaatcatatctgactttagagtctccccagccctactcatgccccagcaagggctgcaacagtcatgtccagtcactggtgatgcgatcactgggacaataggaagacaggcccagtgtgactaggattctgggatgctaccagctgtcagtcaacactaccagatgcggacagagatggctttaatgtgtatgtcctagtaaaccgttttcgtcagaataataaagaccgctaagacaaatcacttcgattgcttaataatctgcttgctctacaaagaagcagtatcaggtagcaattaagcacaaggattctgaatttgagtctacctgtgtttgagtcatggcttctgcacgtactagctctgtaactcttagccttagtgttccctgttggtaaagggggaataacagtaaagttgttttaacgattaaataaggtaatacatgcaaagtatttagagaaatagctggcatatgataacctgcgttaattatctgtatgctgtaactccctgtgggaaaaaaatttaaattaaacttaagtcataaagaaaaaaattagatgactgaaaaaaaatacggcataatatgaaggacattagtgtcgagtggggtcttattaaacaaagattcagaaatccctgttccataagatggtcatcagaccgaaatgtttataaagtacctagactaagatagatctcagtgagtattaatttcctttccctgtctaatatcctcaattttatttcttttgccttctttttaaatttatttttctgtttattttttaaccttgcttccttctatctgcatgcataggatgggtgttgcctaacctggcctgaatcttatctgtctggagagtctccccagccctgctcatcttccttccttccttccttctttccttccttccttccttcctttcttccttccttcttttcttccttccttctttcctccttccttccttcctcctttcctccttccctccctcccttctttccttcctccttccctccctctcttcattccttccttccttcttccttccctccttccctccctcccttctttccttcctttttctctccctcccttccttccttcctccttccctccttcctttccttcttccctccctccttccttcctccttccctccctcccttccttcctcccttaattccttccttcctgacttcctcccctccctcctcccttccccacccgcacctccctccccatctctttctttctttctttctttctttctttctttctttctttctttctttctttctttctttctttctttctttctttctttcttttctccctcaactactgattgctggtttccttctccatgccaggcactctgtggctccttgggataaagttgggaaacaaaccaacattgttctgaccctcttatagtctaatgcggggaaaagttattcatcagattacctcattaatgaatgtgtaaatacaactttagataagtgttctgagcaaacacaatgttgttttgtaagggcatatgtctgaaacaccatgcctgtgagaggctgtgagagagtttacccaacccataagtggggaagggcattttctgctaaagcagtaactcctacagagaacctgtggcctgagctgccattttaagaatgtgactgaagctcagggaggcaggtaacagaggtgctaaggctctctactggagagatttcagagaaatagaacaatatctagcaaaaagttgctttgccttatatataaccaaacagtattttatgatttatttctaaataagagtttattttccatttacagaatcacacattttaaatgttattcactgacctgtagtatccaaattaaacctatttctcttattctgcataaattaatgttaatattatcagtaattgcccccatacataccaaacatgcatcgagaattgtatgattactctatgtaaaaattgagacgtggaatcattcttgacaccttagctccgtacctgccaagtagacataaggaggctcaaaaatatatgctacagataaaaaattaaagagactgacagataaaagaattaaagaaagcataacctcagtggcagagaaattctgctttcagtatactaatttacttttaacttttcagattattttgggaaaatttgaatacagaagtgaagcttcaaaaatatctgagccttctgagcagaaatacaggtttctttagaatagtttttcctcccgtgttcactgtggtgctatggggactctacggtgatatggaatgactgcggtaggggcagtgtctaaacctaacaagtccagtttaatttgccaaaaagtttctcactttgaccttggcctgcatctacctggataagcctatttggctgatttcaggaagaaaaatggctgtagtttttaatgaaaaatcacctttttgaagtttgtctttcactttatgccgtatttggcatacttggctagattacacaaactgtttaaacttacaaagctgaactgctctgaggggagatttggaaattaaataatcgatttttttatccttttcatgatcataccattgatgcaactaaaggcaattcaacattaaaacaaacacaatttctttttatttactacttaaatgtagcctgcactgttagtaatacatgttattttctcacccttttttaaattaaatgtgtggttcaaccatttttcaaaagcatccgcctcttatactgtcgctgaaagatgatcgtgcccttccttgtgccatacagaatctgcataaatatatcctaaactacaagctattgttgaggatctaccacttcagatagggaattgaacataaagaatttgctagtgtcaaatgaatgcaaagctggtctctctgtgatgaggcttatttttagttactaacaatttttgaagcctaaattacagaaaatagcaatcattctctagtgcattggctcttaaaattaatcaggcaactgggttaataatagcatatttttattaataacctacagaaacacctgtacttattcatcagaaatcttcaaaatgatattccagtcaagaagtgtcaaattatcatttgaaaattattgaataaattctaggagtagtttattactaagagtgagttaaataccttttcagcgcattcatttgaggagacacagtggcacagaggttaagagcaaaaggtactcagttagactacctagattgcaaccttagtttcaatagctactaactgcgtgatcttgaggaagttacttctctgggcatcagttttctcatctgtaaaatgggaatgatattagtaacacaaaatgactgctaagatttagctcctactttgcacaaggcactgtgcatgagcaagagagagaatgacagatagatattacatgcctagtactcttctaggatttaaccttcacaacagctgtataaggcagaaagtattatttccccctttttacagataaagacatttagaaaccaagaaggtaaacaacttgcctgaatttatcagagaaagtatcagagcctgaatttagacccagaatgtttagccccaaagtctgtcttcaaccactaatctacaatgcctgattcacacatcaacatatggctgttatttaatgagatgatatagataaaccacttagatcattgcatggttccagtaaatattcaatgagcattcattactattattagtttatgtattgtctcctttattgcattaaatacttaactttccactaagatttttttcttataccctcttttgccacattttgtgagatttggtaagattatcttggggtcaacacataataaaaggcatcacacattttttgtttctaataatttcatgcaccagagtgtcaaacaaatcaaggtcaattctttaaaaagtattcattcatttttttctacaaatacttattgagcacctactacatgcccgatattatttcaggacctattctaaggcattcagcagagaacaagacaaaggcctgtctctcacacaagttacctcctagtgaatcattttgtcattaactgaattcaaacttgagcctttaatcctgggaaatagtgctataaccaaaactgaaatcttccactgttaaacacttgagacattagcaggaagatgtttacacagcccacagccctctgtgtcactggcctttcctcatgggcttaagaaaactgcttcagagaaaacctctgaaaaacctgccaccaacctgtggcagcctacctcaaaccagcagctgaaggacagagcaaagacattccaggatctctgagaactgtatccataaataaagcccattcaaaaaggatgcactgatcatgtttttctccactggaacatgagtggatgtttcacaagtcacccattctcctcattgctgcgtggtgaaagccacaagttccaaaatagatgctgaggctttcaaattcctgaggacagaatttgattcttattcccttaagttatttttctcttgccctcatccttccaaaaaaaaattcatattctgctactatcgatatctcatgtgaaataattatattagtgaaggcttttcatatcagattatgtcctttgaacatacaaggaaaaaactcattgttataacaatatgatcattcaagatgctttttttagtcattttattatttgaagagaaatgagtttataaaaaaatataatttcctacaaatttaagggaaaagcatatgcttcttttttctttttcttttcttttttttattatactttaagttttagggtacatgtgcacaacgtgcacgttagttacatatgtatacatgtgccatgttggtgtgctgcacccagtaactcatcatttaacattaggtatatctccaaatgctatccctccccccaccccccaccccacgacaggccccggtgtgtgatgttccccttcctgtgtccatgttttttttttttttgagacagagtcttgctctgtcacccatgctggagtgcagtggtgcaatcttggctcactgcaacctctgtctcctgggttcaagtggttctcctgcctcagccttctgagtagctgggactacaagtgcaggccaccatgcctggctaatttttaaattttttagtagagacaggtttttgccatgttgacaggctggtctcgaacttctggcctcaagtgatctgcctgcctcggcctcccaaagtgctgggattacaggcatgagccactgctccccacctgatatatgtatacattgtggaatgattatatcaaacaaattaacatatccatttttctttattctgcaatactggtgtagaatattcttaagagactgagggggagaaaagaagtacatatattgaccgctcacaaattttaacatttaatctcatttaattctcataacaacactggaagtaagtacatgtaaccctcatttaaccaagtgaaaacagagattcgggagagccatgtaactgttccactttcactgacacagcagagccaggactagaccagctgtatccaaaggtcacgtcttctcacgaaccacagtattttacttcagcagaggtcatgcagatatccataagaccactgctgttcaagagaaaacagttccaaacggccttttatagaaccaattgctacatacatcacattcatattaacatgaaaaaccatctatatgtgttcctatagttcatcaaaaaactatcacaacaatgttaaagcaattatgcctctcggatgaagtgttacattttaaacaaattacttgatgattctattaaaaggaataaaaataatgtaattgacatagatgagattagcacctttccccattcattttatgatataccttttaaagacatcatcatcatcaaataatatttattacacgctgtaattcctagaagagcaggatttggactgaaaaacataactgagttacaagcaagacgtattgcttatttaatacatcatagactgctatagaagtgttatgtttttatgtaatggttaggaaaacctctgcattaatttgtagaaaaaaatagagaaaaatcaaaagcctacaaaaatttttgtacaactttgaatttaactatttcctctaagaagccaaagacacatttatttcttctctgccttaacattcaatctaattgaaaaagctaggagacaaggaaataaatatggatttgtttaatggtaaagtgcttgatatttctgttaattataacttgactattgaacaacttgcactcagaaatcttaaagtatctcaaatatttatctcatttacaacatatgggagaggaagattcctttctctttttcctcctatgataataaagaccggcaagggaatgtacagagagtttcacaatgagttgtgtaatcatgaccagtccccagacttttgagtctgatggtcttccagtctggcagtctcacaactcttcatattcctagcctttgcacttttaattttccaccagtgattattttaaccatatccctagatgactaacatccatatagcctttgaacctcagtattaaccgcagctgtatcattgagctcacagggccttctatgtaggctttcatggataatatttaataagatgatgtacagggggaaaaggtaaacaatttttctaacattgaaactaatatatatgcttcacttaacatgctatttctcctgagctttgaatatgaaataggcattgtttcacactacaaatttgaggtcaggcagtttttaatttactcttttcatgctaaatttggagtatctaaagttattatcatcatcaaaaaatatttattcaagctatactttatagaagaggggcagagtttggactgataaacataacggagatacaagcaagacttactgcttacttaataggtcattttccattttaactactttagaggtgttaagtccgttcttagccgctggtttgaaatatctaaagctcagcagaatatctctaatgaaataccaatggaagtgttgaagggtttcttactcttagtttgaaattcaattctgatagatataattgactgcaccacatccagaagtattatctgtttatctttgtgcatttcaaaaggcagaaaaaaagttgacttacctcataaagagatctcatggcatgtatctatatctctcagtccatcagtcaacatgtctatcaagaatggccatgtttattctgtcaaatattaaattatgagacttatgattgcagccaaagaggacatatctatttggaaagttatacagataagtgacatgaagatagagagtttatagttcatttttgttttactagaaacaattacagaatactttaactagaacgttggcttctgtacagtttagatacagtaaaaatatttttaaaaaacattttaaaaaacagtttcatgaaattcttagggatccacttataaaatgttgtggagagctactaatatgctgaagttttccagaacaacaagaaatcaattaacgtagcaccacatcagtttaaaaagcaatttatcaacttttcctaccaactcagggtcaaatttcattgtgtcaaaaacttaattttaaaataattgctggagtgaactttgattaacaatagcacaaatttgaaggagatgtgttaaggttccttgaggtcattcttatgagactaagaaagaaaaggaaaatatattggcttcacaaatggccaagatctttttaaaaccagctagcttacaaatccaactgacctgtcgttaccatacttcacagttaagaatcatgagaacaacttgttctgaatcttctggctgactccccaagcagagtgagcattgagtatcttctgtgattaacatataaactgttttattcagttttggcttcctttctctctgttccatgagagaaaggaaaagaaaaaaaaatctttttctttttaatggattcacagtcagtataaatttttcctctcaaggtatgtattataagaaaaaagaaagtggacattgattttatagtatttttctatacttaaacctatacccaagtaatgtatgttttatattttcaaaaaaattttccttaagttattttctatatatttcagtatttaggttatttgttgtactaatagattaacatatgccaagagttcattatcattttctttaaatagattaataaaggaaagcctgaaagagcttgaattttataaagagaagatgaagattttacatatgatgactttaattgatgttgacaatattatctccttgaaatttcttaggataggagggaagcatatttgtggatcaaaggaagttttaaacagcaaacaaatgcacatatactgtcttgttggagccccattctctctgaaaaacactttttttattttttcactcttttttggttagtattgttattggatcaaaatcaaagtagtgttccttgattggcaatgttcgtatttttttatattcattcaggaaacagcagaaaagaacacttatttttaactcattaaaattaaaactcagacacaacatctttggctttctcaaatggatgctgaaggctggaaagttgagtctggcttgcaactaatattaattttctacagcattatataaatcatctgcctgtgctgtctcacagaaaatataaatagtggaaaaataatttcctcttttggagatattgtggcttttggctctcatggtctaggccaaagggtgcaaaatagaattacatgtggcaaatagcatttcccaccatgctaagtggagcaagatccttagatccaccatgttgaaacagagcctcccatgtaaagtggtagacaaggacagctgtaaatatccttgtaatacttttgtgtctctcccatttctttaaagtagattatgaaacatcaacatcaataaatgcaacatttttctgagcttatactccatatgcatattgtagtgccaatattataaactgtagagaaaatttttaactacgtgagtatagctttaaacattttcatattacatgcatttttacatgtacttcaagccaatatttgatcacattcaattttaacatttttgctcgaaagtgccaaaattttgcactgaatgaacacatgaatgaacatttctgcaatagttaataaatcactctttccattctttttcataaatcattatgggaataaaactagctgctgctcccacaaaaattacactggaaagcaagaataacatttcccttgccctttccctcccccaataaactaaattttttttaaatggttatcaatttaatgctatatttaaccatgtaagaagaacaaaagttcttccctttttttcaaaatgctataccctctcaaatagttttttatttaaaactctcttgtacaatctttttattcaaaactctctacccttttcaaatttccaaaagagatgaaaaaaaattgcttttgttccttcaggagcagaattagtatatcacagaaatttctcttgaattatttttcaacaaggatcctggaaagccacatcactaaaaatcaagaatagctaagaaaaactaagaattttgcctgctagaagtttgatctcttgctgctttttaaaaaaatctgtcttgatagcagttttaacataactggtagcgtattcagtatcatttcttcatgacatgccactagcagccaatcttggtaaacaaactgattaaaagattatctgtcacccagggtttcatcatcctctacagtgattcacttgtttggaatcaaggcacagtctgaagtcactgaatggagttgatgaagctaatgcttcacaaatagaaaatgaaaatcatctgaaaaccagggagaaaatcctcactgattatcgccaacttgttggtagaattctaaccgtatggtttccatgcatgaatcacaggaaccattggttgcagcagagcccctcagctgtctcacttcctccagtggcatgagcctgctgctgtaccttgtattcacctggtgacagtgatgaccaagatgtttacacctgctgcagtgatgagcacacaggcatgagcagtccttccacagttgtgtgtgtgtcggagggcattggaggggaagtgaattccaagggctggagcggtagaacaattccaatctagcatgatctgtcttgaattctaagaatatgttttcataacttggaggatggccatatcatggaagggggaaacccaaatattgacgctttttgcctatcatgatgtcataaggattaatcatccaaatgtaactttctgagctctacaaaaggtcatgtgaaatcaaatttctattaataattagattagatatctgatcccaagccctcataacaatcttctctggccttttttgttactgctgcttagagctgagaatccctgttttctgaaaactttaagcctgatttctagttcctcctgccttttcccagatcccaaaaaaatcaatgttaaatcaacttgagtattttcacatgcaaaggaagtatttgaacatggaacaagtgtggatattgtcccaatgatcaggattttcaactttcttgttcttctcagatcctctcttccctcaaaaaattattctgttaaattaatttaacctcttagccttcttttgttgttgttgattttttgttggtttgttttttggtttttgcttgtttgtttgagacggagtcttgctctgtcgaccaggctggagtgcagtggtgcgatctcagctcactgcaacctctgcctcccaggttcaaccaattctccctgcctcagcctcctgagtagctgagattacaggcaccaaccaccacacccagcaaattttttttttttttttttaagtagagaagaggtttcaccctgttggccaggttggtcttgaactcttgacctcaggtgatccacccccttggcctcccaaagtgctgggattacgggtgtgagccactgttcctggcctaaccccttagccttctattaataatacaaaaagatatgtcctcccctaagatacgtaacctttcagtaattataaaagtatatacctgtgctcagtttttatttgatgatgctgtttttattttattttaatccacagctattttccacgaaacatcctatagaagagatactttcttagggatgagaattatgtattacgtacttagaacaagggcaaagtttaactcttagtacatggcaaagctgatctcatccctgaagagtgtaatgtacttctagaacttcatcttctatccaaatccattaaattaaaagagattgagggaactgagtggaatagtcatcaacatttcactaaataaaatgaaatctctctgaaattagtttggcttctacaactctagctagacagaaacatttgtccctgacacactgaagtcattacttaagagcaattgtgcatttggggaaaaaaatggccattgtaagtttgcaaagttgaaggtaagaaggatggatggtgaaatggaagcaaagaaggattcagtaagattagtatttttggataaggatagttgatgtgtcacacaacagagccaacttcaaagtttgacttcaaagaaaactctccaagaaaacacacttgtgcatgtacacagacacacacacagaaagcaaacacaaacacttggtagtttctccctttcatttgtgctaacaacttttccattctacttggtctaggattttcttttcctttttgatatgcttcaaattttgcatccttgaaaataaattttattagacatgatgctaggttcactttagacccttgtgttgtacacttcttaataaacatagctcataacttctccttctagaccacagtagtctagaatctgtcttgccactgtgttaagaagcaccccaaaattttagaaaatatttttatagtggtgtaaaattaccttattaaaatcagaaactctataaaatattttagccttttacaccaatgctaaattctaaacctaatttcatgttgtaaattattttctagcttaagctgaagagtttagaccttgtgacaatcaaagccaactgatcaaattctaccttctttgaggtgccctttcttggatagtaactgcttctttcctcagtaattttctaactagcaaagctcttgaagacctttctcgggaatcttccctaccattcatcccttctttatcatcctgccaaaataatttcttcactgggactttttgctataattacctcaattttgttgttttaacttaaaagtaataaactcatatgctacatctagattacaaattccggaaatagagattgaactctttcctgcatttcctgtttttcctgaggatccagtaatgtgctcttgaatgcaataaatgcttactcaccctctccagtaggctatttccatctgattctgtcattcatcccttcagtgattatttgttaagtacctagtgcattttgagcacactgtgtggttctagatacacaccacatagtgaaacagacttggtccctgccctcgtggaccttacaaccccatgatgaaggccacataacaagaaacttctctggacacacattttatccagtgaagatgtttttaaaatgtgattaattaacattttttcaggtggactttagcctgacttacagccaactagctacaaaccaagatttctttcttgtgaataacaatttaaattggcaacttgtgaatcacaagatctttccagtcctcactgaatgtgataaagccatttatgttgaacccagtgtgtgttttagttgctttctcataatgtaggaaatgacatcaacaaattgtaaaatgtttaatgactgaaacaacaattatacttaaattccttttcaaatccaatgaatcatactaacctgtaacctctgtccctctccctccccacagaataagagctcctctcttaaggcagcccccaccaatccctgctgccccctttaaaatcccttcatgcccatcccttctgtaactaagaaatcttggactgtttgcaccaacttcaagaaacatgaagaggtctcacatttttagttgcctttggagatgggagcaggatagacagagtcaggagtagaatgagacttcctcaagatatgtatgttacagaattttgacttttaaagattgagatgtacaaaaacttaaaagaaaaaatatgaagaaaatgaagagaggcagtatggtgagaaaatgaagtgactggaggagacagcacagccaatatttcactcacaatcattagtctttatctcatctttctgcaccccagattttccctggggtgacttatgaaatttcaattaacgaaccaccaacaaagaacagaggcgaaactgagtcaacaaaaggctcttgatacttaagttcagattccttggcaatctttcaaagtttttctttggcagacctcagcacaaccacgtaagaatatgtctatgtctttgagttcatcttaatgttctttatacagctttcttatctgtgacacagaacaagtttcactaaaaccatatcaagcttctggttccaactataggtctgtgttagagagccacacctgaaaaatcaagcatgtcagatgcagacctgtatgcctttactgctgttcaagaggaaagtgtaagtgctgtgggaggaaggcaggaggaggagccagaggcttggtaggggtgaaggtagatggagaagaatgactaaaagtaagtgcaaaaaatactgcaggaaagcagtttgagataactaaggcagcattccagtgtatccacttaaggaagggttgttaatacagctatacttctgtggataagaaattaacttactgtataattgcattctcggaagatctttcaagacttttctgtgtgtgtgtgtgtgtgtgtgtgtgtgtgtgttgataaaaactctcacttctagtaaacttaggataataggctatgtcttgctaatctatctcactggttattgaaaaactgtcgctctgtagtcaggggtggcaggaatttaagttgaaagcatgatatgactacaaaatgtgcatttctagatacgcagcccttccccaaacagacttggcagaataagttagtttaaatggttggttccatctgtgtggtaaaattgtgtctgacatctgtttaaaatgagcacaagatgcttgaaaaagaagggcaagcctcactgttgaacgtgatggaatctgggggccatggccctcgtgtgtatgtacaagctcacagctcacacggttcaccagtcttgtcagctgttactacctttttatctggatcctgttaacttgagatttgttcttagcttatggaaaaggtctccctgtgttttcttcctccagataggagaagtctcttggcagagttcttcaaaggcagttaagtcagtagcatcatggaaatttggcagcaagttgagtaccagagcagatctaaacgttagtttaggttattttcacaagcaattgttccacaatttttcatccctttattttagcagttagcataatcactcacaacagttcctaaagtgaacctgcttgtccattcttatcattgtgtagtctgaataaccatgaaatttaaatttaaattggatacataaacatggcaaaacatgaataaatcatccaaggccttctgaattgttcagttttcacctgcttaaagttaatgcaaaaagtcaaattgaggcctttgattaaataaaaaattgaacaactagattactttgatatatttcatctctggtaattttgttcttttgccttttaaatcattttaaattgctttgagtgttgccaaaatgcatgctcaccctaatctattataactataagtaggaactttgtgcctctaattaaaaaagaagatgtatattctaggtgatttaatccactctatatttgttgggttacttgggaagtgttgcagattaatatagaaggaattaggacttggtccttgaatagtgtctcaaatattaaagatcttgaaactgaattattttgcattttgtactttgaaaacattgtgatgcaccaaagtaacataaaactgggtcttctaaggttatgttttttaaaggtactatgcaaaaacaataattcttgcctgtagtcccagctactagggaggcagaggtgggaggaatgctcgagcccgggaggaggaagttgcagtgagctgagatagcacaactgcactccaggctgggtgacacagagtgagactccatctcaaaacaaaacaaaacaaaacaaaacaaacccagtaattctcaaaataaggccaaccttaaaatatcccaggtactaaatcatttagcctataatctgatatcactgtttaacagaaacttttccattgctgtcaactaaaaggtaagaaaagggaatgaaactaataaattctgagcacatgcttcgtgttggatacatttagtgctttacatttgctttttgtgctaaatcctttactaagtttatcatttcatgcaatacctgcaacaacccagtgacaacatctttattttacatatgaaagaaacagactcagagaggttgctcaaagccacacaacaagtcagttatcagaagaagaaaagatccaaaccagagccaaaattatttagcagcctcaaaaaaattgacttcagtgtctaaccttccctcgtgtttaaatactctttccaggataggagatgtaattaaaacaatagctaaacaaaaactcaagccattatatcccttgagggctggggggaagatttaaattggttttgttgttatttggttttttcttttttctttttttttttttttttgaagcttctttttaaccctttttttctttctttctttcttttattttttttatttttttattttttattttttatttttggtagaaacagggtcttgctatgttgctcaggctggtctcaaactcctggcctgaaactatcctcccacctccacctcccaaaatgttgagattacagacatgagctgctgtacccagcctttgcttttttcttgacatgaaatcttacatgcaaaacctatgtattcaacagattaaaactgagatactcttgttggaggagaaaaggggcaaggtaagctgaactcctgaaactctggctttcccccctcccaccaagatgggcttctgacatctcagaaggaccactggtttaagttatgttaggcaatctgaatgtataatagagttactgttaatagactatttaaaggttcctgaaaagtaagcatggatgaaaacagatgtttagagcactaggtgttcaggcccgttgcattacagtgcccagacactagcagccaggctgggctttgcctctactttagagcacagccttgagtgcttcacttcgccttgtgggtctgggttttctaagcttcataatgagtaagggtggacctagagcagtagatctcacccctggctgtacatatgtaggaagcttttttttttttttttttgagatagggtcttgctccgttgcccaggctggagtgcagtggcacaatctcagctcattgcaacctccacctcccaggtttaagcaattatccagcctcagcctccctagtagctgggattacaggcgcgcaccaccacacttggctaatttttgtgtttttagtagagacggggtttcaccatgttggccaggctggtcttgaactcttgagctcaaatgatctgcctgccttggcctcccaaagtgctggtattacaggcatgagtccctgcacccagccgtaggaagctttttaaaatgccaataccaaggcctcgctcccagggattccaatttactttcatctttggagcaagcctgaacatgatcatttttaaaatacgcccctgatgattctaatatgcagccagaacggagagccactggtcagggtgatctccctgtttccttccatgtctacactgattgttttcatcgaaatgctaatgaggatatttttaaatgcctccgttccatagcatcgggagcttaaggaaagttcattcttatgtcactctcctagtgtccatattattcatggactgaatttaatcacatcatggtcctttttcatagaaaacctgagaaaaaggtgggtagcttaaggagttccccaggaaaagatttcattcttgttctcatcttttttttccaggtcttttcaatgttttctataaatcactcttaaatgttaagtcttacaaattataaaaaagaaaaattctgagccctccttcagaatgactacattattttctagattccttagagcaagtgctgtgccttatgaactgatgtgtccctggagcctaatatagtgggtgcctggcacataataggtgctccatcttttttttttctttttatgaatgaaaggcatccaagctttcaaaattctgactcatgttacatggaaagggttcccttatgaagctcaaactgcccattacaagagaacagtttgaacatgatataaaacaaatgggcagtagagaggtagtcaatgtgatagcctccccatccccatcccaaggttaccagttgggaagatgagtggttgatttgatagggattgtttcacataacctctttataacatatagttagtggaagcacaacttactgttgtgttcaatttataaacactgtttcacaattgtttttcatgtgaggtttaatatcctgcctgtctagccccagacacccattctacacatccctccatcatatccatgggcacaatcacagccactcccttcatcaaacatgtgctcactttctaggctctcactttaagtgtctatctgtaagctattaaagtcaaacatttctgctatattgatatggttatgggatttagattattttgtgcaggtatattaaggtaaaacagaatatgaaaaccatatgaggcctaacatatgaggtacataataaatatgtgttcaattaatgttatcaggccttacactaaggtcaagaatcaggtaacaatcccagtggcataaatggaagaattgccctagtaagtacaatggaaacataatttcttacattttcaaagtgcaatacattatctgaaaacaggaaaaaatgtggtaaccatccatagtaacacattagggagagatgttaatgttcctataccacagccaggatctatttcactaacagcaccaatgaatgcaaaactttatggaagcctatatatatgctacctgtttatggcagtaaacgtgaagagaagaggtgtttatctttctcttttctcctgaatacttctgaattatatctcaacacttagaatattagcagccagccagtactctttgttttccctctcgaaaatatgaactttaaatcagatatttttgcaggagaaaataagtttagtaatctggggtcttgttatgaggcagaatatgcatcaataagcagaataaaatgcattcagctttcaggctaggcctggacaataacgaccctgcaaatcagagctagaattctaaatgctgtgcctgggaatctgcccagggccttttgggctctcatttttgctgttttgtatttgatatttcatttatatgcatcaaactaataccaactttcatatttgggcaaggaaaggaagagagaatggttgctagaattaaagaactccaaggaactctctaaggaacatagctcctaataaaggtttcagagttccatatttttagaaaacatgtatgtattgattatctacaaagacattcaacacacctccttaattctagaaataatgctaccagttgtggatatcatgaaaatattttaggaggcataatttactacagcatatctgagttgaaagagtagcgaacaatattcttttggttatgtaatatgctgggcagccctgagattcagaaatgttgaggaaaacaagaattcttccccataaataaatcacactgtctcattttagagtttacagtataaaatgatagtttttatcactttttaagttgctttggggaaaactcaaactgaaactgttggtgaatgaaattttataaacttgagaatccgggagattcacgacacaattcaaacctacttacaggaattatatcccaaagcacagaagtgtgaaaagtgtcttgagtgtgtttaatttcttaactaagctttcaacaatagctcttttcatctaagacttgaaaacaaataaatgtagagagattttatgctgctaaggatttttgaaaacatgccaagctgtaggccagaagggaaaggaatgctttgatacacgctattttgcgtatgctgagtttttatctctaacagagtaggatcatactgaaagaagcctgacaacacacccttactgacattattatgacatcagagcccctcaaataatgggaattactaacataaaactaagtaaggaggagaaagtgaccaaatgatcccatggccattccatcacagtatcactagcacaaatgatccagatctatcaataagcaactaattaagacaaactttacactgcccatgatgtcaatttataaaaatatttatttgtgaaataaacatctccagtcccttattttcttaactttttaataaatatttaagtgtttccctcaatattctatttctatttcagtgtccccaaatacatttgttgttgttgttgttgttgttttgttttgtttttattttttgagatggagtctcacgctgtcacccaggctggagtgcaatggggcgatctcggctcactgcaacctccgcctcctgagttcaagtgattctcctgcctcggcctcccgagtagctgggattacaggcacccaccaccatacctggctaatttgtatttttagtagagacggtgtttcactatgttggccaggctggtctcgaagtcctgaccttgtgatctgcctgcctcagtctcccaaagtgctgggattacaggtgtgagccactgtgcccaacccagataagttacttttatacagaactgttatctaatgaaacaaaaaaagactcttctatccaggcatggtggcctgtgcccgtagttcccaccactcaggaccctcttgtcttctgagtagctggaactacaggtgcaggccaccatacttcagaggtgggaggatcatttaagcccaggaattcgaggctgcagtgagctgtgatcacatcaatacactccagcctgaggaacagctcatctctttaaaaaaaatgcagttagagccagggatggcgggcttgtgcctgtagtttccactagtgagcctgaggtagaaggatagcttgagcccaggagtttgagaccagcctgggcaacatagtgagaccctgtctccaaagttactattctaaatggttaataatttattcacttctgaagctgatgaaatttaagaaactgaaaagtaaatataatgtggaccctcattatatactgtggataagagtgatataaaagaaaaattagataatgacacaaaatacacatttataatcacatgccaaactaggcaagaccacaagcattttttggaaatgatttcaggttaaagtggagtggactggaggccgggtgcggtggctcacgcctgtaatcccagcactttgggaggccgaaggcgggcggatcacgaggtcaggagatcaagaccatcctggctaacacggtgaaaccccgtctctactaaaaaaatagaaaaaaaaattagccgggcgtggtggcgggcgcctgtagtcccagctactctggaggctgaggcaggagaatggcgtgaacccgggaggcggagcttgcagtgagctgagatcgcgccactgcactccagcctgggtgacagagcgagactccgtctcaaaaaaaaaaaaaaaaaaaaaaagttgggtggactggggaaggcagggttggtggggatttggacgggctgagacgagaagataaagcatttcaggtgtggacttcagaaaggatgaacaaatgagcttgaaaatgatgaaatccattcaggtaattgtgcatgtggagaaaagaggttgacagaggagaacagagagattatatctgtaagtgaagtaactcaggaatggaaaacctaaaaccacatgttctcacttgtaagtgggagccaaggccaggtgggttggctcacacttgtaatcccagaactttgggaggccaaggcgggcagatcccttgagtccaggagtttgagatcagcctgggcaacatggtgaaaccccgtatcaacaaaaagtacaaaaaattaactgggtatggtggtgtgcacctgtagtcccagctacttgggagactgaggcaggaggatcgcttgagcctgggagacagagtttgcagcgagccaagatcatgccactgcactctaacctgggtgacagagtgagaccttgtttctctaaatatatatatatatatatacatatatatatatatacacacatatatatatatatacacatatatatatacacacatatatatatacatatatatatatatgggagctaagctataggtatgcaaaggcatacagagtgataaaatagacatcagagactcagatgcaggagagagaggactgagggatgaaaaactacccactgagcacaacatacattactcaagtgatgggtgcactaaaatcccagacttcactaccatacaattcatccatataactgaaaaccacctgtacacctaaagctactgaaattttttaaaattaataagtaaaataaatcactaagctcagaacagagagagaagccatgtctgggtcatgcatggtggccttgaaaggcagctgaaactctgtttagtccagagggacatagagaatcactgaaggttgttagagatggaaaccgaactgaaataaggaggaattcaggagtaatttatagactgtgtggcagcagagaaaaagtggagccagagagactaatagggaaccaatggcagcatccagttgtgaggccactggagccaggactggatggagacaatttacttgcttctcaaggccacacactgtccctctgcaaaggaccttatgcttgctattatgcaatgcccagctacaatcaacacctatctttcatttaggaattttgttacctgaggatttagatgcatttaaagacactcttgattctttatttcctctaaattaatgagatttatatctcatacttctcagaggaaaaaaatggtttaatcctagttctaatgtttataagctgaaagagcctcatttctcaaaaaataaataaataaataaagcactaagttaatttacatatttacaaaagaaaaaacattctgcagttggttgagtttatgtgacaagtattttcagacattttagagtgagtttcctttgaaggcagtgataagagtttaaacttcaggtctaaagtaaaatattttaaatggctccttagctttgcttgctaaaaagtagaacattatccaatggagatggaaaaaaaccctctttgcttggccagtgcaatacatgggctgcatatacggaattcatacttgcaaatgttctattttaagcttgagtcaaaatatgatttggctaatatattttagcacctgtttttcactgaacaaacctcagtcttactggaattaagtgtattatttattttaatttatgactattttatcttactaaatgccatagaaaatcaattgatatctgcatttctaatacatgaaaatgcctaaaatctggaaaggagtattgtttagcaaataaatatacattgcttaaatgatagtataatagaaaacattcatgttaaaaactgagttggaaaccttcatttagattgctatagctattaatcacagcttttattttatttatttatttatttatttattgagatagaatctcactctgttgcccacactggagtgcagtggtgtgatcttggctcactgcaacctccacctcccagattcaagcaattctcgtgcctcagcctcctgagtagctgggaccacaggcgcacaccaccacatctggctaattgttagtattttttagtagagaagggtttcaccatgttgaccagcctggtcttgaactcctggcctacctgccttggcctcccaaaatgctgcaattacaggtaagagccaactcactcagtccacagattttatttttaagatggtgagcttcgtatatttttttgtgaagtcagtcatgatgagtttcagtgccttgtttgaggtctcacaattttcttttgcttgagaaaattttttaaaaatgaatatttacttaaatgaatcatagcaatgctgtcttgaccacttttacaacattagttctcaagccagtgagtttcttggcagctttgtatttattcaatcagtgtactcagtaaacgtaattgtgccctgatagacttttaaatgtaagttatcaaacattaaaaatgatggcatcatttaagctgctcactttactcctctggatgacccttgcaatttcatgtggattattatagagatctggtcaaatgttttgtattaatcaatagtaggaacaagcctcattactctcaagtttctaagaatatttgcagccttcataggttttcatgttgtaattctgtttatttgttgattctaaaacaaaccacctttattcatagtgaaaatatgccttagggtacagaaagacattatttgtatatgaactataaataccttattgatttcctatccttggtgattacaagaaaatattcatttaagatcatctcttatataatttaataacagcaataccattctttgctttttaaataaaaaagttatgatacttagaattttacatattttgaaatttatatgtaatttatacagagttgatcctcaatattattagtgtattccatgtttgcaaatttgctaacccactaaaaatgtatttatgaggtgaaataacacctatggcacctttgtggccctttacagagcaacaaaaaaattttagtctcccaacattcgggttctcaactgagtttgaacaaactgacactcttgtcttcttgtttcagcactcacactgtaaacatgtgtcccttgcaagacctattttctgctgtttttcacattttcgtgctttttttaaaaaaaaattcttttttggtttacgttttatttatctatttgtttattttgtagaaattgggtctcactacgtttcctaggctggtctcaaactcctggtctcaagtgatcctcccacctcggcctcgagtgctggggttacaggcatgctcagccttttgtgctttttgttgataatttcaccacttaaaattggccccaagagtagtgctgaagtgctgtctactgttccaaagcacaagaaggctgtgatgagcctcttggagaaaacacagttggttagataagcttctttcaggcatgagttacagtgctcttggctgtgagttcaacattagtgaatcaacaatattaaataacgtatcattaaatggaagcacaggtaaaacaataatatgtattgataagttgataaaactgatgagaccagaggctcctggggacttagtcctgtatatccctacgagcaatggcttggtatttactaattcagtgtttgtagtgactttacagaacataactgccactgcaaataatgagaaatggctgtatctccttctgtttttttctttcctagaagccattttctcaacatttcatcgtgaactattatggcctcatcgggaatgtgaagtgtgtcatctgagcagatgttcttattgttttcctatccactgacccacagcatcaaacaatttagaggagaaaagtggtcctgtcatctccagagttattatctattttatttttaaatccaaacttccacaatcaagttgctattaaggtttatcttattagcatttaaatttttaggaaatgctcattactgggttaagcacaaaaaagtcacattgcttgaaaagtgctatttgtaaaacagaatggcccactttgtctatgtgtaagaggatctgctgcacatttttacctggaataatattgtcatggatttggacatatgtggaagtgctatttgtgtttatgcagatcaacctcttggttttacagaagagagatgccagtcccagggaggttaaagtgcctgcccaaggccgtgtgctggagcagaaggggaggtgctgcctccagtcgagttagagcacttcccaccatccaccaccatcaggtcctgaagccaaatacagaagatagcatatatttttattactttgagatatcatcctgagcccaagaagaatttcttgttgctgtctcataaatatattactttgttatttattagtttaggcagtttatgactagcagtcaaatattcccaataaggttcgaatcaaaaatgttattttgtttttgtattataaaaagaaaagcaggctaggtgtggtggctcatgcctgtaatcccagaactttgggaggccaaggcgggcggatcacctgaagttaggagttcgaaactagcctggccaacatggtgaaaccctgtctctattaaaaataacaaaaaaaaaaaaaatagttgggcatggtggcaggcgcctgtaatcccagctactcaggaggctgaggaaggagaatctcttgaacccgggaggcagaggttgcagtgaggcaagatcaccacactgcacttcagcctcggtgacaagagtgaaactccatcaaagaaagaaagaaagaaaaagagagagagaaaaaaaagaaaagcatattttgaaaggtatcctcttaaatttgtggtgaccctcaaatatttatgctaaaacttaactttcagtatggaaacagaaacatgggttcaatttaaaatccatgactggatcatgagcagggcaaagtgagaggcattgtgagatagggccaaatgcttcgagaatttactccatacagactgtgttcaggaacccagcacttcctctgtgactcaataactggcacatatggttgccagggactaccaacagctgatttcaataaaagttacccaattacaccttgaagacctgttgtttctggagggagttggaggaattaaggaatgtggactgagtttttaaaatatatcttacagaagtcagaggaagatatagaaggacaggaatatactcaagatacaatattttcttctactgtactttttgttacatggaacagaattttagcattggatcccttcagctgtgacaaaggagaaggtccatggttataaagttttccattagactctcctcacacacaggaaatgaacttccataaatttaatgatatgactcttagggttttatttctcccattttataaccctctttaggatagaaacacatttcttgcactataaaaattttagtcagcaaatttttcatattctcactgggatttcataatcagtctgtacacccttcctatgcaataacttttgatcagtatagtgaaatataatggtattatgtaattttaagatgtacatcttaaagacaaaaaaatatccctttatttaattcaagataaataaatcagtgaggaaaatgtatggtgaaaagtttgggcatatattagttatctttcaatatatttttcatttttttctttttatttccttcaaccatatgatgcaatcaacggatatttgttgggtgctttgatgttttcagatctatgctatgcactacaagggtctcaaaaaggaatgaagaacaaagtccctgctctcaagaatgtagagttttccatacaaggttctaaaaaccattaaggtcacttaagatatcagtcagaaggtgaataggatgatgttcctggatgcaaattttagaaatgtggcatactaaaatcttcccctggaacttcaccattcacacctaagaagttaaagatgtctcagtaggttctcactatgttgtctaggcaggtctcaaacttctggcctcaagagatccctataccttggcctcccaacgtgtggaggttacaggcataagccactgcacctgacccattttctccttctgaaaactcttttggattttaggataccatgttctttggattcttccctgcttactctgaccttccttcttgaccctcactgtctcttcctcattcgcagggccacttctccttagcgaccccaacacaaccaagtctcaaaattggacatctgatatatgtgacaaagatatgttttcatttatataaaatgtgaatagaaacttacatacacacacacaaacatacaaacacacacacactcacagtgtctcagaagttctgcaacaaagaaatacagttattgtcattgaacccagaactccctaagtgtttttgacagagcaactttttcttgagacagatctataaaaatctcttgggatagtggtgttctatggaaaacagtctggggaatactgaattagagaaccgtgtgagacattttattattaacatgcaaactcaaagtactgaaagtgtagagaagagaaatatcattatgatctagacgggtgaagaaaagaatctcaaaggaggatagacttttaaagaaataagtgaaaaaaaaaacagaacatgtgatgaggagggggaaattcagattatatctcccaaattgatgatattgattatttgaaagaggaaggcaaaggtgtagacaatgattattagggactttgactttctaagttatacatttctatattgtttatgtacttgtttttacaaagttttacaaatgttttatgaagtggcttattcttataatccagagatattctcctaaaactaactaaagtttatttatcagattaactaatgatgtgtatagctcttacttccacaattatccatatatacatatatgcaatatttacaaacatagagatgtacaaatataatatctcggccaaaaataattgaagcatcaaagtcaacctacattgtaatcttgggcagcacctgttgtttattcatctctcaagtgtggctgacttcagggatgagaataaacaatgtgatctcttactaagcttccctttggactagtcatccaattggtatgtgatgactttatacctgaaactaaggagttgaggaataagctgaaaatagccaacttgggtttcctaagtacagtttggcttctgtaagaactgtttggttgctcctcaatttcagtgtattcattttttaaagtatatttattttaaaagtggcaaattcaggtattacttaataattaagaagcatttatgcccaaacacaatatatgtttacaaccaaatttgaaagtaattgaactgataaccctttagacaaaggagatgtgttataataaatattattgtcagctttccttcatcttaagattttttgaatcttggaagaagatatgcatgaactttgtgttgggtatttataaatgtatacacatatatacatagcaaaatgtaagcacaatacaggtataacatgtaaggttagaccatgtaaacttgctgaaattcagttgtttctgacctacaataatggcaatttcatatggttgaacctaatggtttgtctcagtcattagttagtggtgcctcctcccctaggtagagttttccaattgtgttgggatggtattttcactcttgtaacattcccaacttgtatcagaattcccttcatcttccctcctctacttttatattattctattccgtcatttttctcctagatacgactggacagattgtttacttatagcagtccctatatgttaatccatttctttggtcaacaaattctcaaacatcagaccttaaaggtcaaagaaaatccctgtgttgaattcagtaccatgtatacagaattagtcaactattgcggctctttccctattatctatccctatttctgttactgttgatgttgtctgggagtatctaaacactcccaggaattcaggtacttaagaggactgtctggataacaacgtctggttatctgatgtcaacttctgaacctcttggcaggagtcctaaggcctgcatagaagattggctctaggacaaatgctatcaagaaaatattcccattgggtgcaggtggctcatccttttaatccaaatcactcaggaggctgaggtgggaggattccttgaggccaggagtttgagacctgcttgggcaacatagcaagaccctatctctaaaaaaataaaataaattagcagggcatggtggtgtgcactagaagttccaattactccagaggctgaggtgaggggatcacttgagcccaggagttcaaggctgcagtgagctgtaatcacaccactgcactctagcttggatgacagagcaagaccccatctctaaaaatataataaaagacaaataagaaactagtcccccataattcaaacatgcttattactcactatgattacagatcaaaataactaccagcttcagtggattaagtatctaaaccttgatgtgattggccaatagtttgattactaccatgtgtgtattacatatgcacatgtattcaatgctgatacaataatctgtaaatagaaaagtgcaatagttttctatatgcagtttcagtagtaccaaagctaattaccagttgagaagaatttggctttataagaggtaagccaaaagaacaaagctggaggcatcacgctacctaacttcaaactatactacaaggccacagtaaccaaaacagcatggtactggtaccaaaacagagatatagactaatggaacagaacagagccctcagaaataataccacacatctacaactatctgatctttgacaaacctgacaaaaaacaagaaatggggaaaggattccctatttaacagatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcagggcataggcatgggcaaggacttcatgtctaaaacaccaaaagcaatggcaacaaaaaccaaaattgacaaatgggatctacttaaactaaagagcttctgcacagcaaaagaaactaccatcagagtgaacaggcaacctacaaaatgggagaaaatttttgcaatctactcatctgacaaagggctaatatccagaatctacaaagaactcaaacaaatttacaagaaaaaaacaaccccatcaacatgtgggtgaaggatatgaacagacacttctcaaaagaagacatttatgcagccaaaagacacatgaaaaaatgctcattatcactggccatcagagaaatgcaaatcaaaaccacaatgagataccatctcacaccagttagaatggcaatcattaaaaagtcaggaaacaaccggtgctggagaggatgtggaaaaacaggaacacttttacactgttggtgggactgtaaactagttcaaccattgtggaagacagtgtggctattcctcagggatctagaactagaaataccatttgacccagccatcccattactgggtatatacccaaaggattataaatcatgctgctataaagacacatgcacacgtatgtttactgcagcactattcacaatagcaaagacctggaaccaactcaaatgcccaacaatgatagactgaaatgtggcacatatacaccatggaatactttgcagccatataaaatgatgagttcatgtcctttgtagggacatggatgaagctggaaaccatcattcttagcaaactatcgcaaggacagaaaaccaaacatcacatgttctcactcataggtgggaattgaacaatgagaacacttggacacaggaagggggacatcacacaccagggcctgttgtggggtgggaggagaggggagggatagcattaggagatatacctaatgtaaatgacgagttaatgagtgtagcacaccaacatggcacatgtatacatatgtaacaaacctgcacattgtgcacatataccctagaacttaaagtataattttaaaaaagaggtgctaaatatgatctagtgagttctgtggcagacatttttaagtagaaacagggacaatgtcttgttatggcttcttgatggggtcaaaggctgtattgccttctagctaccggtaaagaaattctctaaccctaaccaacaagtgcctcagcccctacctctgcaaactgcagtcagtctgaaggcaatctgccatgccagaaagccagttttcagaatctccctttcagaaatctaatatggaaatagacagtcttgtaaagacttgcattatctatttactagtgaatagatgaatatctacttgccattaaatatagcaattaaccaataccagtcaacaatcattgagctgcttctttttttttctttatttcttctgaaaaaacaaatggaatacatgtgcagaacatgcagttttgttacataggtatatgtgtgccatggtggtttgctgcatctattgacccatcccctaagttttctcccctcaccccctaccccccaacaagccctggtgtgtgctgttcccctctctgtgttcatgtgttctcaatgttcaactcccacttatgagtgagaacatatggtgtttggttttctgttcctgtgttagtttgctgaggatgatggcttccagcttcattcatgtccctgcaaaggacatgatctcattcctttttaagagctgcttctttgtataagtgcctggtggttaacacaagtgcctagtaggtgttcaataaattgttcttccactaaattaaaaagagtaaaataaaggcctaatctcaggggcactataatcttctcataagaatacaatgtgtttgtataatgtttttatttcatcacctacataatcaaatcctatctacacacagcatgtattagacttcattttaccaatgaataaaattgaagctaacagtacatcagagatttgtccaacagttacaacctaggaagtagtgaaactaaactaaactctaggccttctaatgtgtaattcaatgatagttctaccaaatctccctggttcactaaatcaaactgaaaaggaaacgcttttggtaacagaggaaaaccatagccacattcactgatgtcccaaatgggttgaaaaatgagtcccactttctgcaataaatggccctcaattaataatttattggtcataggttacaggttatcatagtcatatcatattgataggcctataaatgttttaccattagtaaaaagaaaatttcaagatttgggagtcatgggaaatctttgcaccttcctctcaatttactgtgaacataaacttctctaaaaaaacctaagtcactcaaaagaaaaatatgggtcaacaatacttttttagagatgccatggatttttttgtcaagcattttgcaattttttttttactggagggaaaggattttgtagaaatcctttgaaaggctgaattattatggaaaataattttgaactttgagaacattaaattcctttgtttcccaaagctttgtggcaaaaaagagatgctctggaaaacttttcaagcacttagaattttacagtgatgtaaaagttgtctgatacctattatgagtaatagtacctggttagttttctattgcttttctttgaattacggttttccaccaagcaacattaaacaggaaagacaaagatcaaatactcttccgatcaactgatgctcattttatctaatacaaatgacaaaaagggaatagtaaagaacagaaacagtttttctgtcacttgcaaaatagtattgggaacttagttctgccaaagaaattaagaaatatgtgacatctctatctgcctttatttttcctttggttatttttgtatttaacgagacaaaaacattcaacagtgtacataaacttttcccacattttaaatttatttttgaatgataacctttaaattcacaataagttctgacataaaggtacatttatgatgggccctttatcatgagtacctgagtaggaggagacatacactgaaaactttgctgggggagaagtaacattgtcttgccagatgagagtggaaatcacattttagccctttgtaatactctaaaccgagggttagtaacctatggaccaaatccagctttccacttgtttttgtaaataaagtttaattagaacataattacacctattcatttacagtttgtagctgcttttgcactacaactgcagtgctgagtagctcctagagagaccatatggctcacaaaatctaaaatatttactatctggtcatttacagaaaaagtttgtccacccctgctataaatctttctctcttcccttcctctcctacagatggcaataactagtggcaaaaaaaaaaaaaaggcctagactctcttatggcaagaagtggaaaataacgcattttttctggattgtgcaggtgatacttctgggtccctgccagcctcgtgcattttcaagggcctaggaatcagaaaccatttctgactctttgacagcatagccctcctcccactactctctaaatagaagcattgacatcagagtatcctaaaacaaccaaatatgggacatgtttatttagtgcatccctgtcagcttactaattagaaaactgagttatgtttctcttttaaaaaataggacaggtgcccatgaaaactgaaaatttaggccaaactatctatgctaataacactttctacttttttttttttttagatggagtcttgctctgtcatccaggctggagtgcagtggcaccatctcggctcactgcaacctccgcctcccgggttcaagcaattctcctgcctcagcctcccaagtagctgggactacaggtgcacggcacacccggctaattttttgtattttagtagagacagggtttcactgtgttgcccaggctggtctcaaactcctgagttcaggcaatctactcgcctcggcctcccaaagtgctaggattacaggcgtgaaccaccactcccgaccctaacactttctacttttacatctcccagcgccatttaatatgttttagtttcaactatgcacctaaaacagtaataacaaaatttaagtaaacatctctagaactttcagtgaaggataaaatatgttaggtaaagccacatttttgtctttcttcttatcctcctaatgtgtttctacctacataaaatcatcaacttcaatttttttttttggtcacaaaaaaaagcttgatgcttatatacatagcagcagcaagaaaaaaaacataccttttttctttacttaccagaccccagaggagtgactacagctttaaagctgactgtgaatatatttttggagagaggaagtttgtgttgtctagtgtccatcgcttgccaacttttctgatctataaaatacttcagtgacttcacacactgatgctggctttcagctttcttttagctctggtcaccaagagcaacaagtgccattgtaggtcaatccctagagaaacatctgtcttctctattccttgggcaggtactttcatgtgtagtagtttcagagtttatggttatttctctctggagaccatctgtctgctgggtttattttttcctgatgttgtaccacatcataaagtctactgccaagagtactttactcaagaagattttgttttctgctgttttagtcacttcactgctttatttctgtaagccaaatcaagtggacaaaatcagtagcaattccccactccacggccctgtagcataacctggctcagtttggttgcaagttcttatgactgctttaaaacattctcctcacacaataagtgatgggtcctcttgtatatacgtgtaacaaagagctgcactgagattttccatgaaatgtgaatgcgctcagaaagcctttccaagttttttaaaacaagtgaatcatgtaggtctaatcagttgaaagtaaccaaattcataattgatttttattagcaaatatagtactttgaaatagctttttatgctgcatgacccaaggttaacaaaaaaatagctttttgtttccagggaaaaataagtttaagcttatttttatcctttcttactttagttcccaataatcatacttaaataaatgtactccagagtttctatttttcattttcagataatgtaatggttattatcatatagtcatagaaaattgcaatggttaagtcattatttgcctaataaatttacaacctttttacggaaaaatgattccggccagacaaatgttgtcaaacaccttttaatgtgttttcaacctttgtcatagctcactttcttgcataaacagagccttccaaacaaagcatggaaaatttaaaccacatagattcgtattatcaaaactattacaccggattattttccatagtgtcagcattgacattaatttcttgagaagataactttaaaaggaacactcacatggattttacaatgtctcttcctcacccttacaaataacttttattcattcacggctataattagcacttcctgtaaggcagcccttttctcggttgtggatgggcacactgtgaattcattagcatggtagccaggtcagcagagtcattagtggtcattttaatgatgacttggaaaccctgcctggtcaatttaagtgaggctcattcccatgtactgactgcagccaagcagcttcacaatattacccatttatttaggcagcttcaaatagtttcccaggaactggagtaacaagaagctgaatgcagaggtctgtgtgtcaagaagtttccatgactagtgaaccctgagcacttctctgtacacattcaaacccaactcttacattcattcttcaaatgggtttgcttagaccaagccagattacttgagcaccttaaattttgctgggtattgtttcatgttttacatttataagtgttttgcattttaagcagggattttatataataaaccaatataattcattgtcatcattgttatccatgttagcgaaaacttgtaaaattatgtagcaattatgtgtcaactggcatttttaactctctttggtatttatttatttattatgttaaaacacagattctcattttgaggctatctcattttattctcaaaacaatactagaggagaagtagtgaggatgtggaaaggaagccatgtacctgggacacaaagagtatgagcttggggatcagctgacatctgacttgcagactgtggctgcaggcaggggaagtagcacacaaaagcatcaagtttcattattatatcatgttattatgttacagcatgatattgtgcaggaaacagaaaccagccggacctgcctagaaggtctatctggagaaatggaagaattaatgttcttgtgaggatcttaaaagccagatgaatgagtctggatgtgatagcaagggaaaggaaccataagttttaaaacaaggaattggcatgataaaagcagttccatagaaagcaggggccggaagacctatgcaggctgaattccaaatgcaccattgctttggcttgatgactttaggggtttgggggtttcacttacaaattcagtaaatgtcaccttttcagtgagagagaccttccctgaccactttgtccatacgttcaactctccccgcttctgcatcctatctatcctctttctctgctatttttttctccttagcagttatcactttcaaacacagtatgcattttatgtaataatacgttgtttatggcccatctttcccgctataatgtaagttctgtaagggcagtgattcttgtctatttattcactattataccttcagcacctagaacactgcctggcacatagtagcccctgaatactacatgttgaatgcgtcaatgaattgattagtacctgtaccaagtcctattcttgatactagaaataaagtagttaataagatacacaagttttctgttctcatggaggatacattttagtagtggataccaaaataaacagagttgtaattccaagtggtgctgtttgctcagaggaaaatataacagagttaacaagaatatcaaatatcaaataaatgctctcctgttgcacacattgaatatataacagtcgaaaaggctgtttttgtttccagttttgaattcattattcctgaacaatctacactggttttttatcacagttatttttcctggaaaagacacagaaacagcttgcaaaagcaagaacctgactgtgatagatttctaaattgtagatcttattccattcagcaagatcattcccagtcattccattcagccatgaactgcatgtcccatctactatgatggaaaacatccttttcaactgctatcaagaagcagagcctttttatttattttgacaggccaatatctatttggttctttccacactgaatgagtatcttcaagaaactcagacttctgatagggactcagtgatgagacaacaattaagaagaatctggactttcccattccaaagcctcttctcaaggcagttgtgatccttttaaaaaacacagactaaagtaagtggacagaataagtacatagataaagaaacacagaagttaggaacacaatttttttattatactttgagttctagggtacatgtgcacaacgtgcaggtttgttacatatgtatacatgtgccgtgttggtttgctgcacccattaactcgtcatttacattacatatttctcctaatgctatccctcccccatcccctgaccccacaacaggccccagtgtgtgatgttccccttcctgtgtccaagtgttctcattgttcagttcccgcctgtgagtgagaacatgcagtgtttggttttctgtccttgtgatagtttgctcagaatgatggtttccagcttcatccatgtccctacaaaggatatgaactcaaccttttttatggcagcatagtattccatggtgtatatgtgccacattttcttaatccagtctatcattgatgaatatttgggttggttccaagtctttgctattgtgaatagtgccgcagtaaacatacgtgtgtatgtatctttatagtagcatgattataatcctttgggtatatacccagtaatgggaatgctgggtgaaatggtatttctagttctagatccttgtggaatcgccacactgtcttccacaatggttgaactaatttactcccaccaacagtgtaaaagtattcctatttctccacatcctctccagcatctgttctttcctgactttttaatgatctccattctaactggtgtgagatggtatctcattgtggttttgatttgcatttctttgatgaccagtgatgatgagcattttttcatgtgtctgttggctgcataaatatcttcttttgagaagtgtctgttcatatcctttgcccacttcttgatggggttgtttgatttttttcttgtaaatttgtttaagttctttgtggactctggatattagccctttgttagatgggtagattgcaaaaattttctcccattctgtaggttgcctgttcactctgatggtagtttcttttgccatgcagaagctcttagtttaattagattccatttgtcaattttggcttctgttgccattgcttttgatgttttagtcatgaagtcctcgcctgtgcctatgtcctgaatggtaatgcctaggttttcttctagggtttttatggttttaggtctaacatttaagtctttgatccatcttgaattaatttttgtataaggtgtaaggaagggatccagtttcagctttctacatatggctagccagttttcccagcaccatttattaaatagggaattctttccccatttcttgtttttgtcaggtttgccaaagctcagatggttgtagatgtgtggtgttatttctgaggcctctgttctgttccattggtctctatctctgttttggtaccagtaccatgctgttttggttactgtagccttgtagtatagtttcaagccaggtagcatcatgcctccagctttattctttttgcttaggattgacttggcaatgtgggctctttttttggttccatatgaactttaaagtagttttttccaattctctaaagaaagtcactggtagcttaatggggatggcattgaatctataaattaccttgggcggtatggccattttcacaatattgattcttcctatccatgagcatggaatgttcttccatttgtttgtgtcctcttttatttcattgagcagtggtttgtacttctccttgaaaaggtccttcacatccttgtaagttggattcctaggtatttcattctctttgtagcaattttgaatgggagttcactcatgatttggctctgtttgtctgttattggtgtataggaatgcttgtgatttttgcacatggatttgtatcctgagactttgctgaacttgcttattagcttaaggagattttgggctgagagggtagggttttctaaatatacaatcatgtcatctacaaacagcgacaatttgacttcctcttttcctaattgaataccttttattgctttctcttgcctgattgccctggccagaacttccaacactatgttcaataggagtggtgagagagggcatccctgtcttgtgccagttttcaaaggaaatgcttccagtttttgcccattcagtatgatattggttgtgggtttgtcataaatagctcttattattttgagatacgttccatcaatacctagtttattgagagggctgttgaattttgtcaaaggccttttctgcatctgttgagataatcaagtggtttttgtctttgattctgtttatgtgatggattacatttattgatttgcatatgttgaaccagccttgcatcccagggatgaagccaacttggtcttggtggataagctttttgatgtgctgctgatttggtttgccagtattttattgaggattttctcatcgatattcctcgggatattggtctaaaattctctttttttgttgtgtctctgccaggctttggtatcagaatgatgctggcctcataaaatgagttagggaggattccctctttttctattgattggaatagtttcagaagaaatggtaccagctcctctttgtaccgctggtagaattcagctgtgaatccttctggtcctggactttttttggttggtaggctattaattattgcctcaatttcagagcctgttattggtctattcagggattcaacttcttcctggtttagtcttgggagggtgtatatgtataggaatttatctatttcttctagattttttagtttatttgcagagaggtgtttatagtattctctgatggtagtttgtatttctgtgggatcggtggtgatatccccttttcattttttattgcatctatttgattcttctctcttctcttctttattagtcttgctagtggtctatcaattttgttgatcttttcaaaaagccagctcctggattcactgatttttttgaagggttttttgtgtctctaactccttcagttctgctctgatcttagttattccttgccttctgctagcttttgaatgtgtttgctcttgcttctctacttcttttaattgtgatgttaaggtgttgattttagatctttcctgctttctcttgtgggcatttagtgctataaatttccctctacacactgctttaaatgtgtcccagagattctggttgtgtctttgttctcattgctttcaaagaacatctttatttctgccttcatttcgttatttacccagtagtcgttcaggagcaggttgttcagtttccacacagtcatgcgattttgagtgagtttcttattcctgagttctaatttgattgcactgtggtctaagagacagtttgttgtgatttctgtccttttacatttgcagaggagtgctttacttccaactctgtggtcaattttggaataagtgtgatgtggtgctgagaagaatgtatattctgttgatttgggttggaaagttctgtagatgtctattaggtctgcttggtgcagagctgagttcaagtcttgtatattcttgttaaccttctgtctcgttatctgtctaatattgacagtgggatgttaaagtctcccattattattgtgtgggagtctaagtctctttgtaagtctctaaggacttgctttatgaatctgggtgctcctgtattgggtacatatatatttaggacagttagctcttcttgttgaattgatccctttaccattatgtaatggccttgtgttctttgtctcttttgatctttgttggtttaaagtctgttttatcagagactaggattgcaacccctgcttttttttttttttttttttttgctttccatttgctttgtagatcttcctccatctctttatcttgagcctatgtgtgtctctgcatgtgagatgggtctcctgaatacagcacactgatgggtcttgactctttatccaatttgccagtctgtgtcttttaattggggcatttatcccatttacatttaaggttaatattgttatgtgtgaatttgatctgtcattatgatgttagctggttattttgcccattagttgatgcagtttcttcctagcatcaatggtcttcacaatttgacgtttttgcagtgtctggtaccggttgttgctttccatgtttagtgcttcctttaggagctcttgtcaggcaggcctggtggtaacaaaatctctcagcatttgcttgtctgtaaaggattttatttctccttcacttatgaagcttggtttggctggatatgaaattctgggttgaaaattcttttctttaagaatattgaatatttgcccccactctcttctggcttgttgagtttctgccgagagatccgctgttagtctgatgggcttccctttgtgggtaacccgacctttctctctggctgcccttaatattttttccttcatttcaaccttggtgaatctgacaattatgtgtcttggggttgttcttctcaaggaatatctttgtggtgttctctgtatttcctgagtttgaatgttggcctgccttgctaggttggggaagttctcctggataatatcctgaagagtgttttccaacttggttccattcgccctgtcactttcaggtacaccaatcaaatgtagattttgtcttttcacatagtctcacatttcttggaggctttgttcatttctttttactcttttttctctaaacttctcttctcacttcatttcattaatttgatcttcaatcactgataccctttcttccacttgatcgataaggctgttgaagcttgtgcatgtatcacatagttctcatgccatggttttcagctccatcaggtcatttaaggtcttctctacactgtttattctagttaaccattcatctaatcttttttcaaggtttttagcttccttgtgatgggctcgaacatcctcctttagctcggagaattttgttattaccaaccttctgaagcctacttctgccaacttgtcaaagtcattctctgtccagttttgttccattgctggtgaggcgctgcgatcctttggaggagaagaggcactctgctttttagaattttcagcttttctgttcttgtttctccccatcttcgtggttttatctacctttggtctttgatgatggtgatctacagatggggttttggtgtggatgtcctttttgtggatgttcatgctattcctttctgtttgttaattttccttctaacagtcaggtccctcagctgcagatctattggagtttgctggcggtccactcctggcggtccactccagaccctgttttcctgggtgtcaccagtggaggctgcagaacagcaaatattgcagactagcaaatattgctgcctgacccttcctctggaagcttcgtcccagaggggcatcgggctgtatgaggtgtcagtcggcccctactgggagctgtctcccagttaggctacatgggggtcagggacccacttgaggaggcagtgtgtccattctcagatctcgaacaccatgctgggagaaccactgctctcttcagagctgtcagacagggacgtttaaatctgcagtggtttctgctgccctttgttcagctatgccctgcccccagaggtggagtctacaaaggcaggcaggccttgttgagctgcgtgggctccacccagtttgagcttccaggctgctttgtttacctactcaagcctcagcaatggtggatgcccctcccgcagccaggctgccgcctcacagtttgatcttggactgctgtgctagcagtgagcaaggctccataggcgtgagacccatcgagccagacatgggatatactctcctggtttgctgtttgctaagaccattggaaaagcctagtattggggtggcagtgtcccgattttccaggtacagtctgtcacggcttcccttggctaggaaacggaaatccccccaccccttgtgcttcctgggtgaggcaataccccgccctgcttcagctcaccctccatgggctgcacccactgtccaactggtcccagtgagatgaaccaggtacctcagttggaaatgcagaaatcacccgtcttctgtgtcgatcacactgggagctgcagaccagagctgttgctattcggccattttggaaccaatcccaacaattttttttaataacagtaaaaacaagaaattcgaagccctggagagggcctataagaaaagcaagaagtcaggcacagtggctcacacctgtaaccccagcactttgtgagggcaatgcaggaagatcacatgaaatcagtagttagaccagcctgggcaacaaagtgagactgtcactacaaaaatttttgtctaaattaacctggcatagtggcatgtgctggtagtcctagatacttgggaggctgaagcaggaggattgcgtgagcccagatgttcaaggctgcagtgagctatgatctggccactgtacaccagtgtgggcgacagcgcaatatgttgtgacacatgcaccaaaaaaaagagaagcaagaaagaacgtaggaagaaatcaatcttgttcacccagaaattctccaaagaactcagattttttactctgtgtttttaaatattgagaaaatggaaggcatgtaactaacagcatatttttaacagtttaaaaaaccacagtcatcaagagtaatttcagatgagctgaaaaccagataaaccacaacattcccctgtccccaaaaaggacttttttaaattacaggaatagaaaagaaataatcctacttgttggtggtcagtattgttacagtaacaccaagagatcagagctatgaaaatcctaacctcttcctaattttccatcaaaaagcctgattttccaccacagaatgcaaatgaaaaccacaatgatatttcatctcacactagtcagaatggctagtattgaaaagtcaaaaacaacagatgctggtgaggctgtggagaaaacggacaacttatatcctgttagtgggaaggtaaattagttcaactactttggaaagcagtttagagatttcttaaagaacttaaagcagaaaactaccatttgacccagcaataccattactggctatatacccaaaggaaaatagatcattacaccaaaaagacatatgtactcctgtgttcattgctgcactattcacaacagcaaaaatatggagtcaactagctgcccatcaatggtggatcggataaagaaaatgtggaggctaggtatggtggctcatgcctgtaatcccagcactttgggaggccaaggcaggtgaatcatgaggtcaggagttcgagaccagcctggccaacatggtgaaagcccgtctctactaaaaatacaaaaaattagccgggccttgtggtgggcacctgtaatcctagctactcgggaggctgagacaggagaatcgcttgaacccagcaggcagaagttgcagtgagccgagatcgcaccattgcactccagcctgggtgacagtgtgagactccatctcaaaagaaagaaagaaaatgtggaacatatacaccacggaatactacacagtcataaaaaagaatgaaattggggtcacagtggagcaggctctcatgtggaggtggggaagtttggtccatcagaatgatcaccaagaaacacaaagcagacctgggccctgggctcccagagaagaaaaagaagaagaaagtggtcaaagaaccagagactcaatactcaattttaaacaatgatgattactttgccaatgtttctcctataagagccacatccccctctaagagtgtggtccatgggaaggcacctgagatgcctctagtgaagaaaacaagtaaaagaagggtgtcagcaccctttgtgaggagcacgtagaacctgacaccacgctgcgtgccagacggtcagagaagtcacccaatcccaggaagcaggtgcttggccatttggagttcctctgtggggagaagaaaaagaagaagtcacctccagccatgtcccatgcctctggggtgaaaacctccccagaccccagacagggtgaagaggaaaccagagttggcaagaagctcaaataacacaagaaggaaacaaagggggcccaggaccccacagccctctcagtccagaacccttggttctgcgaggctggggatgctgcggacacttgctcagtggggaagaagggtgaggaacaggcagccttggggcagataacggaagcagaagagccccagggagcacagtgggaaggtgaagaagaagaaaacaaaaatccaccaggagggagatgccctcccaggccactccaagcccttcaggtccatggagagcagccctaggaaaggaagtaaaacgaagccaaagttgaggctccggaatacatccatccccaaaggagatggccctaaggcccccgagaagaaaaagatgaagtccaagaaggtagagcagccaatcattgaggagccggctctgaaaaggaagaaaaagaacaagaggaaagagagtggggcagcaagagacccttggaaggaggaaacagagacggacttagaggtggtgttggaaaagaaaggcaacatggacgaggcgcacatagaccaggtgaggcgaaaggccttgcaaggagagatcgatcgagagtcaggcaaaacggaagcttgtgaaaccaggaagtggacgggaacctagtttggccagtgggatactgctggttttgacaacgaggaacagaaactgaagtttctcaaacttactggtggcttcaaaaacctgtccccttcgttcagccgccaccccctccaagccccgcagcacgattgcaaggtccaacatagccctcagcaagaaggcggccgacagcctgcagcagaacctgcagcagaacctgcagcaggactgtgaccgggccatgagctggaagtacagccgcggagcccgtctctgcttctccaccgcccccaacaagatcttttatattcataggaacgcttccaagttagccaagctggaagattaaactctagagttttgtcccctcaaaactgccacaattgctttgattatcccatttatgctggagattacaagttttttttggtgaaaaatcagatcttggtgatgaccttgagcagtaggatataaataactcccataaacttagcgttccaataatggaacactaggcataagtgggttattcagttgtgctgatgaaagccatctgacagttggctcacattgaacacctgtggagactaaggacaaggacaaggacaactatcttgatgggcttggatgaactggggagaggcagctcatgtttggggagccaggagaacaagtgagtggctaaaacctcctgttttctgtgttaaacattccgtccctgtttgagacatcaatgtgtacagatgacctttgttgagtgtttagcaggtgctaggcacatactagtgttttccttaatgtatttaatcttcataattatgaaatgggtgctattattatccgcatcttatagatgaggcaaaggaagttcagggataaagtaataaaatgccctgggatcacccaaccactaaaaacaaacaaacaaaagaatgaaatcatgtcctttgtcccaacatggatgaaactggaggccaaagtcctaagcaaattagtacaggaacaaaaaaacaaataccagatgttcttacttataagtggatgctaaatgttgagtacccacggtcgtaaacatgggaacaatagacactgcagactactagaggggaggggaaggagaagggcgtaggtcaaaaaactacctactgggtactgtgatgactaccagagtgtaatacccatgtaacaaatctgtacatgtaccccctctatctaaaataaaacttggggaaaaaaagcatgattttcttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcgttgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatggtatttctagtcctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatgatagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtgtggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgactttctcttttcctaattgaataccctttatttccttcttctgcctgattgccctggccagaacttccaacactatgttgaataggagcggtgagagagggcatccctgtcttgtgccagttttcaaagggaatgcttccagtttttgcccattcagtatgatattggcggtgggtttgtcatagatagctcttattattttgagatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatccatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgagtttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctggagatgtctattaggtctgcttggtgcagagctgagttcaattcctgggtatctttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacatgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcatcagttgatgcagtttcttcctagtctcgatggtctttacattttggcatgattttgcagcggctggtaccggttgttcctttccatgtttagcgcttccttcaagagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggttgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttgattccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggttcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagctgcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgctttggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcctcccatgattttctttttttaaactaaaagggatttttaaaaatatgattaagaaacagtgaaaatatgagatgggaaaattgttggctattaataagttcatatttttgcatctagctttgtatcataaggtatcaaagtatttgaagatgaaactgaagaactttcattaatagtttctcataatattttagcttttatttatgtacaggagtatgataaattttaaaaaatcttgaaaaaatgtgatgaatgccaaatgaccagagagagaaaaaatatcctgagtgccaaaaaggagtaaaataggaggccctgggctttgtatattgataagctcaataacaattcctagaaatattctagatagaatattaagcaaatgatttataataaatttgagggccaggcacagtggctcatgcctgtaatcccagcactttgggaagccaaggcgagtggatcacttcaggtcaggagttcaagaccagcctgaccaacatggtgaagccccatctctactaaaaatgcaaaattagccaggcatggtggtgcacgcctggagtcccagttacttgggaggctgaggcaggagaatcgcttgaacccaggaggtggactttgcagtgagctgagattgcgccattgcactccagcctaggcaacaagagcgaaactctgtctcaaaaaaaaaaaaaaaaagggaaagaacaactatcattcctagaaaataacataagttcatcaagagtaaaaaaattacattaaataatgcttatttcttattttgataggttaaccagattgctacatcaggggaatagagtagataaaatgtcttgatttcagcaaagcactgataagtgctttataatatctttgagggaaacaaagagaaattcaggtaagatgatagtcgtgggagaagaggtacctgataggggtgctccaaagtcaagatatggtgtttgtaaagaaattcggaagataagggtaaaacattaggaggttcttgtttagggagtgggtagttcatgctaggaataaatgaatcaagattaccatagtaatatgtaaatgtaacaaatataaagactttccagaaatccaagtgagcaaaatctattcattttcatttaagttcaatttgaatcaatggcgtcatttagttcttttaaaaaaaatgcaactttagattgaatactcccatttcaaagaaagagtagtaatagacaaaaacacatctttacggcttttgttacttggtcaaatatatcctgaataccttgtaacgtgcagaaaacatctgtggctgcttacataatatatgcggtacaagtggataaaaataagcaaaagtttgtcttcccatttaactgaaagccctgatgaggacacagactatgcctgagttcccagttcctggtacaatgtctgtaaatatttgtgattgatataatacagtgaaagtaagataatgatagaacagtgcaaagaaattgggaatgaagttaatccataaaaatgtataccagaaggatctgggacactattactatttgtaatgtgggtcccaaattcacctttgagcctcttggcatccaaggcaaggaaacaaatatgttaaaagatcacagtctccgaaacctaaaacttcatcccttttgccagaagcaacgtgttaatagatttttcttgcaataaaatcctgagagaaatttctcacaggatgcctcattgagcaaatacaatgtgaaatagggagaaattcttaaaatacggtaagctggttaaatgctttttactcctagttaaagtaattcctttagggaccaaagaagtagggtccaagtacacagattgccagtggtcagctttgctccaggccctgtggtgtggtaggaaaagtacaacaaattaagtgattgcatatacttgagacagtcttttttgaaaccaaacttttgctgtagctgggcagtatccagtttgaatctgtattccccagcaagaatggacaatgcagatatttactgttggtgattaaatgccaattcttttgcttacactgaagaatgagaatgagtctcagtcccactttgagggatgtaacaacaaactgggcaaacgtaaagaacagtgacaaggagaatgacacgtcaggacataatttcatatacaaagtaggcagcaaactgggctcggtatattgaatctgaagaccaacagggaagtcatgataaaaccaacctcaaacatctgaagaactctcttagggaggaaggagcacacgtcttctgtggtccagatcctgaccaaggagtaaaggtcccagacaaggagagcgaactcaggagaaaatcaatttccaacggtagagctgtctgtaacagggctatgccgccgtaaaatgatgggagggtcctggatgctggaggggtttagagagacactgcacaactgtctatcagtgatgtttcaaaaataatccctgtcctcaaagggagactgaatcagaaatccttctggccacacgaatttcctgatcctgaggtgagaaggcatgctccatgtctgtctacgcggagtccactgactgctctgagggaaacctcttgaactgtttatgggttctgttgccatctcctagcttttttacattagccatagtcctttaaagaaatactctaagcaagcagaaaccacagtttcccataccctccaatttcctcttaacatcccacatgtaaaatgcaatatttcattctttaaaaactgctcgctgatgacgatatttttaaaacttcacaggccgggcacagtagctcatgcctgtaatcctagcactttgggaggtagaggcgggcggatcacgaggtcagaagatcgagaccatcctggctaaagtggtgaaaccccatctctactaaaaatacaaaaaaaaaaaaaattagccaagcatggtgatgggcacctgtagtcccagctactcaggaggctgagaaaggagaatggcgtgaatccggaagggggagcttgcagtgagccgagattgcgtcactgcactccagcctgggtgacagagcaagactctgtctcaaaaaaaaaaaaaaaaaaaaaaaaaaaaattcacagagatttcagtgatagtatttattgattagggtctttgttaatatttaaggttcattgcacttgaaaagcagaatcgtgcagtgttctaatcaattattccaaatcaccgttaaagacactaaaaatgtcatatttaatttttattgctttgcagtggaagctgaggcatgctctgagtagatcccaggtgccaaatgcacttctcttatggaaacattatgcataaaggatattttgcaaagtaccaagtttagaaagaaaggtaaatttaggatgctggaagaaagaaatgactccagtgcttccctctgctgatgaagttttgatttcattaggtggcctgtcctccaggcaaagtgctgtgccagccagtggggtcagctatagtctctaatgtcagcaggcatactccagtcatcataattcatgaaatgctctcaaggtcccctgtcaaatgcactgaagatcatacttcatcaaagcaatacttaaagtttatgaaaagtcagaagcagggttgaatttcctttggaagttatttctgaagaattgttttcttaaaatattctatatcttcttcctgttagcatcttttatttcaatcctatggttccattccatttaaaacatttaagggccaggcacggtggctcatgcctgtaattccagcactttgggaggccgatgcgggcggattatgaggtcaggagatcgagaccatcctggctaacacagtgaaaccccatctctactaaaaatacaaaaagcattagccgggcttggtggtgggtgcctgtagtcccagctactcaggaggctgaggcaggagaatggcgtgaacccgggagaaggagcttgcagtaggtcaagatcacgccactgcactccagcctgggcgacagagtgagactccatctcaaaaaaaaaaaaaatttaagatctcccctccctcaaaactttcttaatgagtataactaacttacatgggccattatgccatggaacacttacagtctgccaaaatgcttgcagagagcacctgctaggtggaaatgtgtggttgcttcaatcagcaaagcctactctgttgatttgactgttgtatcatgctaagttcagggagatgtctactttaaacctcagctccatttctcctttcttcattgcatcattcacaattgtttgtgagtacctggggattgtgtgtttgtgtgaatgccaatagggtaacttgccatggttcgttcagtagagcttttctgaatgttttattttcacatcattttcattcttgctaaatgaatctgtgcttgatgcactagttctggaagctagacattatctgttatacaagcacccatgagattcccaagtcaagctttttgtcaaattaaatctaacaaattgattcttaattaacccacaagaaaggctgatgatagttttcttgagtaaacatagagtcctttgagttggtaatatttaaattttttataaatttccttctttttctcttacaataatcagtgccttccaaataagttttggataaaagatctagatcaaaatgaatttcctcagaaacaaaatataaatgactgtttcaggcaaaataaaggccaatagctgttccagactaattttgaaggaatatccatcttatgatacctcaggattaacgtatacatggaaaaacattcatatattttaaactcatcataaagctgacaggtgcaaaactgggccctcttccagccccgtcttaccaattctcaattacagatgtcttaatttttatgtgtgccatgggcccttcagcaatcttgtggaaactatgaaccattcctcaaatatatgtgactacaaaaggaaaaattatgatgaaatctattattaaaacattacacaaatttgcaatatggcaatgcatatgcttctttattaaaaacaacccctagcagtagggctaatagctacataatcttgaaatgatgagcaaaatcaatattcaagatgaaacaattatggtttcatctacaactgtaaaatgagattttaaaatctgtgatttttgtgagcaacaaattcacaagtacggctaataccatcatgatctattgccatggttagcgaaagataaacacataaatatcccccctctatgttcactaccccctaaattttacacacagatcccctggaggaccgtggactctacattaggatagcctgagcccagtgactcttgccaccgcttctacttgtattcaaccactagagaggtgcgttggggtcatggtcagtaatcagcatgcatacatgcgcacaggatcctcagaagcaatagagtcagcaaaaccacacacacaaacctcactatgtcactgccaatcagcccaacatctgaacactgtcaccttacgggggtcactctgtgtcagttcagtgttttctccagccagaaagtctgcctctggcaatgataccaagagctaattcagagcagaatgtgttcattgttctccatgatgtcatttgccaaatgaaagaaatggttctagaatatcctctatgcttatttaccaaaactttatatgcttggtctgcactgtcaggataacatgttccatacatttactttttctagggggaaaaaaatacttccatatctccagctagaatttatagccgagatttaaatccacatttccacgtggatgtctaaaactggatttatcctcttctccccaaaaccagtttctccttctgactttgacttttcttctcctgacttgtacagtcatctcagactttccagccaccacacccgcttcccagactccactccccaatttacagcatcccttcagtctccctgtttattccattctcatttctactatgttcatttacagcctaacctagattcactgttacccttgttcctgcctctcactactcagatccattctatacacactgctgccaacttaattttcccagaaggcaactctgatgacccttttatcctgtccagaaatcttcaatggctccccattttctactgaactaaatgcagactctgccctacaagcctctcctccacttagctccagactcccaattcagccacctgtttcatcctgttctgcaaactttgataattctcgttccatgaaacaaaaggcaaatagtttgcctcattcattttctgacttgctgccttccacattttgtaccctccttctaggatgtgtttctccagaaatttctcttgttgaaaccttactcttccttcaaagaccatctcaaacaccatcttttttttggaacacttcttgatgtgctcccacctttcccaactaaatagaatccctccccactttcagcctctgtagcatttttcttagcacttatctgcctctgcctttcattctgatccaatgtgttcactttgcccacctcactagattttaattcctagtggtaagaatttgtagaccattcctgaaaatccatttttggcataggaattatttcaacacaattgaaaacatgtattgagtacccattgtagaaggcactgtaccaaaggctaccagctgtacaaggctaaattaaaacagcattcaaatattgatgaagaaggaactagcaataagatgtgtttcgagcacagacatagattataaaactgccattgggatgctcttgaaggaggaaagcatcttaatgattaaataatcccctgctcgcttttccaagtgttttctgggaaacctggacttggtggggaaagggagggaatatccagataagggctcctcaccagaggaggacatctatcactgtcatctgatgccacatcatcctcccaactaccttagtaatccctgtattttactttctcatttatagtttgggggtcaggtaggtgcactggattttgaccactagtttgcaaattttagtccattaggaccaacttaaaatataatccacagtatcctgaatcattagatgcatgaatcaaaagtaggatgatgccagacacactttgggaggctgaggtgggaggatcccttgaggccaggagttcgagaccagcctgagcaacatggtgagaccctgtctctacaaaaaattttaaaaaaaattagccaggcctgctggcctgcgcctatagtcccagctctcaggaggctgaggtgggaggatagcttgaaccctaggagttcaaggttaaagttacaatgagctatgaatgcaccactgcactctagcctggtcaacagaggaagaccctatttctaaaaaaataaaaatgaaaaataaaaaagcatgatgaatcattaacatcgtgtactaggttttttcactagcaggctctttcctcttggagccttctgtttagaatggcaacccctttcccctcagtttgaggagatagagaagtgtcttcctgagccgagaataccaccaccattctcatctctgatgcttattcagcacactgcatagaggcttagactacacagtgcttaggttctctttctgctacacaaccttggaagagctacaaatgttaattctcagttttcatatctgtaaaatggggattataataattttattccataaatttctggggataacatagagataattgataatgtaagaatgaggagaatgcatttaaaagggacttagcacagtgtccagcttgtaggaacccctctatgaatgttagtcattattatcagcatagaaaacatgttgggataaatataaagaaacaaggaataaatgtggtggggtcatctattgacccctgaatagtcaggggtcaacaaacatttctgtgggccttactgaccctgttataactactcagttctgcaatcatagcatgaaagcagccatagacaatacataaatgaatgactgtgactgtgtgctgataaaactttatttacacaaacaggcattaggagccagatttgtcctgtaggcataattaggcaaactctggctatactgcccaaaccctggcctttgggaacttccaatcaagtgtggtggtaagacttgtaagacttttcaggggaagcaaggaggagtcagggactaacttcaccatcatccagaggagcatagaaacttggtattttaagacagcttactatatgaatttcccagagaggaacacaagtaaaaaatatgacctagagcaaatagctcaggttttttttttaacactgcctttcaaaataagtaacttcaactttgaaacagagccttcccttttagtagacattttccttggaaactcagctcccgccttgatcctagaagttacacatttgtaggaataaaaatatctgtagattaattggtagacaatgcctgatcctgaattctgtttcttatccttatatatgaatagacagagctgagaagtcatttatccagcagtttgactagaaggaaatggaaagtgtatgggtagcagaggaaatcattcacttccttttctattcttattattaatatatgatcttattattaataatataaaggaatagcaaatgagaatccatgagcaatatcagaccatgaaaatgagccagtggctgagtaacaaccaattaggacacttgatagtttagcaaagttgccaaacaggagacagactcggctcctttgaacgaagagtgactgcagtgtggattccccagataggagagcaagaacatactttctgggcctctctcaggatcgttgtttgggaaggaagttgtatgggaaattcacaaactcttagatgctaacatttaaatgcagcatgccacacacacaaacccacaaacacaacctttttttcatcaataaaattgcagaggagccccatttgcacagtatatcacattgtattttaatatccaaaatggctagtcccttccagagtttttatgagttaatgtgtgctaatttaatgggcctggtgctttattcatttgaagcaagaaattaagtctgtgataataaggtaaggttcttatcagatttctctttttgttgttttacagttttctccttgtctttggttgcttgattttgtcagtgttttctaccatccctgagcacacaaaattggcctcaagttgcctcttgatcctggtaagtgaaacatgaacaagaacgtacatgaatgttgtataagaactgcctataacatttatactatgcatcttatcctacaaaaaaatcctatctaaaaaagagttactgagaaatataaaaatgtcaaagattactgaaacatttgcccaccaatttaacatgtagtcaatccttagaaatatatagaaatgttcaggattgctattacacagcaatatcttgtgttgtagatatatcataaatagaaggcaatattagaaagcagttttaagtatgtttatctatgctaataaacaaattatataagaagaatcagtatctatgaggcctctcattatattgtgaaagactatagagtagagagcattttccaataactgtaatttggcagtagctaaatataattggccaagaactatgaacatatggcacctcataagaaaatagaaggctccttcatgctcttttcaaccaacagactgcattatgagttttgctgctaatgcagttacctggtgataaattctgcagtttgctctgtttccattatgctgtcaatcctcaaccacacagaattgctcaattcactttaaaatggaaaaagaccccaagatatttttatcagaattattctgagccttttaagctctcatactttctattacaactaaactatagcactgtacactctaatcacatctgattgaaagtttggttcattttcaactattttgacccactcactttgtccaaaattatcagatttgacagtcttagagctatttgaatgaactacaaactggaacagctcactgtttctgtaaagcctaggggtatacagaagcagggggaggaaaacggtaagatggtttatgtgccctaataagcagaggttggttatgttacagcaataaatattgaatatgaaaaaattgttactaccacgaaggtggaaactgaaagatttcaactcatataacctgagagagggggcagatgcttttcctacctttgctttcagatggctagtttgtactcaaggttgctaagacatcatcaagtctttctgtgcaatatcagggagacctcattttgaatctgtaataaatctctctcaattcatttgcatacaaattgtgctccagcagcatattgctcatgttaaggttaccgtttcaaagcccaaggtagagaacagatagaccaaagagcacatcagagatctgttccatttgcaagctttccctttgggtagaaagtaggcttttaaccttgtctgcccttttgataacacaaatgatctgagcccaagggctaaggtatagctggcttttaggtccacatatggaactacaaccaggaattttagactgaaaatataaatctgatttttaaacttggaaacaaaaaactggatctactgcatgaccaatattaggaataaatcaatcattaggaatctcatgaaaagatttcttccagagccaggtcaaaaatccaaaatgttagatttatatcctccaaacctctgaaatataaattctgtcattgctaatgaatttctaaatagtccaaagaaacccatgtaatcacaaagtctaaaactgattagtatcttgacttttaaaacctgttaaatagtgaacaatggatcagagtttagtaactagagtgcatttagtagaaaataaaaatgtagatgtcagtcttgaatgctttctgatttagcaaggtggaaatgagttcctctatgcagatgaggcctttgttttgagcaatgtggttagtgctacagatatatattcgcagaaacctgttgcaacaaggctttccatagggagagggtttgttaatcctactatctttgtactatagtgatacattgtcaaagtatattctcaaaacctacctagaaatatgcagactgcattgcagagctaagattcacagatgaaattcttcaccaatgttttctccaaaatctttttatctggacacaaaaattcaaatactgtcttttactttttctttagcaatgaataaattaggaaagcattaatattttaattatttttcacaatgagttaacatagtatattataaaagttcaatcatttgtagaagatttggaaaagtcaatcattaagatgacaaatcttaatgatttaagtaatgtctcatttattaccttttaacatgtatttttgagacagttactatgatttcaaagtcacagaactcatagaacacgattctgattagcagtaaagttcccaagatgagacatatcgaaggaattaccatccaaaggaagaagaaggattatcattgaaatagtaaaaagcaatggcttttaaaatgcttgcaagaccaggcacagtgactcatgcatgtaatcccagcactttgggaggccaagacaggcagatcacttgaggtcaggagtttgataccagcctggccaacacagtgaaagcctgtctctactaaaaaacacaaaaattatctgggtgtggtggcatacacctgtaatcccagctatttgtgaggctgaggcaagagaatagcttgaacccaggaggcggaggttgcagtgaaccgggatcgcaccactgcactccagcctgggcaacagagcaagactccatctcaaatatgaataaaataaaataaaatgtttgcaaaaatgtacaataaatccacatttgtacacttttcgtgtacactgttgatgtataaagacaacaccagaggtgtacatttagaactatgtgtaaatcctatatcaagattgtgtattttttcataacttccatcccttttggtttttttaacattttaaaatatgttcagatatttcctacaattctatttctgtgcaagtgaaaggcaccgacacttgtgacagggagcacactacaggcaaacctggcttgtagacagagccctctttgacactcactcttttccacctaattgttcccttgagggcaccagcgtgttaggtgcaggccatccctttagacatctcttgcttgcctcctgggggcccccataaggactttcgctgtccatcccacatccaaaaaggaagtctcccctcatttccatccagaatggcactgccaacgctcttgtaaacttgtaacttcacaaacttgccttggttacaagccaaatgaatacctgtgttaatttgctcatttattcttttcagttgtgggaactgagatttcagcctatacaaccaggttccttatttctctccatagaagcagtggagcatagacttaagaatgtgatacagactatagtcgggctccatgaattcaaatttcactcctgtccaattttagctgtgcgacttggaaaatcactccactgtgccttagttgtcttatctgttaaaagtgaataggaggattctagaagaaagacagagtaggaatcaccaggattctgtctccccacctaaacaacaattgcactggcagaatttgatgtaattcaatggatggaactctggaatctattgaatgtttgcaacttacagaggaaggcttagatggtaagttgcagttaattttgtccatttcagctcttagcacagtgatagctacccatcccctacgcccaggcccattgcaggcagctgtgcacatgttccaggagggacctgaacacagcttataagagccaggatgggcaaaaagaactctgtcctccaaatatcagaaatctgacctcggatcactaattgctgcttctgatcacagaggcgcagacaaaaaatgtggcagccattgctgttgcaccttcacccattgctgtaagcccctcccctaccagcaaaagtgacttctaggggattaaaacgatcctccccacatccttcatttttcttttttccttttttggaatacagtgtataaagatgtaattatgtgacattaataactgaaaggtgtagggctagagatgtaaaggagcagagtttttgtatgccattaaagttaaactggtataaattcaaattagagtgttataactttaggatgttaatttaattcccatggcaaccacaaagaaaatagctatagaatatacacaaggagaagtgagaaaggaattcaaacatttcactacaaaaaaaaaatgaactaaacacaaaagaaggtagcaattcaggaaatgagagacaaaaaaagctatgaagtatatgtaaaacaaagagcaaaatgatgaaagcgtctccttatcattaattactttaaatgtaagtggataaaagtttctagtaaaagacagagattggcagaattgataaaaatacatcattcaactgtgtatatgcttagtacaagagacttactttagattcaaagacacaaatacattgacagtaaaagggtggaaaagatattttatgcaaatagtaaacaaaagagagcagaggtggctatactaataacatacaaaatagactttaaatcaaaaaagttataagagataaagaagggcattatatattaataaaaggtttaatacaacaagaagatgtaataattataaacatttatgcacctaataacaggtaataaaatacatgaagcaaaactgacaaaattaaagggagaaatggatagttctacaacaatagttgtagacttcaataccctactctcaataatggatagaacaaccaaacagaagataagtaagaaaacagaagacttaacacaataaaccaactaggactaacagacataatacagaacactgtacccaataacaataacataaacattcttatgttattcatatgccattatgttagcccgcaagttaagtctcaacaattttaaaagatggataccacacaaagatggataccacacaaagtattttttccaaccacaatgggatgaagttaaatatcaataacagaagtaaaactggaatattcaaaaattaaacagcatgcctttgttttatttttttttcttgagacagagcctcactttgtcacccaggctggagtacagtggtgggatcttggctcattgcaacctcgacctcctaggttcaagagattctcctgcctctcagcctcctgagtagctgggactacaggcacgcaccaccactcccagctaatttttgcatttttagtagaggcagggtttcaccatattagccaggctggtcttgaactcctgacctcaagtgatctaccaacctcagcctcccaaagtgctgggattacaggtgtgagccactgtgcccagcctaaacagcatacttttaaacaaccaatgggtcaaaaaataagtcttagaaattaatgaaaacaaaacgcaacctgccaaaacctatgggacacagtgaaagttgtgctaagattaaaaattatagctataaatgcttacattaaaaaaagaaatatctcaaatcagcaacttcattttacaacttaaggagctaaaaaagaatacagtagacccaagctagccagaacaaaggaaacagtaaacatggataaatgaaataaagactagaaaaacaataaagaaaatcaatgaaaccaaaagttggctgttagaaaaggttgacaaaacagacaaacctttagatagatgaactaagaaaaaagaatactcgaattaatagaatcagaaatggaaatgggaatattgctactgattctacagaaataaaaaggacaataagagagtactgtgaacaattgtatgccaacacattggaaatctagatgaaatggacaaattcgtgaaaacacaaaacctaccaagactaaatcacaaagaaatagaaaccgaatagtgctataactagtaaggagattgaatcagtaataaaaaatctttcaacaacaacaaagaagcccaggatctgatggcttcactagtgaattctaacaaacatttaaagaactaatatcaatccttctgaaactattccaaaaatataaaaaagaagcaacacttcctaactaattctatgaggcattactttgatgccaaagacacaagaaaaagaaaaccatagaccattatttcttatgaacattagtgtaaaaatcatcaacaaaatgctcgtatatttaccagaatattaagaggattatacaccttggtcaaaggggatttagtccttcaatgaaagaataattcaacacacaaaaattgatcagtgttataggccacattaacagaatgaagggaagatgccacataattatctcaattgaagccagaaaaaacatttgaaaaaattcagtacccttctatgattaaaatatatatatatactccacaaactaggaatggaagaaaactacctcaacatgataaaagccacatatgaaaaacctacagccaacatcatacacaaaggtgaaagactaaaacttttcctctaagatcaggaagaaggcaaggatgtctgtgtttgccatccctattcaacaaagtactagacggctgtactaattgctagctagagcaattaggcaactattaaataaaagaaacaaaaggcatcccaactgaaaaagtaagtaaaattatccctgtatacagatgatgtgatcttatatgtaggaacccctgaagatttaaaaaaaaaaaaaagactgtaagaaataataaatgaattcagcaaagtagcaggatgcaaagtcaatatacaaaaatgagttgcattttaccaacaatgaagaatttagaaaggaaactatgaaaacaattccatttataataatatcaaaaaatacttaggaattaacttaaccaaggagatgaagaacttgtacaatgaaaactacaataacattgctgaaataaattaataagacataaataaatggaaactcattccctgtccatagttttgagaacttaatattgttaacatgtccaaagtgatctacagattcaatgcaattcctatcaaaatcccaatgatgtttcttgcagaaatagaaaaacccatcctagaattcatatagaattttaaaggacccccaaattgcccaaactattttgaaagtaaagaacaaagctggaggacttataattttttattttaaaacttactactacaaagctacagtaatcaatcatgaggtagtttcctataacattatgaatgtatttaagctacagtaatcaatcatgatgtagtttcctgtaacattatgaatgtatttaatacactgaactataaaatgattaagctgtaaattttatgttatatataggcataaagaccaacatttagacccatggaatagaatagaaagtccagaaataaacccacacacttacggtcaaatgatttttgaccattcagtggggaaagggcagtcttttcaacaaatggtgatggaaatattagatatccacatgtgaaagaatgaagctggacccttacctaagacaatacacaaaaattaacttgaaatgccttaaagacctaaaactataacattgttagaagaaaacataaggcaaaaacttcatgacattggatttgtcagtgatttcttggacataacaccaaaggtgtaggcaacaaaagaaaaaaacagagaaactgaacttcataaaaatttaaaatgtttgtgcatcagaagacagtatcaacagagaaaaaaggcaacacacagaatgagagaaaatatctgcaaataacatacctgagaaggggttaatatctggactatgtagagaatttctgaaactcaacaacaaaaacaacctaattcaaaaaatgagcaaaggacttgaataaacatttctcaaaaaaaaaagaggtacaagtggccaataagcacatgaaaagatgctcaacattattaatcattagggaagtgcaaatcaaaactacactgagtaccacctcacacccgttaggatggctactatcacagaaacagaaaataacaaatgttggtgaggatgtgggaaaatggaatccttgttcacaattggtgggactgtgaaatgctatagccactatggaaaacaatacagctttttttcctcaaaaaaataaaaaatagaattacatgatgcagcaattccacttctggatgtatgccaaaaacactgacggcaaggtctcaaagagatgtgtacacccatgttcatagcagcattgttcacaatagccagaatgtggaaacgacccaagtgtatactgacaagtgaacggataagcaaaatatggcatatacatacaaaaaaagtattcacccttaaaaagaaggaaattttgacatatgcttcaacatggattaatgttggggacattatgccaagtgaaataagccagccacaaaaagaaaaataatgtatgattccacttatatgagtgagatacctagaatagtcaaaaaagtatagagacaaagtggaatggttgttgccaggggctgtagggatcagggaatagtgagttattgtttaatagatgaagagtttcagcattacaagaagaaaagagttagggagatgggtggtggggatggttctgtaacattacgaatgtatttaataccacactgaaccatactttaaaatggttaaactgtaaattttatattacatatattttaccacaataaaaaaattgagaaaaatcttttaaaagattaaatgagcattaggaaaaatagctaatacacgctgggcttaatacctaagtgatgggttgatagatgcagcaaaccaccatggcacacatttacctatgtaacaaacctgcacatcctgcacgtgtaccccggaacttaaaataaaactaaaaattaaaaaaaattaaatgaaatttaaaactcaaaaaaaaagtggttaatgatatagcctacttcataaggctgatgtgaaaattagataaattcaagtgcttaggactgggcccaacagaaagaaaactcttggaaagatagcaaatatgatcatcatgggatcttccatgtttaatggagacctcatagggacacaagtacaggtgaactgtggaacatttgaaaatgctacacttaaggaaatattatattttataatagaaaacaagtatctgtgtaagagttttctcaccgcaatcactgttaattatggaagcttgctacataaacatgttctctaaaagtgactcagtggtacacattcggcatgcagcatgtgttcacaatagccacttatttctggtggctaatgaaactgatttcaattgttgaagcattttagtaaatacgtctgatgacagtgcttgtggctttatatctcttctctcgatgtctgcatctactgagtgaaacattgggcaggaataactccagatctgatggacttgcttgctctgccatcaccctggtgataaaatttgtgaactcaagaacgtgtatgaaactgtgtgtccacattccagggacagttaaaagctggtgttaatttcctatatttggtgattccatcaaaaatgaaagggagccagcattttttaagtacccttcatttattaggctcattgatttcttactagaaaaataaaactggcaatgtaagtatcccctcccattttcacaaatagctaaataagttgtgcaagataacacaccaagtgtaaaatagccaagattccagcttaggcctggctgaggaaaagactgggctgtcttcagagcatcccgctgcctctcattctcttgcttctttcaaggctgacaagtctaccaaaatgcatttgccagtacccaatgaagtgctcatgtctaaggcttctttttgttccatatatgccaaataaggcttacaacacttttacttaggatgctgtgctttcataaagagttccacttaccaagttatcacaaatgggtatatcaattcagaccactagaagttctttgtactgagaattctaaattctgttttgcaaatattcaagagcctgattcatggggtaaatagtcaagtgtaaaagttcatcttctagccccagttcactttgctcaggtgagtatcatgctgttgaagtgagttctcctatttccaggttagactattgtggtaagttttgtttggtttgttttgatttcattagccaaaggttgtaggttttagcattgtatttcccacctttttgagaacaatactgtctggagtgcatttcctctctgttaaagaacttcttgccatccagattaattttaaagtatttattttaagtttttagatgaaaattgtccatcatgttgagaaaagagaactccatttgatgaaagtgatgcatattatttgcaaaattcttattgcaggttatcatttctaaaagtgcccacccataagcagtaaaaggaatgccactatcaattttagcaagacagagcctgtctcagtatatttgctcctgtaccctcctgctgtgttagaaagactccaaactacaaatggatcgtgctcagcatctggatgagtactctatccaggctttcccaaacatccagatgtttgacagcttctacatatgcatattttctccttatgcttcaggtagcaaagtaaacatgggtttattgtttccctgcacagtgactctgctcctgaattgtgtacaaactcaatttaggcaggtctaattatatcttaaatgtactagtggagcttactatttaaagaaaatctatagggaattcttttgtaaagtgaagcatccccttggaaaggtaataacagctacataatttgttacatgtttgttttctttttaatgcgggcacatgcatttttaattgctatataaatattcactatatatatataacatggtattgaagaattagagacatcattgccacttcctatataccagtattaacgggggagggaaaaatcagccacaagcacatttactggtccttgcaaagtagaaaggtttgcacatgaaattgtaagggtttgatacagaatgagatgacagtagtctttacatttaaaacttctggtattaaatattgtaagagaggataacagagtgtaaggataagaatccattcgaggatattaaatcttatgtttgtaaaggcagtaacgcagtatgagatatgaagcaatcagatgtgaggaatgagcaatgcttctttagatttatcacatccctataatttactgcagaaagctctcagaatatcccaatgaacattgaaaactgcagttattttcctttgcttttctttcatcaaggaaaaatgcaaataaactctaaaatgattcacagagactaacgaccctcatcaatctgccgatgactgaaaagaaaaaagcaggaatagttaaacacctacactgaaccttaacagaaggataataacatagtaagttgccccataaaaagtatttcagatattagaggaaagaatttttgaagctaaagataatgattgtgcctgaaaaagaccatgcctctatctacaattaaggaaggaaagaattttccatatttttatgcaaacattgatgtctaaccaagtggtccaggctatgctaccaaactctgtacaactttgtttcaagacttgacaggctacccagcagacatccttagagctataaatgagccatattcaaccaggtccacactgatgtttagctcttatgcccttttgagcttcacaaaagtatatctgatggagagagaaagagaaacaaggtagtatgataaattttacagggttactggaaaataagtcaaaatgtttgtcagtagaaggaaaaacacccttcccttactatctttccatgctgtgatcatttccatcatttgaaacctggaccaaatacctcctccttcctgaaataaactttctttcctctaactttcctcagtcctgtctacttgacattgtatcttctccattattcatttattcaacaagatgtatgcagtacccaataaggatgaggcattcttttttaagagctgaggagatagcaatgaacaaaacagccaaaatctctgttctcatggagctaatgtttttgtggaagacctagaataaacaaacaggaaaatcaatatattagatattacaaataaaaggaaagcaagaaaaaggaataggtaatgaaggaaagtttagatagtatgtttagagaagtccactgaaatgggtggcagagacttgaatggaatgaggcgatgaggcatgcaaagattagggaaaagaaaatgccaggcagatagagcttcaaggacataagctttagacaggagcatacctggtgagacaaggaagggcaagaagatgagcaactgaaggagggtaagccagggttgggagaagtggagaaaatgaggcaccagttgaactgtaaatttcctgagaagagaatccaaagctgactcagtgacaccacttaatacagtaatagttggtggcaaatcatcagtaaatgaaaggagatggcccatttaattatataacactaatattgacatgttcatggaatcatggatatggcaccaaaattcagacaatatgcaggacctgactttagaatggactagagcagagagtaataggatgggggacatttaggaagcaggtgaagttattcaagtaaaacacaatagagccctaaaccaaacagaggcagcatgaatagcgaaagggcatggactagaacaatatagagaacttacaggttaaaccaaaactgtaagtcctgtataattggtttgtgcctcacagaaatttctgggagggctttcctcagcagattagaagtattctgccccttcagttactacatagctgcaggttacctgcctcctgccagacatggtttgctttgtctgtggttcccatttgcttactgcctctctgattgattgagacctgccatcttgctctggcctacatatcccaactctggatttcccacttggtctctgatcctgtggatttctatagattttcatatatttccctgggttctgcttacttcctcttctaatttctccagctccagtcccttaactcatgcaattttaactcaaatatatattaaatgcttcctacattttagcccctgtgctggggtctggagtcccaaaaatgaataaggcatcgccctgccctggaagaattcattgtccacagtatggtattttctacaacctctgactgattccagaagaaaataaccttgaaatcatggtgaaattactaaattagaagatgagagagaaataggttaattcatcattttttaagttcccactttaggacatatccacacaagaaaataggtctatctctaagtcatttttttatcttggagattacaaatgagatgatcaaaaactattttcaatataggttactactgatcatgcccatttattgagtattgctttggtactgcacaaaaccaaaagctggaagcaatagggtaggtcccactgttccccatgcaggtatacacaccaggggttacaactaaagtgagaagacacatcatgcctctgcaaagtagattagagaaaaattttccaagctgtaaatggcagcttgacaaacaacattacaggctggattcaatgaaaacgctgcagacctggctccctccagggctataaatcacaatgaatacacagaacattactggaaaatgcagaacagaaaagagactgtgcaagtgttacaggccctccagccttggctcactgaagactaatttagggagattcagtgccgcaaggtctcagcatcatgggaaaacctggaaagccctcctcatgaaagaacactgcagaagagtcttaacaaagaaatggaaactccagaccaaaacagctctcaggggagaccagaagggtagaaagtaaaagaggaccacccctaggagtgcagggcagtagggaggactcactctggttctcactccccaccccttactctcctgaacgttattttttaaatcaggtgaaatcaagtatgaataacatcaaatgcaacctcaaaagaaagagaaatcccaacatattatgttggaggagtgttatgcagaaatagagaagggccggggggcattcctgcctctttgacttaatgataataatgactggagaatttgtgagttaattacacctctataagtctggaggtttctctgcctgtcagttagcccatctgtttctcttccataggctcctttctgagtcactttctggtcttgacctatagcctacagcggtggagaattggatgcccagggtcactgtagccaggcagggatgcgcatacaactgggtgaggcaagtgggctgtgtgatgagtttgggaagcttgtcagtttgtagagtccaagaaagagctatggagacctctaggatagaggtcgagctgtgtccttcgaaaccccaacactgtgaggacaaacatttccttaagtcacttctgcagttttttttttaatcttgagctgttcattgattcattaattcatttattcactcatcaaatattcactaaggacctaccaggtatgctgtgagccagaggcatggcatacattatataacagctgtacactgagatactcatatagtccccatcgctgtctgtgatgattctttaaaattattttcctagttaaatcaggtggagaatgtggagcattatgcaaatacagtcaatctgctaccttaagtttccctaatgcaagttacctcatccacaatttatgaaattgtacatacagtaatgatgtcaatgtaacacagaagttagagattatttttctcatataatagcagctcagcatacaacacattggcctatctgaatgcaccaagcttgaaggaatgcagtactgccatgtctaccttctttattttggatactcgctcttccttggaagttacttagacagatcttcccagtcttgtgcagaagacacaaacatagatgatgaacagaagtaatccatcattagcatcaccacattgtatgcaaagccaacacctctgtctacctgtgatatatgacagggtgaccttatctccataatgcagcagcctgaatatttaccagcatcccagtccatcaagctctcttcacctacatgttaagtgaaggccaagattactccagcatttccttattagaatttgacatgcctttttaattgtacttctatcttattagaattgttttcgttaggtctctgtttacaacgtttcctaggtttagagtggtttggttgaattctatttttatcataagccctgttctttttagtgtgaaatcttgccccaaactatgttttccagcaatgtatatatggcattgtggcaggaaagcccatatttcagtggatagagtttacccattctgcctattcaaaagcacactatattctgattgataatgcagtcctttccagtgaaagacatcaacaacacaaactaagtttggcgggtatcatccttaggtcccataaatcaaaaggataaaaggataaaacctgcatcaggacatggtttggagtattcttcatccaatcaaacttttctactctcctttatccagctatattaaagaaatctttaagctttacaaacctatttatcaaaagttcaaatttttaaaattagcctaaattttaataaagggaactatcaggcagtttagattgaaaaacaatgttatatggtgttaaagttagaaacaaattttacagctattactatagcacaaacaatattttgttaaaaatataagacagtctgatttaataattataagctttctttttcacttatttatgtattttgacattttctcagtgcatagcacctataacattgggatcattctgtcttttcctatttttaacccagagtaaaattccaaatattttttagaattaaaagatttaattctttaccttatcagagaggaaaaaacaaagtcttttatctgtccactcacaatacagaacacttcttacaccagatgtgtgggggtttttccctacacgcaaagcaagcgatcagttttagagtggacaccagctgggtgtcctctaattcaattcagttctgataccacctacctggagatagagtcagatcccacagatcttgtggctcagtcccatgagactgccccaactttcagatgccaattgcaagctttagatttgctttcttacctatgcttccaaccaatcaactatagatcagcgttctcgtgaccttctccttgggctcaattaatttgctggaatggctcacagaactcagggaaacacttatttcatttaccagcttattataaaggatattacaaaggatacagatgaagagatgcatagggcaaggttatgtaggaaggggtgccaagattctatgcccttcctgggcacaccatccttcaggaacctccagatgttcagctatacagaaattcttcaaaccttgtccttttttatttttatggagggtgcttcattacatagacatgattgacattgtccactgatcatcaacttaacattcagcccctttcccgtccttggaggttgggtggtgggattaaaagtcccaaccctctaaccctgtcttggtctttctggtgaccagcctccatcctgaagctgcctaggggtttccagctaccagtcaattcatacaaaaagacacttatcactttgaagattctaaggattttaagagttgtatgccaggaaacaaggaggaagaccaaatatactgtgtatttcacagtatcacaccttgctacacacaggcttctcacatcctgatctttcctacatctctaggctaattgctgcaccaatttcccttaaaggtgcccacacatgcacacacacacacacagtcatgtgctacatgccagcaatactaaaccattcatatttttcatgcacactgtctctgtgcctttaaaaataatgttccttctatttgaaaaacccagttctaccacttcccttcaccatcttggtaattcctatcaatttattaattctcagctcgctctcttcttgaaagtttaccctgactctccaggagttgttacattccctacccttgtgttctggggttcaacacagctcagagggaatggtctgtagcagtggatggtctataacggtgttcatcacactctgctacagttgttggtttccatacatacttttatttctgttagattgaaaactatataagaataggaactatttgttagtagtctatgtatttcctagtatgtatcacagtacttatcatacaagaggtgctcaatacctatgtgaataacctgaccattcaatctaaggaagccagcagtgattctccacatgtattcctgttttattgtctttatagaatttataactatttgatgtttgctggcttatttgttattgtctttcattattggttttattatacataagaacataagctccctaagagtggacccttattgttttgttcatcactttagccccagtgcctagaacaaaataggtattcagtgcctggagcaaaagagatgcaagataaaactgtcaacttcatgtaatgaatgagtagattcaggtttttctctcctgtactaatagcaagctttttaataaattagtatataggttcaatgcctccatggagacattaaaatactctggtttcaattaatcttgcaattttagcagtattaaattccaaaaacaatttttcactcatttggaagatctataaaggcaactgtaattaagtaatgtggaacacaagtttcaaagtctaaaataaagtgattattcgctcattttgtgcctcttttttttcactcttcctcatttttttctgagattcacttacccttctgagtctgggctaatcaatcatttatgttattaaagcaaatatgcttatctaatatcaaagcagtataatcatgcacattaaagaataatagtataacatgagtctgtagccaacattaaaaatgcataagatcatgtaacaagaattactgcaaagacctagccagttattcaacactaacatattttaattaaaaactaatttagtaataaccgaatgattcactagtgatctctagatgcaaaaaaaaagactagtgtcttcaaacagcttcctataacattttagatcaactgagcctagtcaaactaaaacatagttaccaatccctcctcagacctcacatgatacttttgtttttcacttttaacacatattttgcttttaaagcactgtgtccagtttaaatataaactggacacagtggcttatgcctataatcccagcaacttggaatgctgaggaaaggggaacacttaaagccaagagcccgagaccagcctgagcaacacagtaagtcctcatctagcacatgcctatagtcctagctactcagaaggctaaagtgggaggattgcttgagcccagaagttcaaggctgcagtgagctatgatcatgccactgcacaccagcctgggtgacagaatgagtttctgtctctgaaaaaaaaatgcattaaccaagcatttcttgagtgcccactagttctaagttaagtgccctagctcattcctgacttcattcatgcttaaatgagaggacctaagtaagtagaatgaaagcctaattggttacaagagaggaagggactcatttccactggcaattgaaggaagcttccatagatggagacatttgaggtggttctagcatcacaaaggtcttggtcagtctggctagattttatgggggtcaggtagatgaacagaagctcaaaggaagattgaaacagagaagaacctactcttctgagtacagtcatttgaattttatgttgtaagtgattggaaatggaaaggaggtccttaagtagcacaatgacctgatctgatcaaatttggttttgagaaagataattttgactatgtcttgaggaataactggaatggagaaggaatagtggagggcaggaagaaatggaggctgctgcattgcccagaagctacatgagcatcaggactaaaatagaggcagaaaagatggagaagaaaaactgaattcatagaacattcctgaggccaagccatcaaggggtggtgtttgaggtgagaggctggaggtgaggatttctgcactttctgactttggggcatggtcagatagtgatgacatcagccaagactaagaacacatggtgttcgacaatttcagaggagagataggctggttttaaatatattacatttgattcatttggggaccatcagaaggtactggaaatatttatctatagtccaggagatacgggagtctggatttggagatcatggctatgtagagaaaaagaagggaactcgtgaggtggagagtgaaaaaaaatggataaggaaatagtagccaccattatgatgagcaaaacactctggaaacagacccaatattaacacacttcattttcgtattaagcccctaggaaccttcatttaaagcagtgcttctgtcaaaatttagacttgaggcatttcatcagatgccttcccaggacatggcctaacacctgcatcattttcaatgctagcatttaacttgttagagtattagcttacagcagtcttcatccaaagtcctggtgctctgggatgatggaagcaaaattggggatggcgtcttcttcctttgaaagagctatggattaacattgcattgaggacttattgatattaattattttaaagagctcactgggaaccattcttaaacctaatctaggataaaaaaccagaaatctttagggtaattgcagtaacctgctactgccaattttttcaaaggacaaagggatggaattctccaagaaatggagcaccttggaaggtttaggttttttatctacataaatatcattgtttgcaggatactagcatcactcccaaatgtcaattctctttccaataattactgggccaatcataattgcctcttaacgcatcaaagggaatgtcttgctcttgacaaccacacacctaagctattatgaactgtaagcagtcagtccttacccttaagcctctggcataaataatcctggccaaatacctgagcagcaaatatcaatataggagttcaaccactgacacaagcacctgcatcattaggacagaatgatttcaaaggacaaggtaattaaacaaaaaaaaataaccttaggttacccacatatgtgaacctcccttgatatgccatcaactgaaagcgatagatagatagatagatgatagatagatagatagatagatagatagatagatagttgatagacaggtagatctcaaagtttggggtttgcagcagatgagggcaggaaggcaaaagagaagaattaattgcttgggaaaatctccaagaaaaaaaaaattcatctgaaatgagggattgctctttctcttgactcagtaatcttcagaaatagaggaataaaataaaatcttcacataatttgactctagccagagccagaattcagttttatgtttctttcaactgccaacaactttgttttaattataagatggaaatttctaaccactatagtgactagcagctttttataagactgacatttcagatgaacaaaaacattattcaaggagattcactttccaacagacaaaatgtgaccaaagcaaataacgacattcaagttgtatgaatcaggccctagcctataaatgttcagtgcattctgcatgacaatagtcatcccactgcccaccttcccaccagcacagtgtctctcctcaatactcaaagatttcaattaagtaatagtatcaattataagccacatgcttttcttaatattttgaacactcaacatttgattgagaggcacgggaagataggtattatgtccctaacttccttattaatattctcacttcatggccactcctttacacgcagtgctaaagtcagaaaataagataaattcaaagtctctactccccagctttggcttacatgccagaaaaagtgaaaagtgatctaattctctctattgtcatattctaaagacatccgagccagacatttgtcaaaattggagaaaaggatggcaattttaccaaaactgttgcaacataattgatgctctagattttccagcaagaagaaattgagcagctgaacaagataagcaagcattctacaaacttataaataaaaacacttcagccgggagaggtggctcacgcctgtaatcccagaactttgggaggctgaggtgggcggatcacctgaagtcaggagttcaaaaaaagcctgcctaacatggcgaaaccccatctctactaaaaatacaaaaaaattagctgggcatggtggcacacacttgtaatcccagctactcaggaggctgaggcaggagaatcacttgagccgggaggcaaaggttgcagtgagccgagattgcaccactgtactccagcctgggcgacaagagcaaaactccatctcaaaaaaaaaaaaaaaaaaaaaaaaaaaaaaaaaaaattcaagtgttccgaattcccatttaaatgtattttggaaagtatataaaaatcaaatataagatggttcttcccatatctgctgtttttctttcctttattgccagtaaacaataccaaatctcacattgtttctcatctcctcaaagacattcttggaaacttgtccgttcatggccacgttgaggaccagggctgagtagctgtgggttggcacttggcagtgagcagaatagtattcacttgaaagttctcataattatggaaaatcgtctaatgaggatatgatatatttatattttcaagcttctgcttttagcatgcatcagggaatgccttgttcttagcttagattctcattcctattcccttgcctagaatagacacacttatgagtcttgtcccagtttccatgccctgatcctcggatcatctccaggtgcccagttcctttcagaaggatcttctgtctctaccaaaacctggtgagggatgagagcagctgtggtcagagcacaaatccaaacttctgcccaaggcctttgtcctggaatgtactccccatttcttgcagagtaaaagccaaagttcttacagtgacctaaaaactatgtagggacacagtctagtcagccattcccagatatcctcacctcctatccctctccttttacccagtctacttcagccagcccggtctccttgttcctcattcacactcagagtttttgcaccaactgatccttctgtctcgaaacttctttcatcagatatctgcttgactcccttaataacttagagtttgctccaaaaggcctaccctgctcctatttaaagctggaaaccttccatctcttcccagcaccttcatcctcttttatcactctctatagcacttatcttccaatgctctatctttctgtatcccaatgtacttgttcattatattatctgcttgcttccactagaaacatcaaatggacatggatatgtttactctgttcagttctgtattccagcatttagaagagcacctggctcagcaaatatttaatgagtgggcttattttatttaacagagttaaagcgatttctgtgtatcaggcactgttctaagcactgtaaaaatattaattcatttaaagtctggtgacaaccctattaagaatggatttttcattccaattttatagaaaaaaaaaactgaggcacagagaggttaagttaaattgcacacattccataaatggcagacccctccatgcttctatcccctgggctctgctgaatgaatgaatgagacatagtggaaaccaccttttctgcactttgttctgagcgtcccactctgaccaaattaatgatcccagtgtttgacattgacccattgaagtcaatgtgctggccctttgcttccccaaaacttgtagcttattagttatttagaagccagtatcaaggagaaagaggcaagtaggccttatctactgggataggtctaccttttagtagaagtatgaaaaggatcaaaacagaatatgcaaatacagatcaaggaactagtgaagatagggctgtggaaatgaatctcaagccccttggatcagcagtagacccttccttctggtccagcttgtcatgctttgctaggctaagggctgcctccacagattgcaggaacctggaacttacctgtgggacagaccgacacgtatttgcatagtaatttgtacagctagctgtagcttattggaatgattacttcaatgtttgggaaacatttaagatgattgaaagggggtaattagcatttgggaggaggcatatctcctatcaattttcctttgagtcgatacttagagaatctctgctaacaaactgttgccaaataaagatcctgctgggttttctttaattaatgagatggcttgattgtaattattccattaattgtttaaatgcaaataagtgctattaagggtcttgaaaagtgtttcctcttaactatgctaaatcttcccccttgtcctctcatttctgttctgaatttgcctagtatatcctcttttaataaataatacaaaaataagcatcaaccaaactctagtggtataatcacaaattctgaattaatggagtctgaatagaagtgatgaattgtattagtgttctggaagaagataagattccactgaatccatatttaccatgcaaacaagcagggtaataaaacagaagaagttgtaaaaatgggaactttcaacagtgtaaacaatttatagtctctgatgagataccaatcttggatatataaacctagtctttgaatactgtactttcagtgactctagatactctttattatgggggaaaaaaattcttgccttaatacaattctattccctgcctgccaagatatggggctgggggatactgtactttcagtgactttagaaactctttattatgggggaaaaatgcttgctttaatacaattctattccctgcttgccaaaatatggagcagcagagtctccccagctcccacacctgcagagagattcttggggcttcaccacggcaagacggtgtgaacaacacagctgcatagtcaggctacctgtagggaggtgtgagagcatttcctccctcgaggcttcatggctggcctggaatgtaagcacggatgaaaaaggggatgcaaacgagagaggcaagagttgtttcctttacagcttaggaaatttttcagagctctccttgtttcaagaggagaatccactgctgtgggttccttgttcctttttccttcagcccagccaccccgttcactctgacccaggctgtaaatttacttcctgtgcacgttgctctaggacttcttttatctagattttacaaaaggtcaacttgacaccgctctatcactttacatctattcaggcatgccatgctgcttaggaaagagtaagaagtgcactttctctctccaatacattcttttctgggcagactcttagttctgaatagacagttatttttgcccagagcttatttcttgttaatgtcctgtaaattcaatatatgggtctatatttccatggctttggtcactagttgtgtacaggatgctttattagttaaaattgtgaatcagtcctctcatatatcattaaagtactaccatggtctccaaatcaagtgtcgtgttgccaggtaggaataagtctacaaccaaataaaggagcaggagagtagaggagggtttcaagttactgtggcagatcagttccctcctatactaagtgattttccaaatcaattcaagcaatggcaattcatcctgctgtggatagaggccgtcacccatcagaggttgtttggtaagtgtgtgtgcataatgggtggcaagcaggcagtgatgtattaattaagacatattgatgatgtgagcagaggtgtatgacagcaataatattccaaacactactgtgggcaaataagagtgatggcttatgtacagtaggagtcatctctatcagagataaaagttacacttggcaagcaaggcattttctctccagcagggaaactttagaaaaacaaatgggaatcagaatgtagcttggtaaataacacaacagagaaacggattgtgacagaaacaaaggatactcccatgaattcctggattcagctgtcaggataattcaccattaaatctaactgctaaatatttgccatgtgctatgtgttatgcttagggagcattaaaaaaaatgcattctaaaacacttggaaattgcccaggtagttctcttgtttttatcctcaactcagtttttttttttaagccggtatagaaacatattgattcttaatctattgtttaatggttcaattgaacaacaagcagaagagattattaaattagttcaagattatctctgatcaggcccttcatcttactcaatttaaaagtatacttgatttggccgggcgcggtggctcacgcttgtaatcccagcactttgggaggccgaggcaggtggatcacgaggtcaggagatcgagaccatcctgcctaacacggtgaaaccccgcctctactaaaaatacaaaaaattagctgggcgtagctactcaggaggctgaggcaggagaatggcgtgaacctgggaggcggagcttgcagtgagccgagattgcgtcactgcactccagcgacagagccagactccgtctcaaaaaaaaaaaaaaaaaaaaaagagtatacttgatttatggcatgagtggtcttgaatgattttgatggatgactggaaacaattagagatataaataaatagcacagaatcatgacagatttcatgaagaatacactgtgaagattcacatggttaataacattgaaattattaaaataaaagagactgcatatattagatttttctttgtgatctagttgttcaaagcagcagaaaactttaaattttccttaattttgaaagtgtgattaatggaatattgttacaatgccattgatttatatactttgaggatagttaacttctttatgtttattagaaattgcactgagagctaatatgcagtttctattggtggtgatatgttctgttaacagggcctcctgtcagtttttattctgagatttctgcctttcctgttcttttgcatgagcctaactgactgagtttcaatatcaagttctgaaagcaagtgagcatactagtgtgcatgcaatgtgcacagaaagatgtgttttcctacctctcaaagctcaccaaaggatattactcatattgccacaaagtacatttacaccaataacacatactttggtaatgggaaaaataaataatcttaggtaataaaatgcactttggtgcttataaaggaaaataatcatcataggtagaagaggaggaaggcaagactaggttttgattcaaaatgttttctgttttgctaggaagtctagaaggaatttggtcaaatgacctgaggaggcaaggagatttctcccagtggcacatggcagtccacaagaagactaggggcagggaaacaaagcaagattgtatctgatttctacaggactccaacactaccctgccaatacccttttctcctctgaaagccatgatcccaaaggtttccatttcttccgggtttttcacattctaccaacaagcagaatgtcttccccactgacagctcaacagttgagcttttcggggttctaccccttcatcaacacagcctttgctttcctggttactgagtaaataaaacacactggccacttctgcttagccttcaggagccactctggctccaccctgaagttccatttcctccaagaactaagacatttggagattctgcctaaaatatgcttaaataaaagggataaactgtctctcactttctttcccccacagcttgtcttaagaacaacggtgtaaccattagtgaaaaatcctttcaggctagtaaaatgtaaaaagagaagaggtatcgggtaacaacaaatgaaaataaaatcattcagtggtagaaaccataggagtgaaattaggtagttactgtcctccagcttacattaatcaaaataagcccacactgtcactaagacatcttgcagtaagaagccattcaccctctcattgcaattagtgtcataaagctgaatagacaggtcagaaatgaaaatcataggccaattaagttattctcatttttccacctccagctagctctttttgagaattttgattttaatagataataaaacagtatgctaattgggtggtgctgagcctgaagccgtgaactgaaggaaacttcaacaaacatttggctagggcctgctctaagcagaggggctacgacaatgggtaaggcatttctctagaaaccagcactcagcagaatttctggcacgagattttgtgagttttctagtggtgtgtcttatcttcccccaatagattataaactcctcgagggtgacagaacacattgctgatctttatatcctgcatgtttatggtattcggtagacatttataaaatgaattcatgaaaagcagaacatctagaaatgaagtcaacattgcagagaagttagctatatgaaactctgtaaataccctcaaggaagaaggaagaagcagattttctggaaatcaagggacctcccagtataagagcaattcctttggtccaaagaagggcagctataagaacagagacataactcctccgtaagaaaagataaaaattctgaaagttctctaagaacatgcccagccctgacctgcctctcactctcagtagcatggaagccgtactatctcttatcttgacacaagcatccacttcaatccacaggacaaatatcaccaatatgagaagataagatctgttttatagtcaacttggctgacatgtactaatttctcaaggtcaggatagctctctaaatagaaatacttgtttgttttaaggaattttatttaaatttgtgtatcttaaattttaattttgatctcggctcactgcaacctccacctcccaggttcaagcaattctcctgcctcagcctcctgagtagctgggattacaggcacctgtcaccatgcctggccaatttttgtatttttagtagagaccggatttcaccatgttaaccaggctggtctcaaactcctgacctcaagtgatctgcttaccaaggtctcccagagtgctgagattatgggcatgaaccactgctcccagcctcatgtagttcttaagaggaagaaaagcctatagattagtgagaagtagacaaattagcaatttgaatcaaatgaaaacttggtttgatttcattcattttggagacactttcggtgtttccattttgatctgattcaggacattgatcttcgattctaagttgcactggttaatttgtgattattttacaaaatcataacagaatacatatctgggtccagttcaaggtacagcaagccattttcaatgtttccagcttggtgtttatgattcatacatgaatcatttgggcatgcagacacacccaaatagaaacctcaaaccaattaaggtataaataggtttaggatgggggaggatggacaacaaaaaaaacctcagtaaggctcctccacaaagggcaccacttcagcttggtcccatgggcagacttcacctgtggcaggtgaaggggaaagcctaagacatcctgtgccctgatgcagatgtgacttacagaacataaaacgtaaaggcagaagggatcatctgggtggctgctcatactaggcaggcattatagctgctgacaagagccaacccatccctaaggatctaaaatcactacaagagaggacggaagtcctctcatcatggcatcccaactagtaactgggatgcatagggccactccaggtaggcagcgaggggtaaaccaggaatgtcctgctgttcccacctcttttccccaagcagggggcacccacttcctgcctccagcccatatggtctcaatttatggcctcaatacctgataaaaaaccagccgtgatccttccttagtaacaaagtgtcaatcagtcatttggaatggggcattttcaaactattgcctccctatgatcttctgaagaacctctgggataaatgaacattgttatttaggtatggttaaatgaattacttttcaggagcagatttatatattaacaggtgtgaaaaacttgaatggataaatcatttataaagaaatttcaggaatcaactaatcccaaggggaaagacccactaagacactagattttgctggagctactcaaacaaattcatctatcatatctacctaagccttccaatcaatgagactagccgcagtgacactgtctgtcaaaactacctcagtcatttttttccaaggcaggaagcatccataccccttcacaccttaatctaatttcccctatctccaccccactcccacttctatgacccccttccccccatacccacccccgaagcatctactagccaacttagtgaagttctgtcacgctctcacaaccacctctgtgcagcaatgattctgtaaatatccatgtgtcctcaacaccaggtcaaattagtccctttggtaaaaacattcattccctcaaattctcttccaatacactaatataccttcccaaaaagtaaggagaagcttgaaagctagctggattgatgatggtatgtgatgttctataagttatagttagtaagcatgtttttaggatatttttctgctctccaaagagacacaattccggaagatatttacttttgtgtatttccacattttggtttaagtttggagccatctctagatcttaatttcattcccctaatatgtgttatactagtagaattttccaaattacatagaattataactgcaactcttctgactgatgccttttttttgcattttatgatgcagtttacatcacaaattctttccctgcagggattatgtaaagaggcatgttgacctgctagccctatgttactttaagtatatgcacacacacaaaaaggaacaaaaacagctgggaattgattatgttgatattctgaataaaagcaatagttctaattatgtatgtctaattagccacagctcttcaagaattgctgcaaatgtcacagggtttataatgtcggcatttcatcttcacgaaaatgctatttgatggcataaaaccagaaaaaactaatggtcacagaagacagcttgtagattagacaaaggtcactgtgttttaatgaacagtgctgttaattaatgagaaaacaactggtacatgagcttttaagcattgtgaatttgtacccaaaaaatcaatctgcctaaaacaattttaagtagctaaaaaacaaaataacggcaagaacataatttaaacctcaaatggtacagcagagttatatgtatcaattaaattgaatcacagttctcaggtgtgacatatgaagaggcttctttaatgcctggaaaagagggttaatatggattggtattctcaatacatattgtagataaaattcaagactagctctaccactgcctcttttcttttttttttttttttttttttttgagacagtatctcgctctgttgcccaagctggagtgcagtggcatgatctcggctcactgcaagctccgcctcccgggttcacgccattctcctgcctcagcctcctgagtagctgggactacaggcgcccgccaccacacccagctaattttttgtatttttagtagagacggggtttcaccttattagccaggatggtctcgatctcctgacctcgtgacccacccgcctcggcttccgaaagcgctgggattacaggtgtgaaccaccgcgcccggccaccactgcctcttaggcttcttaatttccttatcatttaagaagaataagaaaattcttctatgttttaccaaaattctgtgaggacaaatgaggaaccattgtaactcctacaaggtgagtgataaaaataatacacatttattgtctttgcttttgtaaagagttatccaagccaagcttctaggggcttaaataaggaaggacaggaccattgttaataacatcaagtttccactacagctttcctccaaacaagtcaaatattctgaatattattcactaatctctttagctgccatttcagtaaatagcgagcattttatttcaactaaaaccaagcaagagaaaatgaactgctttatcctgaggtacagcagcaaaggcaccagaacttgtctcatggcttacccagcaagggtcagaagaaccatccctaatttaaatcatctcgactgaatgtaacagatttttgtattttcaactcatatgaaaataaaacaatgagacctcatccaaagggtgatttagagagtacctctaaacaaaacacagtgaaaatagacccagcatctggatttgaagaacacatttcctcttacgagtctatcccattgtctagattgctggcaatggcttttttaaatttaaattgttattgagataattgtagattcacatgcagttgtaagatatagtagacataccctgtgtatactttacccaatttccgcaaaatgtaacattttgtaaaactatagtataatatcacaaccaggataataatattgatacagctcacaaatctcattcagatttctccagttttacttgaatacatttgtgtgtgtgtgtgtgtgtgtgtgtgtgtgtgtgtgtgtgtgtgtattggctctgtacagttttatcacttgcagagattagtatatctaaaacaacaatcaagatattggacagttccggccgggcacggtggctcactcctgtaatcccagcactttgggaggccgaggcaggcagatcacgaggtcaggagatcaagaccatcctggctaacacggtgaaaccacgtctctactaaaaatgcaaaaaattagctgggcgtggtggtgggcgcctgtagtcccagctactcgggaggctgaggcaggcgaatggcattaaccagggaggtggagcttgcagtgagccgagatcgcaccactgcactccattctgggcaacagcgcgagactctgtctcaaaaaaaaaaaaaaaaaaaaaaaaaaagatatcggacagttccattgtcacaaggatctctcaagttaccccttgctaaccacatccaccttctccttcacacttgcacaccccttcccttctccagcctgaccccagcagccactaatctgttctccatttctgaaatgtttttatttcaaaaatgttatataaatggaataatacagtgtataactttttaagactgacttttcttgcactcaatataattccctggcaattcatttatgttactctgtgtatcaatagttcattcatttttattattgagtagcattccatggtatggaggcaccagagcttgtttaaccatcctcatggtgaaggacatctgggctgtttttggggtctggtcattatgaatacttcttctgtgaacattcatgtacaggtttttgtacaaacataagttttcatgtctctgacacgaatgcccaagagtacaattgctgagtcatatggtaactatatgtccagttttataagaaacgaccatgctcagaaggaccatactgttttacattcccatcagcagtgtttgaatgatccagcttctccgcatcctccccagcattttgtgttgtcactattttttgccactattttttattttagccattctgctagctgtgtagtgataccattgcgatctaatttgcatttttctgatggctaatgatgtcaaataacttttcatgtgcttctttgccatatgtgtaacttcttttatgtatgtcctcttttatgaatatcctatttatacctttgccaattttctaattgagtttttggttttttactgttgagttttaaggtttctttacatattttagatattagtcctttgtcagatatgtggtttacaaacattttctcccagtctatggcttgtcttttcatccttagtacctgggctctcacagagtaagtttttacttttgatggagtccaatttctcattttttccttttataacttctgcttttgatgtcaagattaagaactctttgcttagtccaaatcccaaaaatatctccatttttttcctaaaagttttattattttatgtttaatttttaaacccgtggtccatttttaaatgattatcataagataggaagtatagattaaggtccacttttttgcctatagatgtccaatttttccagcatcatttgttgagggcccttcttcctccattgaaatgcttttgcacctttaaaacaaatcaattgagcatatttgtgtgggtctagttctgaattctctattctgttcactgttctatatgtctgtatgttccatatgtctatccctccaccaatccacagtcttgattactggagctataatagtaggctttaatatcaggtaaagtgattgatctcgttttattcttctttgtcagcattgttttagctattccaggtcctgtgcatttccatataaattttaaaataagtttgtatctaccccccaaaaaaaactttgctgagattttgacaggaattttattagacctgtagatcaatttgggaagaattgacatctttgctatgatcagtcttccaattcataaacacggtatttctcctcacttatttaggtcttttctgatttcttttatctgcatttcataatctcaatgcacataaaccgtatgtgtttttctaagtggatatttaagttatttttatttggaattattataaataataattttgtgtttctaattttcatttccacatgatcattgttagtataaagaaatatgattaatttttatattgatcatacatcgtgcagccttagtgaactcacttgtttcaagagtgtcttcgtagatttcttgggatttttctgtagaccatcatgccatttgtaaatagagaccattttatgtttacctttccaaactgcatgttttttttttcttttatttggcttattgcagcaactattaatataacttacaatactatgttgaataagagtgatgaaagtatacatcttggttgttcttaatgttggggaaaagcattcagtctttcactattaagtatgatgttaagtttgttgtaaatgctatttatcgaattaaactgttaaacctcttttcctaacttgccaagagttttttttaatcataaatgggtgttggattttgtcaaatgctatttcttcatcaatttatatgatttttttttagctttattatataatgcattatattgattgatttcaaccattgagctagccttgcatacctggaataaatcctacttgcctatatattgactgattgactgtttgctaatattttgctgaggattttttgtgtctaagtttatgataaatatgggtatgtagtttttgttttgctttgttttattgtctttgtctggttttggtgtcaggataatactgacttcataaaatcattgagaaagttttttctcctctattttctgggagaaattgtgtgaaaatgatatattcttatttaaatgtctggttgattttgccagtgaaaccatttgacctggacatttctgtttggggagattttaaactatgagttcaattgctttagcggttatagggctacctagattgtctatttcttctttgttgagttttggtagcttgtagttttaaaggatttggtccatttcttctaagttatcaagtgtatgtgcgtaaagttaccatagtactccttcattttttcagtggcgtagaatctatactgatatcccctattacattcctgacattggggattttcatcagctttcaagaaagagatttatcaactttattgattttctcaaggaaccacttttttgtttcatggattttccatattgttttcctcttttcagtttcattagtttttgctcttttctatgttatttccttctatctgcttcctttgggtttattttacccttctttttccaatttcttgaggtaggtactcagattattaatatgagaactttcttcatctataatgtaagcatttagtgctataaattttcctctcagcactgcttttactgcatcctacatattttgttatgtcatttttttattttcattcagttcaattttttaaaaatttttgagactttctctttgaccaatggactactgggaatattgtttaatttccacatgtttagagatttgcttgttgtctttctgttattgatttctagttttattccattgtggcttgagaacacattctgtctgattttattcttttaaacttgttgaaatttgtttatgacccggaatataatctatcttaataaatgtgcatgggtgctttttaaaaatgtgtattctgctgatgttgggtgaaatgtctcatatcagtcagatcctgcaggttgaatgtgttgttcaaatagttcacatacttgttaattttcattctagtagtgctatgcccatagttctgagcaaggataaggtgggttgatgaagttcccaaatacgacttaacatttgtctatttttcctttcagccctattggttttgctttatgaattttgagactgtcttgtcattttcccctcaccttcttaaaaaaaaaagcagcaagcaatatttctgaacaatagggcttgaataaagaacttgtaaatgtactttatcctgccttactgcagcagaggaatagtgcagtgaccttggcatacctaagaacaatgggcatatatctgtcatttgttaagaacaatggacatattggtgtcatctgtttccatgaaaaagaaaaattactacacggtagtgttcgggggctcaggccacatttgggattttcttgggatcccttataatatgagtactcacaactggagtgccaaatgtcctggcataagcaggaattaggggcagggattaaaaagtggatctgccattcaacctaggttgggcacaggcacaactacatgggcattttgggcctgagtatgttttccatatttggaaagatgtgctggattaacaagaaatgatctggcactttagataccttaataaatgaacagactcaactacccagatatacattcaaaaccaaaacaaagccaaaatcaaacaaaaccttcggattattaatgaatgtatgttgaccctaattttggttatctgtgcataaagtcatctttgaaggtttatcctataagtaattttgaataactgtgagtaagcagtgatgatattgggtatttatttcccatcatgagaaatatttgtggattacttagtgcaaaataagagaaggatagaatgatatagctctactaggcatttcaaaagtgcagcatatcatcacatgctctaattaaagaaacagacatttgcctgaaatttgcaacaaaaatgccacttttataaatttggtaacagtttttatcctgcgagtaagaatgggagaatggggagtaggttagaatgtttactttctctgctttgtatttctgtgatgtttggaagttttaataaagacaatatattacttttacaattaagctattataacaacaatctataaatgttgttctacattataaatcttgaatcaaccctcgttttaaaacaagaaagtgaattattttttaaaggaaaaacaattttgataaataaagtgcctgtccctatagagacagcaaggtgactgtgctaagcttgctccagaaatgctttcgttttacaaattccatttggtttttcattctatcatcgactgtttaatgagccactctagctggcctttccccagggttaactcacaactcttcctaaataatctcagtcattttcctggagcaggtgttgttttctaggcagctcttgccaaagggcagcataataattaacaagcttcagatctggaggattcagggtctcatttctggcaaaggatatgtgtgtcacactgtaatgcttttgaaacttactgttttataaggagattttgacactgtaacgaaagaattcagtatacttcgaaatatttgcttctttttctctaagaacaactctcgaagatttagagattatgtcactccttgcagcaaaatgaagctctattttctgtaaaacttgccattatatttcaggatcgctattttatttcagatatttcacatgttactgggtagctaaagtcagctacactataaattccagacgagacagatccattattcagcctgcacatttagtattgaaactgactcccaaatttacgaagcattaatgacttgaaaaggaatagcattccatgataggaaatgcagacagtatgaggttcaaatgctgtccagatttagtttgatctggagaaaggaaatgttcttaactttagatattaacaactagatcctttagacaaagtgcctaaatgtccaaaaatatgcatagagcttcttactgtggtttgctccataatgcttctctctgatatgtcttatctgatattttaggagttcgtgatgattgtcgtctttggtttggagttcatcattcgaatctggtctgcgggttgctgttgtcgatatagaggatggcaaggaagactgaggtttgctcgaaagcccttctgtgttataggtgaatatcagagtctcagatacctggactatgacaccaacattcttgtcttctatctcctgttttgcaatatttgattaatattaaaagctaacatccatggagtacttatcatggaccgggcactcttgtgtcttgaaaatgttgactcatttgatgttgtctccacagcattatgaggtagatatttttattatccccattttacagttgaagaatttgaggcaaagagagacggagttagttgctgaatgtcatacagctactaagtggtagagcttgaattttagccaggcaatctggctctagaatacccacttatatcaattaacttatatggaaatacatgtttctccagtgttgccctaatttaggggaacattgatttcagtgagtataaaaaaccctttttgctctacaatatgacaccagtttatgctctggatcagctggaatagatagccatacattggtactggtaatgcatatcaattaacattcttcaagaatgattataagtatggtttgcttaatgcattggtaactgtagactggacaaagtgctctacactctgaaatatgaatcccccaccctccaatccaaaatacccaaatacatagcacatctctgcacctccctagctgccattgtttctgagagacatcattcacctgggttctagcttgaaattgtacttcctaatgaagatgccatagagcattctggaattaagatctagcatttcccagtaatatttaaaagtattataaaatggaaaagtctatatataaaagctattattattattatttagtagctaaatttggctctcttgcttttttgtctttctcacttcctaggcagccattcaaatccaaatactgaaaattcttgatgaggcttatttatttcaactattttcaacctgaaaaagtaggtttttaatttacaaaatagtttaggctatcttctacagctaccacaggttttctgttttgttttaggagtcaggaattgttgcgtaatcttctcagtttcctcccttactcctgttccctatggtgggggcagagtggatttaaggaagaaagtgtatcaccatccatgggcactgttaagaagaatcctttattccatacttctttcatagtatgcacatctcaaaagtctccacttattaaaccagaatttatggaaatgtggctgtgtgtgaggcactggtgttacaatagtgaatctagtggaattctcagttaaatctatcttaaaataccttgtttggccctcacgaatgcagtctgtttgtctgtcttctccaataataggctttactgctttttggaagccatcatgctaaggtatggagcaaagtcggtggtaactccaagccttgcaggttcataaagccccaaggcatattagtgaaggcattagatttttctccctggagatgcttttttctctctgaattctctactcaggcagcattacaaaggactgtaacctgatgtgaaactactgcacaacaagtactttctgtcccataaggggcccaaacaaaacaattcacaaggcagatggttagccaagattcactcaacttctacaggataaggtcagttcatggatgactggaaaaatgtttcattccagattttaaaaccaattaaaaattggttttgttccaatttcagaagcaatgccaatgtatctctggcctccatgcgaaaaagaaagctttttcccagatgtctgctgccttttgatagctgttttcagctacggatacatcaacacatcttagtcctttagtctttctcttcctgcctcagatccttgcaggtcttgatataatatgtagttctaaaaatgatgttatgttatctataatcttacttgcctttggatgtatcaatagtgaccttaaaaatttagtatgatgcctggcgcagtcactcctgcctgtaatcccagccctttggaaggctgaggaaggcagatcacttgagcccaggagtttaagaccagcctgggatggaaagacctgtctctacaaaaatttaaaaattagctgggcatggtggcatacacctgtagtcccagctactcagaaggctgagactggaggatcatttgagcccaggagtttgaggctgcagtgagccatgttcctgccactacactccagcctgagtaaaaagagtaagaccctgtctcaaaaaaatactagtatgacatggtttaggcataattgcagttttgttaacccttcagaccttttctttatttagatattttacctctaggaaattaattgctttggaagaaaatttcatggataaatatataatgaatccccattagaacaaagtctagatttgtacttacagttaggataattatgaattttttagtcttttattaaatgtacatgtttgacccatggtccagctgaatggatgttatagtgaagcatgttcaaatgtggcttatcagtatgaggtcagtaaaatttaacctacacaaaggaatcaaacatcaccttcctgaaggcagcaagctgtaccagatgactgttgagactatttctaggcccgttcaacaggttcataaaaacgcttgatgtaactggtaaaatactaaagtgaacactgtagtcgccttgttcaacctaatttactgtgacaaaatgaaaaaagaaatagcatctcttatctgtccctgataactgttctgaatgggtgtttggaaatatagctaaaacctcccaaaacttcatgtatttgtaagatttgattactctgaacattccaagtacacacccaaatatttttagaagtgttgagcattcgagaaaagaacatagaaaagattgtggtagactggctgtgccttcaacctgggaaatgctttctgtaagcacaccaatgtttttctttccagttggaaatacactgaagctgctagagtggtcagctaacaagccccatgtactattgcaccctattgacaaaggcccaattgatagaggttttatgggctaattactgaaggttttagcatgtccccttctgaactgcccaccttccttacccctgcactctagccaaaaccaagagcatttcaaaagcccactgatctcacaaatcctaaaatcattacatatttgtgtttggaaaacatattttaaacaattataacataagggaagaaataaatctatttaactttttttaattaggtactttgtttcattactactgtacattgatgtatgtctgcttggttttaagcatttgctttgaaaattagtaaaatcttatctagaacataaaattcttcctcatatctatgtgttcaatttttatctctcccctaagactcttctgtcataataacattctatagctatgagcactaattgctgtattgctgatgtggatagtcaagtgtgttttgggatgaccacccaagctgcccttcatttacccagactggctgctttatgatttctctatgtgaaaacacaaaacactcacccaataacatcggcataaagaatttgtgaataacctctaagactgatttcatagtcattcttttttctagctttcattactgacctacccaaaaattgcaaatagacctaaggctgaaacttgggtcacaataatgagcctgatgtgtcaggaagccaacaaattacttctcacagtggctttttttagattccttggtgacgctttccaaaggcagatataacagggccatatttttcagtcttgcagggagtctcagtgagaaaataccagcctgttgttagtcttggatctgcatttgatgctaagtgtaagttgatttcttattgttattttaacagtttattttcagtgtaattatttccacaagaggacaaaagaggaataaaataaaattttattttatcctacgtggataaaataaaattgaagcctttattaaaatcgaccacatggctgagactactctaatatatctatgatttcatcttattaaaaggcaacttaagttgctaatgtgttcaaaagttagatcagactcccaaaactgccactgtgttctaaattgattttgagacatcatttttctgtttctctgtcttctctatcttttgttctaagagacttactcttcaatggcattattttctataccttctactcccttttccctttagtagaaattatattatttcacttattttctgttagtcatacactcttctgcaacttattacttctaagtgttcaaactccctcagtgcatgtagattccttccatgtgattaactggaccatctgaggacaattaaaacctgttggattggctgatcacaaaacattaaaacaattttaatccctctagttagtaatagctgatatttattgagaactactatatattaggtactactttaagcactttataaatatggtcttatttaattctacataagtactataatgtccttatttattttattttattttactttactttattttattctattttattttattttattttattttattttattttattttattttttgaggcagagtttccctctatcacccaggctggagtccaaatggcatagtctcagctcactacaacctccgcctcctgggttcaagccattctcatgcctcagcctcccgagtagctgggactacaggcacacgccaccacacccagctaatttttgcatttttagtagagataggatttcaccgtgttggccaggctggtcttgaactcctggcctcaagtaatccacccgcctcagcgtcccaaagtgctggtattacaagtgtgagccaccacgcctggcctttataatgtcccattttatagatgaggaagtaagacaagactgaagactttatagatgaggaagcaagacaaacttaaaaagatgataggtgaaagaacctggatttatttctcatgatttcactctagaaaaatatacatacccaactggaaaattgtctttactgtttattagcattttaaaattaaatttaattgaaccttatctattgtcatcaacttgtaaacagaagaacatgatactattatgcttatcattagtaattcaagatctttaaagaaaagccaggctttatagaacattaattgcagtatcagccttaattatatcaactaaattatgttacctattgctgctctctaacctgaatgggaaattaggacctaaaatagacttacttacctgtatcaaacttgcatatactcttcagttgttgttatcatgaggctccctgtgtatttccaaattggagacctctggagagcaagtaacattactcgcaggactaccttcaaatgttttttaacattaataaactatcggtaatttagataattgttgacctggtacacaaacttgaaagttgaacttacaagacagcttgattagctgatatggttggaccacatgaagaaaatttatttccgaagaggaaaatgaataaggattatttcccactctttctataaactttagtagagcactatgatatactgtattaacattctgtactatcacatgttacataagaaaattcattcacagacagggtatttattatgtgtcaaacataatcttaagtataaaggatacaaaagcgactaaaacacggtccctgcctgtaagaatagaatctcctgtgcccttagagaatggcaaaacttaaaggaggtatactataattatggtgttacagagcaaaggtgatggaaattgaagtagtcctagaaagaaggctatggaatatcatgagtgattgtataaaacaaagaagcaaaggactacccccaggttttcaaattatgtttgagtcatccactgaacatttatacaatttctaccatgtccaagcatgcttatggatgctggagaggctgtatggcaccaaatgggcaaggtcttccttcttatagagataatattcgtgtggacgaagaaaaacaatacacaaatatgtttttgaaaaacaagataatgtcatctacagataagcacaatgaagaaaataaaacagaaagagtagaggctaccttagcttgggtggtctgagaaagtctttctaagtagttgacacttgagttgacctgaatattaagaagaagccagccatgaggaggtttagacacagatctttccaggccagggaatagtaattgcaaggattattaacacttgatgagcttgggttgtacaaggtggagacataaggtctcgtggctggagctcaatgagcagtggggagaatagcagaaggtgataggggagacaggcagaggtcacaccctgaaggccatgtagcctctgctaccctgaatcaaggttccttctaaagacaggccaccaggcaaaggtcctacgggttgctggcaggcctaatatgaatactattcaggttatgaacagcagcattaatcaggcaacaaaaagtatggctgtttaatgccctgggttttttagtcatgtatgcctgttggaacttcatatcagcaatatacaaattattacccatttatgtttataaaaaacataaacataagtttataaggaaataatcctctgaattttgtttctatatttctgcccttagaaacatgaaattttacattgttttttaaaatgttatttttctatgaggaactggaattagaatgtgatggaaacttttttacagccccagtggtatcaccagtaagcagttcctaagatcctccttgccaagggactctattccatactcttagttatgatgattgcagtgcagaattatttcattaaagattgtttatttcttttgagaaattgtccctttttgccttgagatgttatctgaaactgtatgatcaataagaagcattaaactgtcactatggggtaaattttcaaagtggtgcctgcaatttgccagtatgagtcccattaacttctgtggaagtcctgcagttaaacccctgcacatggctttgaaaatgttctacaagtttgtctttgtggtgccttttttatttttaataaatatcacagagcaactcagtgcatagttgattgcagtatttaagaacgtggataatgtactgtgcaggaggagacttttaaaattagattttaaagcttcatttctattaagagtcacaacaacaatataaatacatctttagttcttcaaagagcacctttctataaaggaatttggagctcaattagaatatagagcttataaagcagcaccatgtccctctgagacattgtttacttcactctatagatggaaaagtcgaggcactgtgaagtgggggtgctttgtccttagcccataaatcagcagtaaagctaggaatagcatgctggcctcccaatagctcattgctctaaagcactgcctcttgttagagtcaaatttaattatagtataatccgtttaatctacatgtggagaaataatgaaggagcaggaaaaatgaatttcttaacagatcagtggaaaaccatattacatagattagcaactgtcttttcaagatccgtattttcagcatgtactagatggtatctgatgccatgaaagcaaatattctaattccactggccagaactggcaaagaacttcttattttcctcactttgaaacataagtaaaggggttccacttgaaaattaataagccatgtgatatgattcgattcctgtccccaaatctccctccttctaggggccattgtctaaagtctaaaagaaaacataccaggcacagtggctcatgcctgtaatcccagcactttaaagggagagcaaggtaggaggatcacttgagcctaggagttcaaaatcatcaacctgggcaacataatgagaccctatctctacaaaaaaaacaaacaaaaacaaaaacaaacaaaaaaaactgtaatagctgggtgtggtggaacacactggtagtctcagctactcaggaggctgataggagaaggtaacttctgcccaggaattcaaggctgcagtgaattatgattgcaccactgtactgcagcctgggcaacagagtaagacagagagagagagagacaaagagaaaggaaggaaggaaagaaggaaggagggaaggaaggaaggaaggaaggaaggaaggaaggaaggaaggaaggaaggaagggagggaagaaggaaggaagggagggagggaaggagggagggaaagaaaggaaaggaaagaaaataaatgtaactattataaaagatgttcaatgttttattttggaataactttagacttacttagaagttgcaaaaatagtacagaatttccatgttcaaatgtactctttacctaactttccccaaaatattttacctacgtatactgcaattatcaaaaccaggatatgaatacatactattagctatagtctttatttgaatttcaccagtttttacatgcgctcaatttttatatacactcctataaaattttctcacatgtatatatgcatttaaccaccaccacaatcaaaatacagaacttttccatcaccctaaataaacttggaatgatatactttgtattattcctttacaggtactccctctcttcaatcctaacctctgggaaccactatatctgttctgtttcactgtaattttgtcatttttataatgttatataaatgaaattgtaaagtagtaatcttttgaaattggctttttcttacacagcatgatgctcttgagatccatccaagtgcatcaatagtgcattcctgtttattgcttaatagaattccatgatctagatgtaacacaatttgtatattcatttacctaatcaaggtcatttgggctgcttctagtttttggctattacaaataaggcagctatgtacattcatgtgtaggtttgtgtatgaacgtaagtttttatttctctagggtcatatagtgctagttcacctttatcagaaactgccaaactatttccttttaaaatatagaaatgccaatgcaaacatgtgcatggaggtcagcagccccaccccctgccccacgctgccactgctgccagtgtgaacatatgcatggaggctggcagccccacgctcaccactagcctgcccctgcactgacactgctaccagcatgagcgtgcacatggaggccggcagccccatggccaccagcactctgccccagttgatgagcattcaccccaccacactgccacttgctcttggcactgctcttggcacttacaaatgagcacagatcctgctgccaccaccccaacaaagtggtttggctggcaccacccatcagagtattgtggccagaggtgcaggaacaccttagcgcctccactttagcagtttcctaacctcaaggggccagagaataaagtcagagatccagtaacagcctcccaaagttgcagcatacagcccaaaagttctgagctgagccttaccccctaaattcttccagaaatgaagccagtcaactgaacccaccttatatgagattcaaaccttccagggcatcaaagaagatagaggcaaaaaaaaaaaaaaaaaaaaaaaaaaaaaaaaaaactatccaaaggacagcaatttcaaagactgaaggaaaatcagcccacacagatgataaagaaccagtgcaagagctctggcaactcaaaagtcagagtactttcttacctccaaacaactgcagtagttccccagcaatggttcttaaccaggctgaaatgacaaaaagagaaatcagaatgtggataggaacagagatcactgagattcaggagacagtgaaaacctaatccagggattctaaggattacaacaaagtgatacaggagatgaaagacgaaatggccactttaagaaagaacagaactgatctgatagagctgaaaaactcacttcaagaattccagaatacaatcacaaatataacagcagaatcgatcaagctgaggaaagaatctcagagcttgaatatcacttctctgaaataactcagtcagacaaaaataaagaaaaaaagattaaagaagaatgaacaaaatctccaaagtatgggattatgtaaagacaccaaatctatgactcactgatgtccctgaaagagagggagagaaagcaagcaacttggagaacatatttcaggatatcatccatgaaaattcccccaacttcactagagaggccaacattcaaattgagaaaatgcagagaacccttgtgagatactatacagataaccatccccaagacacatacttgtcagattctctaaggtcaaaacaaaacaaaaaatgttaacagcagctaaagagaaggggcaggccacctcccaaggaaaccccatcaggctaacagcacacctttcagcagaaactctataagccagcagagattgaggacctatattcagcattattaaagaaaagaaattccaaacaagaatttcatatccagccaaactaagcttcataaatgaaggagaaataagattcttttcaggcgagcaaatgctaagggaattcattaccatcagacctgccttataagaggtcctaaagagagtgttaaatatggaaaggaaagattattactggcaactacaaaaacgtgcttaagtacacacaccattgatgccaaaaagcaaccacacaaacagatctgcataataaccaattaacaacacaaaacaggatttgatccttcaaatccacacatatcaatattaaccttaaatgtaaatgggctaaatgcccaattaaaaggcacagagtggcaagttggacaaagaagcaagacccaacagtatgctgtcttgaatagacccatttcacatgcagtgacacacataggatcaaactaaagggatggagaaaaatctaccaagcaaatggaaaacagaaaaaagcaggagttgctattctacattcaaacaaaacagactttaaaccaacaaaaatcaaaaaagataaagaaaggcattacataatggtaaagggttcacctcaaaaggccagacttaactatcctaaatagatatgcatccaaaacaggagcacccaaattcatagagcaagtttttagacacccacaaagagatttagataaccacacaataatagtgggagactttaacatcccactggcagtattagacaggtcattgaggcagaaaactaacaaagaaattcaggacctgaatttgacacttgactaaatagacctaatagacatctacagaaatctccacccaaaaacaggagtgtatatattcttctcatctgcacatggcccataatctaaaattgactaatcagccataaaacaatccttagcaaataaaaaaaaatcataccaaccacactctcagactacagtgcaataaaaatagaaattaatggaaattaacctgcttctgaatgacttttgggtaaacaatgaaattaaggtagaaattcagaaattatttgaaactaattagaacaaagatactacataccagaatctctgggacacagctaaagcaatattaagagggaagtttatagagctgaatgcctacatcaaaaagttagaaagatcttaagttaacaaccgaacatcacacctagaggaaatagagaaacaagagcagatcgaccccaaagctagtagaacacaagaaatcaaaatctgcactaaactgaaggaaattgagacgcaaaaaaacatacagaagatcaatgaatccaggacttggttcttcgaaagaataaataagatagataaaatgctagctagactaataaggaaaaaaagagagatcaaaataaacacaatcagaaatgacaaagggatgttaccacctaccccacaaaaatttaaaaaaccctcagagactactaaaaacacctctatgcacacaaactagaaaacctagaagaaatggataaattccttgaaacatacaaccttccaagattgaaccaggaagaaattgaatcctggacagagaccaataatgagttccaaaattgaatcagtaataaaaagcctaccaaccagaaaaagcccgggaccagagggattcacagctgaatattacaagaagtataaagaagagctggtaccattcctactgaaactattccaaaaaacagaggaggagggactcctccctaactatgaaaccagcatcatcctgataccaaaacctggcagggacacaacaacaacaaaaaacaaaacttcaggccaaatccttgatgaacatagatgcaaaaattctcaataaaatcctagtgaaatgaatccagcagcacatgaaaaagctaatccaccactatcaaggaggcttcgtccctgggacacaagtttggttcaacatatacaaatgaataaatgtgattcatcacataaacagaattaaaaacaaaaaccacatgatcatctcaataaatgcagaaaaggcttttgataaagttcaacatcccttcacgttaaaaaccctcaacaaactaggcactgaaggaacatacttcaaaataataagagccatctataagaaactcacagccaacatcacagtgaatgagcaaaagctggaagcattcttattaaacaccagaacaaaacaaggatgtcctctctcaccagtccttttcaacatagtactggaagtcctggccagagcaatcaggcaagagaaagatataaaagccatctgaatagaggggaagtcaaactgtccctgattccagtcagtatgattctatgcccagaaaaccccataatctctgctccaaagctccttggtttgataaacaacttcagcaaagcttcaggatacaaagtcaatgtacaaaaatcagtagaatccctgtgcaccaacaacatccaagctgagagccaaatcaagaatgctatcccccaagcctgccaccatggccacctacaaactggtgcagatccagcacagcgagagtgagtggaacctggagaaccacttcagcggctggtacgacgccatcctgagcccagcgggccatgaggcggcaaagcaggcacggcgagatgctggctatgagtttgacatctgcttcacctcattgcagaagagagcgatcccgaccttctggacagtgctagatgccattgatcagatgtagctgccaatagtgaggacttggcgcctcaatgagcagcactatggggctctagccggtctcaataaagcagaaactgctgcaaaacatagtgaagcccaggtgaagatctgcaggtgctcctatgatgtcccaccacctccgatggagccctaccatcctttctacagcaacatcagtaaggatcacaggtatgcagacctcacagaaaatcacctaccctcctgtgagagtctgaaggacactattgccagagctctgcccttctggaatgaagaagtatttccccagatcaaggaggggaaatgggtactgactgcagcccatggcaacagcctctggggcactgacaagcatctgaagggtctctctgaagaggctatcatggagctgaacctgccaactggcattctcattgtctatgaattggacaagaacttgaagcccatcaagcccagcccacgcagttcctaggggatgaagagaccatgtgcaaagccatggaagttgtggctgcccagggcaaagccaagaagtgaaggccagcaaacaggcaccctccctgcccattgcatccatctgtccctccctcctgaacatgtcacactgaccacatctatagacatcttgagttgcagctgcagatggggaccggtggctcccattttcattttagccattttgtcttctgcacccactcccttcatacattctagtcagaatagcacttctagggcacaggttctcagtctaagctgtggaaaagccccccttatccaagagagttcaaagatagtgacttgggtttttgcaagtgctttgtttactaaggacttgtgaggaggagccatgctgagctacgaccaatgaggagaagcaagagagcctgtctgcccccaggagctagtcctgtgcttgtctgtagtcaggccactgcctgggggctctagtcatcccagtggaagatgaatgtaacctgcatggtgatgtgacaactgtttcctccctgaccccagaggaactggctctagaaggttgggatcaatcctgaatttagtttatgtgttacatttacttttatttaaaaaaaaaaaagtatagtgtatataaataatacaaaacaataacccttctaagggtttctcgtggtggttgaaatagtcccacatgtggtcatcagaacataagccattcctcataccaatatggggtaagctccttgacctttgaggggcaggagtgcttcatgctgtgtgttttagaatccctccctgccttgtttcatggcagtgaaatgcctcttggtcctctccaagtgtgtttttcactgatttctgaatcatgttgcagttgcttggccctgccacataggtctagtgttcatttgagcataactgtactaaatcctttttccagatcagtataataaaggagtgatgtgcaataaaaaaaagaatgccatcccatgcacaccagttagaatggtgatcattaaaaagtcaggaaacaacaggtgctggagaggatgtggagaaataggaacatttttacactcttggtgggactgtaaactagttcaaccattgtggaagacagtgtggtgattccttaaggatctagaactagaaataccatttgacccagccatcccattactgggtatatactcaaaggattataaatcatgctgctataaagacacatgcacatgtatgtttattgcagcactattcacaatagcaaagacttagaaccaacccaaaagtccatcaatgatagactggattaagaaaatgtggcacgtatacaccatggaatactatgcagccataaaaaaggatgagttcatgtcctttgcagggacatggatgaagctggaaaccatcattctcagcaaactatcacaaggacagaaaaccaaacaccacatgttctcactcataggtgggaattgaacaatgagaacacttggatgcagggtggggaacatcacacactggggcctgtcatggggtggggggaagggggggagggatagcattaggagatatacctaatgtaaatgacaagttaatgggtgcagcacaccaacatggcacatgtatacatgtgtaacaaatctgcacattgtgcacatgtaccttagaacttaaagtatagtaaaaaaataaataaataaataaaaatttaaaaaatgaataaaatacatagaaatacagctaaccaggtaggtgaaagatctctacaacaagcattataaaacactgctcaaagtaatctgagatgatataaataaaaggaaaagcattccatgctcatggataggaagaagcaatattgttaaaatggccatattgcccaaagcaatttacagattcagtgctattcctatcaaactaccagttcttcacagaattagaaaaaaaaattatttaaaaatttgtatgaaaccaaaaaaaagcctgaatagccaaggcaattctaagcaaaaacaacaaagccagaagtatcacattgtgtgacttcaatctatattacaaggctacagtaaccacaacagcatggtactggtacaaaacacatagaccaatggaacagaagagatagcccagaaataatgccacacacaaaccatttgatcttaaacaaacctaacaaaaacaagcaatgggaaaagaaattcctattccataaatggtgctgggataactggctagccatatgcagaagattgaaattggaccccttgtttataccatatacaaaaatcaactcaagatgggttaaaggcttaaacataaaacctaaaactggccgggcacggtggctcacgcctgtaattccagcactttgggaggccgaggcaggcggatcacgaggtcaggagatcgagaccatcctggctaacacggtgaaacgccatctctactaaaattacaaaaaattagctgggcgaggtggcgggcacctgtagtcccagctactcgggaggctgaggcaggagaatggcgtgaaccccggggggcggaggctgcagtgagccgagatgctgccactgcactccagcctgggcgacagcgagactccgtctcaaaaaaaaacaaacctaaaactataaaaaccctggaagatgacctgggaaataccactctggacatataggacctggcaaagattttatgacaaagacaaaagcgattgcagcaaaaacaaaaattgactaattttgtcaattaaactaaagggatctaattaaactaaacagcttctgcacagcaaaagaaactatcaacagagtgaacagacaacctacagaataggagaaaatatttgcaaactatgcatctgacaaaggtctattatccggaatctgtaaggaatttaaacaaatttataagcaaaaaaacaaacaacaccattaaaaaatgggcaaagtccttgaacagacacttgtaaaagaagacatacacgtggccaagaagcatataaaaaaatgctcaacattactaatctttagagaaatgcaaatcaaaaccacaataagataccatctcacaaaagtcagaatggctattactaaaaagtcaaaaaataacagatgctggcaaggttatggagaaaaaggaatgcttatatactgctggtgggaatgtaaattagttcagccggtgtggaaagccgtttggcaatttctcaaagaactcaaaatggaattaccatttgacccagtaatctcactattgggtttattctcaaaggaatgtaactcattctaccttaaagacatatgcactcatatattcatctcagtactattcacaatagcaaagacatgaaatcaacctacatgcccattgatggtggattggataaagaaaatgtggtacatatacaccataaatactacacagccataaaaaagaacaagatcatgtcttttgcaacaacatggatgaggctggaggccattcacctaagcgaactgacacaggaacagaaaaccaaatacacatgttctcacttacaagtgagagctaagcattgagttatatggtcacaaacaagagaacaacagacgcgtaagcctacttgaggatggaaagtgggaggagggagagcataaaaaaactacctatcaggtactatgctttttacctgcgtgatgaaataatctgaacatcaaacccccataatatacaattcacctatataacaaacctgcacatgtaccacagaacctgaaataaaagtttaaaaataaatcataaaataaaatgttgaaatgcctagaatgtttcatagcattaaattagaccatgctgtcttaaatgacatcttattttcatagaaatcatgtttctgctttttctgtttttctatgaaaatttttttaacaagcagaagttaacgaaatgtatattttaccacttgggtcaagaaacaaatgaaagtattgcccattaaggagcagttcttcatactgtgataaatgaatgtaagtattatgtttacatagatgaagtataaagagaccaattaatgtaaaaagccaatactgtacaaattcctgaaggaccattttttaaatctaactttaatttttagaaagtccttattcaagcaaactttactgagaccaatactaattatactttcctgctaaaagatacagataatgacattagttagagccttaaagtactactccaatggaataaaatatttaaaattgccaccaagacccagtggtgctttatagagagttgggtccaatattcatggttctaatgtgatctaaaaagaagtcgtttgttctccttaattcaacacctctcagaaattgccctattcttaaaactattctctaagactacttttcctccaagactctgccaaatgtctccccttggatcttccaccataaccaacaaaaacattattttctcaaagttagaaacaaccctgtgtggccaaaatatatgaatcccaacttcattctcactctggttgtaagaaatgctggaataattaattactcatttggaaaaaattaaagctgtatccatatctatcttaccagattccaagataaactccaaataaatcaaagatttaaattaaataagaccataaaatactgggcagaagaaattggtaaactctcttagaaccttggaatctggaaagattttctaattataactaaaaatacaaaagtcataggagaaaatattgatagaatacataaaatcaaagaatactgtatgataaactaaacagcaacgtcaaaagacaaatgtggaaaaatatttacaactcctactaaaaaatagaaactaatcaccttaaattataaggagctctagaaatcaagaaaaacccaacaacctaacagaaaataaaatggatatgaacagactggtcacagaataagaaatacatatatacctcttaaacatacccagtctcactcataaaaaagaaatgcaaatgaaagcattctctcacctatcagattggcaaaaatctgcagtttgaccacacactttattgatgagactgcaaggaaataggcactcacatgccacaggagtgcaaaggggtatcacccttatggaagagtgtcaatatctaccaaaattacttaagcatttactctttgacccaggaagtctacttcctaataatttcatcaatttgtagtaaatgttcactatagctgaataaactattgtaaatccaaacaataaaatacagtggaagacctttctgcacagctacagaagaatcccaagatatatgaaataaaagaaaaatgaaatgtaatactgcatatatagtgtgctacttttgtgtaagaaaggagaaaaataaaagttgactttcatattgcttgtgtttgtataaagaaacattgaaataatttttacaaaaagaagagaataaaaatgtttaactgaggatagcgaatgaggacagcatgaatggaaacgggtaggagtaagatttttcagcatttacctttttatgtcattttaatgtttaaaatataaatatgttaactattcaaaaactaaattaaaagaattattgcctggcacagatgaagtacagtttagatgttgactattattatttttgtatagcaatatttggatgggttaatgggctcatattatgtacagttgttccgaatctactcacactccaggcacttttgtcattgcaaagagggacaatgccaaagataatttaccataggatttccatgtgcacctcctcagttctaggctgaagtaacatagaatggcatttttaactcacgaaaaactctgttctaaaaggtgctttattatttgccttaatttgctcttcatatatttccttaattttaaacttagaattttagttgtaacttttcaaaggattgcccaagaagatgcaatgagatgatacatgtaaagtgcttagcttaatgcctggtgtttaatcaatactccataactcttagtggtagcaaacagaatcataaaagtgatgtgttcagtgaagcctctaatcaatcctagaatcgatacctacaatcagaaaaaaattatcaactcagaccatctttgtatgtttttgtttattatttttcctcaaaatatcttcaataaggcattcctagaatttgagagtctgtgtatcttaaataagaatgcattttattttaagaggtaaatggaaggagcaagaaccaagacaggtactttttgagtctggagtccttagatataataagtaatttcaggaatggtatgtatggtacctaaaggatgtggtttaattagaagggcttttgaagctttcttgtagactggttgttcattatggcttcatctatgtttctcccagaaggcttccctggcctcttaactaagttaattgtccctgcaatgtgctccttgtatttcttctgtcataatattcatcactcatgattgtggttactcgattcagcgtcttctatgcaaaccatgctttcagccttgtgcagacagaaggcatccatctggtccacaccagccatgccctttaatattatatgcccaggtcctagaagtttctggccacaatgaatgtgtattgaatgaataaaaaattgagaaaactgcaagctagtaaacagtcacatgagaagcgtcatccccccggcccccatcacaacccctacacacacaaagtaaaaacaacacagtcaacatgagcaaatagagaaaaaaaatgtggcaattattcaagcaatgcaaggtgaaaaatagcccctttgcctcagttatcagaggttttcaaaaggatattttttgcctgcattttttaatctaattgcttcaattattttatttggtcatgggaacatgattatattttttaataaagtgcttaatttgcatgcatgctttgaattgtaggttcttttacaggaggcttgtctactcccatattgcctttttctcaattattttacttctgccttttgcaaaatgttttaaatatttgattttagcccctaccacagactccaaatctgtgcttggaatttggagatcaaagtactgtagctaatccttaggacatttgccattgtgtgacttaagaatccatctcttatcaagtttctgtggttttctggagtatttacaggtcacaatgtcaaaatgtgcacatctgaaactatttttgaattatgctttctttatactcttccatatttagttaatgggaaaatatccagctcctgaatggtattgaactcgattaggccatctccagtctccttataaaagattcctaagttgtagtatcacatgttttcaataaaccttgtttttgttctcctttaaacagagcgtgtcttattcaaaaagctcatgacagtaggaaaggaattgataatgaaaagaaagtgagtccgaaggaggatttttcctcatagctttaggatttgttataagacaatgtgtttcaccgcctgacctgcagcttcaggagttggttgccatgaattctgatcctgtttctggaagtaatttatcgcattatcttgtacaagcttctctgggacactctttctttccttttaagcacagataagagcagcaatacactttgcagcgttcataaacagcaatacataaaagtaaatatgaaattagaaagttccaaaaactgctctaatctagtgccagtgagggaaaattttggtaaggattttataagtaaagatgggagttagatgcataattatatgtgacctgtttggttaataatcccactgaaatacagatagatgatagatagatagatgatagatagatagatagatgatagatagatagatagatagatagatagatagatgatagatagatagatagatagatagatagatagatagatagatataatagatctacacatggcaacaagcaagattttcaaaattataatgaatgtcaggtatttattcttggcttatatttactcaaattcactctttaaagtgctatctttttattcttcacaggaggaaaagtctattttcacaccccaatgtttatccctaaggattagccaagtgcctaaactgtatccatttcatatttccaaaaataggaaattgtgcattgaaaaatattgagagccaggtgaaccaggtaattctaaattttcccagataatacttagaatgaattcccatccataaatgtcctttgctaagtgacgtttcatctcaagtggcatctccattgtaacatccgagtaacacagtctattcaaagaacttcctgaagatatcctttcaaaaacttttagcagtaggtgatgattaatcataatctgtatgtcatctgaaaataagtatcaagtttcttaaagaaaaattacatatcccaacactactaaacataactggctgctaagtttcagagggtccatatcatttaactgcttagagtaagtgcaaaaagggagtattataaattaggtattgtagttttgctctgtaaatttaaacccataatgccattgtttggctgttgatgtttaaatattcaagctatgaccttgaataagatatccaagcatggaatttcatcataggatgttgggatttccagcagatgtttcaaatttgattattcattggtggaatccaaatctttttttttttaatctgcagtcaaatactggtatggggttctgtttagaaatcaaaactgactgcagctttgtcatttggtaggtgtgaaaataggtactgaagaaaattttaaacatctgatggtatcaacgtgcaaaattgctgttcctaaaagctgtctcaaactttctatataaaagaatataatataaagccactgtatcattgccctaaaccatgttctaaagcatcagaaaatacacatgacttttcatctcttcgatttattgaaaactgatggaattacacctaggtaatttactcaagatactagactatgccttaaataggatgtgcctcctactcattcatgatgactctcaggggacaaatgcttctttcctgttttataaatacagaaacacagcttccttacctccttcagtctgtaacccacatctgaaattaaatgtttgtgatcacactttgaagcaatttgtttcagtaggttactgatattgcaagggattcgtcctgtagcatgagaaaaaaaaaaaaatctactgcctgactctgcatccctgacctttcccccagactccagccccattcaccatctaccaaatgcctactagccatctcaaaattaacatggccataacggacaagtagttctgcccttcaaatagtgctcctcacctatccccagtggtatttccccagcttagtaaatagcactttattcacctgattgcttagaccaaaaaccctgaagtcagccttagactccctcgtttgtctcatcccacagtcagtccttcagcaagtcttggcctctccaccttcacaatgtgcaccaaatccagctcctttacagctcctcctgactttaacctcactcttgtaatgctgctctcaccctttgtccagaccacagcagtggcttcttacctggccttccagcttcctctctgacatctggcttcctttctggcatccagcctcttcctggttggtttcccaaaggtaaccaaaatgatcttgtgaaatacacatctgatcctgcactctgccaaaaaccctttccctgccgctatcatataatacttagaaggacatctaaagctattcccaaagctgtcgtgatctggctggagccttctctcactccgctcaagctaacttgatctccttgccttcccttgaacacactgaacacacttccacctcaaggtctttttatatttttttgcctggaaccatttttccttagatatgatcacggtcaccccttcacttcgttgggtcatggctcctctgagatgctttcccattgagacaaccgaaaatactaaaaacggccgggctcagtggctcacgcctataatcccagcactttgggaggccaaggtgggtggatcacttgaggtcaggagttcgagaccagcctggccaacatggtgaaaccccatctctcccaaaaatacaaaattagcctggagtggtggtgcacacctgtaatcccagctacttgggaagctgaggcaggaaaatcgcttgaacccgagaggcggaggttgcagtgagctgagatcatgccattgcactccagcctgggtgacagagactgtctcaaaaataaaataaaaactaaaatattaaaaacatgttaattataagatgtttgctaaattttacctgaatatcaaccatttgcaagtagttatattccctattcttaataatactttacttcttggaacttcacattaagatagagcacccgcccctctgtgactccaccctcatcctgctctgcatttccccagggtttttgtcactacctaacattatattctgtacttgtttattgctttaacatcagcctaccccaggagaacataagctccatgagggcagaaaactcttctcttttattcactgctctatacctcatgcttggcttatagtagacatgcaacaaaaaatatttgtcgaatgaactaatgaatgaataaataaattgccttaacacttaatttgagaaaagtcatatccaaaacactccttctgatgcttcctcgttcaaccagtatccaaaacaaaaaatgtaccacttagaatttgagaaattcaaagttagaaaggatccttgagacttgccagttcaatccaactattttaaaggtatggaaaccagccctgagagataagtggtgacaaagctagttaatggcgaacagataattaaactaggcatagttcaatgttctttatgcttccatgctttacatctctgtttcttttgaaagttccttctgtatacataagcaaatataatggaaccagaacacttctattccttcttatcttgctgctctgttggcaataaaacatctggcacatgatatacatgggacactaaaaaaattataaatttctgcagaaaagggctcacattgataaggcagattgacctctctgtctcaatctgctgtcccattgggacaacctaaaatataaaaaacatgttaattataatattttcgctaaattttacctgaatatcaactatttgcacgtagttatattccctattcttgataatactttacttcttggaatatcacatgtaagcctttgcttgactttctacatccctgtttactaggctttctatgacataaaagctaccaaaagagaaacacgggaaaaaaatatataagtgctctggaaacagaaattagtttgatttttggctccatttaccagctaaatgactttggataagattcttggactttcttagtatcaaattactaatctagaaaagtgaagggaaaggtatatctataaaacatttttttttagattgagagttaacatgataccaggcacactaaggcagactaaaggctttatatgtattatttcatttaatcatcccaatagccctgtgagaaaaagggatctattccctatttgcaggtgaggactccaagactcagcaagattaataggcccaaggtcacacaactaagaaaggacagaactagaaatacctgggctgttgcacatgaagtttatactcataacctctgtgcctccttgaagggctattatggagaaacaatgaaataaagtctgtgtactgagcatcccgcacagcctcatacatcagaggtactcaataaatgttgcccatttctcttctgttttcccaccactgactaaataaattaccttggccaatgtactaacctttctaggccatagcttcttttttaaataagttatggttctcttttttctcattacaaaagcaatacatggctattaaagatcatttggacaaaagatatatatatatatatatatatatatatatatatatatatataactaaaatttgtatggaatcttaccacctaaagataatcaccattaatatgcaaatgtatgtatttatactatttatttttctatatactataagaatacataatctggccaggtgcaatgactcacacctgtaatcccagcactttgggaggccaaggctggtggatcacttgaggtcaggagttcgataccagctcgaccaacatggtgaaacatcgtctctactagaaatacaaaaattagttgggcatggtggcgggtgcctgtaatcccagctactggggaggctgaggcaggagagacacttgaatcctagaggtggaggttgcagtgagctgagattgcaccattgccctctagcctgggcaaaaagagggaaactccgtctcaaaaaataataataataatacataatattttgggagagcaaaactgaaatcctgctatcctgctatgtaatcagttatttaaataatgatgtttagaaacattttatctcacaatattcttctaagacataatgttttgtggctgtatcgcatttgtggtaataataatagtaataataaattagctcaaatgtatgttagtattgtactgagatgtttcacagttaacttattcaattcttgcaaccctatgacataggtacctttattatctacattttacagataaagaaactgaggcacagaaagattcagtcacttaacaaggtaacccagctattaagcagcagagccaggattggaactgaggcacatgagcaccacagcccatgctctggaagggatatagcatgttgttttttattaatccatcctcattagaaatctggattggttctcattttttatactgctactaatagtgttaggtatgagctgggaggagaaaaaaacaatagtttaataagtatgctgctgcaaacttgttaacatctacaattttatcatacatccctacagtttaaattcctgaaataagttattcacattgttaatggttttgtcaaataatgtcaaattgctcccccaaaaaataccataccaatttattcttacagaaaatcttcatcaaataactttttttctctgccttgccaacattgacaattcatttttttaaactttgtcagtttgatagaataaaatggtacctttctagtattttaaatttcaaaactagaaattgtaaagaacttttttatatattaattagtcattgtttcttcttcctaggataaattcgtctatgtgccttctgtccaattttctactagcatgttttcttagtgttttatgtttatatattaaagatattaatcttttgttcatcatcatatatgttgccatttttttccaggtttgttttttgcatttcaatctgtgtagagttcttttttaatgtatggaattttcgtgtgttcgtgccttcacttctcaactgcaaaatatgggagattaaactatattgtttttaagacctttaaaattataacattgtattctatttctttcctaattactacaaacaaataacttatcaggtaagtatctatcaaataagttttgaacatctacagtatgatatgtacggagctagtcactgaggttacaaaaaaaaaagcacgtctgcatgcagttggtttcttatagcttactatagaagagaccagcaagtaaacagactactagtataatcatgggtaataagtgttatgacaggagcatacctcagacctctgggcacaagtggccttgactggttgatatctgtgctgagttccagaagcaagcagaagtgagccaggtaaagaagggagaagggccttctaggcagagcagcagcattttatagagcactttgaatgccaggtagcagaatttgatctttcttctatgtattggaaggccttttttaaatcacagaggtagtataatcatcttaacattttcatgtggtagtagaatacaaagtggtttagagaaaggaaaaacaggagagtgaaaaccaggccatacattgtagggatgaccaagagagaagtagcgtagcctgaactaaggaggagacaggataaatggaaagagaaaattagatatgaaacatactatggaagcagaatcaacaaaagtaaaccactcagtagatatgagacgaggaagacaataaagaaggagatgttaatccgtgaatttaatatgaggtctgtatcagaattttgttgtttaacttgattcatttattctgaaattcacttggtaaaaataaatacgtttacaataattgatactactttgaaaaagaataacatttgtgtcacacgaatataggaataggcaataaaacataatagaatcccaaaataggcttctcaataagtatatgcaaacatttggagaatgacagagtttttatttagatggtattgggaaaattgactttcatatgggataaaaagtaagattagttctctacttcaccacagagacaaacaaaaattccgttaaaactaatgattgtataagttagagtaatgcttagttattatataaatctccaaattctagtaactaaataaaatagaagtttatttcttacttgtgtaatagtccaatgaaggtgttctttgtttggggttggggtatatggtaaaggctctgttccatgcagttattcaggaacccaggctgacaaaagcactgccatcttcagcacatggtttctaagggcattcttagtaccaaactgcaactgacatagaaaaagagaaagtgataagccatatgtgcttgccctcaactgggaagtggcatacatcatttccattcgtcttcattaactagaattagtcacctcatctcacccagaagcaaggggtcccgggaaatgagacctctagatgggcaaccacttctcagagataatgctgtaccttagaagggaagcacatatctgtggtagacagctagctacctttaccacaaagactattctgaatagtaaacataaattcattaactaaataaggatgtaagtgtgccaaaataaaatataggaaaatatttttataatcttggttggacaaagtcattctagataacttaacttctgtgacttaaaaatgacatgaaatccaggcatctaaaacaggagggggatggttttgtttttcccactgtatttgcaaagattgaagacttataatatcccaggtaataaatgagtgtgcttagaaccatgtctatcacatagtgaacagtaaacattagatttactagtactatttttattattattagcattcctttttattagcaaggagagagaaataagtgtttccatacattgttagtgagaattggtaccatcattttgaaggcatcttgatatcaatcacaaatcaaaatatgccaagaattcagtctcaagaaatttagccttaaattccttatcctaaaaataaatgtacaggactattcgtttcagcatcattttaatagcaaaaccaaaagtaacctaaaaattcattaataagtgtcttagtctatttgttttataataaaggaatacacaaagctgggtattcataaagaaagtaggtttatgtggctcacagttctgcaggctgtacaaaaagcatggtgcctgcatctgctcctggtgagaacctcaggctgcctccactcatggcagaaggtgaagtggggccaacatgtgctgagatcacatgacgagagatgaagcaagacataagtgccattttctttttaacaaccaaatcttaagggaacttacagagccagaactcagtcattacttcaaggacggtaccaagccattcatgagcgatcctcccccatgaccaaaacacctcccattaggcttcacctctaacactggggatcacatttcaacatgatatttggaggtcaaatatccaaactatagcataagtaattggttaattaaataaattagtgtcctaccttatatacatttgtattgttttgatattttactttataactttaaagtgtatattttattaaaattattcaaaacttagcttatagtgaggccactagaataattcaaaaaactggaacaaaaaaatgtggtgggagagggggatataaacatcaagaacattgtatttgtcgtacttctgattgtctcagagagaacaagatgaagtgagtttaaagggaaagaggtaaatttatgttagttattagggaaaactttctgagactatagaataacttttaatttacaaaaattttaaaagcctgaagtctccagacagtttctagaagtcaagatataccctctttgtggcttacttacctcgagagggtttatctgtccttataactactagtttgaaagtgttcaaccatgctttgtttgatccagatgatttagttcttttcattgtgattttacattgagccatgttatactttctaatacatgcattatgcagtgtaattgtagcaacaaaacacagtccatcaggttcagatgtacaattggccttgctctaacccaatccttgagttcacaatagggaagctttggatgtaaataatgaaggctttttggtatttcagtgactaacaccttttagacagggtccatggtgatcaattcatattgattttgctgactaaataatacttgagcaaagttccagtggcatctaaaaataagctctttcacagtccttatgtgtcttaaatatcattatggtatttattttgttcaaatctttgcagtcacctcaaatttcaagaattcatgtgtaaatcattctaagtgatgcagtaaattagtgaacctacttcctaataccttgtaaacctatatttcacatttctactgggctgcttataatcaatagctctttcttcactacttcccaacttgttctaatttgtttcctttgagagaggtagattttaagagttctggattacatgcttttttttttattcatgtgacttagagctcctccttgtttattagcagttctatttctttctctagccccattttctcttgaagcagccataaaagtaccatctgtttttcagcatcattttatttctgctttctcctccctgcacttttctcttctctgaatgctttatgcgataacaatttattcctgatttattatccacctgctttcatagcctccccctttctgttcctcctccatccctatcccaccctggatggagtggtataccataattcttaaggacacagctttggagtcaagtaagggccagctcaaccacttatgcatgttagtgacttgaccactatgagcctcaatttcttcatttataagaaagagaaggttataatatcatctactacataggttggcttgaagaattaaataaaataatgtacatcagggtttctcagccttggcactattgacatttggggctgagtcattctttgttctggaggctgtcctgggcattgtaggatggttagcagcaaccctagtctctaccactagatgctcgtagcaacccccttcccagctatgacaatgcaaaatgtctccagacattgctaaatgtcccagggaggcaaaattgtccccattcggaatcattgatgtatataaaacatttagcacagtgcctggtacatagtagggacttgatcaataattgtgatggatggatggtcagatgaatgattgaatattcatttttaatacaagtgtctaatataattcttgacagtcaattaactacttaatacataaatggataaacaaatgaacctgaagccagtgagcttcaagggctgtccatagtttctaccttacaccaaaatgtgttatcttcactaaaaacaagcttcctatgtttcaaaaaatattttagacaattaactaactgcacagcttaagctactcccccaatttaatatatatgcatatactttaaataatagggagattttaaaataaactctaatggatgatagctataacaattatgttgctatagaattcagtgctagaaattgaagtgatcctttgattaacctgagtattttaggttgatatcccagtcaacaagccattgatgtggtaagagaacaaagctcagccaacttttaagtgttttttaatctaatttatcttatttaaatatttattgagtgcctactatatttcaggcactgttctaggtactcaggatacaattgtgaacaaaacaatgataaaacactgtggaaccaccattctatgaaatagtagatcacaaaaatagtaaatacataaatagaagtaaaaataaagactactcataacttgtaaaatactagcctaggaaatagtctaggtggtactgacagcaaaattccagtggatgactgtaacccaaccagaaacatttttgtgactgcactcactgtttgccatttggttgctcatctatgatttcagtttactgaactctaactttctcgtctgatctgaattacaatgagggtattaaatcaaatctgtggttacctttgcatattttggaacttcaaacatttagattgtgattcactgtgtgcataattttttaaattgtctcaaatcaacaatctttctcttacttttctaggttttctctaatgaactaactttatagcatactttttgtgctgtagtctaacaaaccgatagctgagtttttttaaaaatgaatacaatatatgctttttctgcctcgcttttttcatctgtaaaatgggatctgtgggatacctaacacataaagtcattgtaaggattaaataaggtaatgtttattaaaaaaaaaaaaaaaccttagaactgaagaaaatgccaagcacatagtaagttttaagtgtagtattttctgcacccctactagccatgtacttatttctagtatttccaatattttagcatagtaaatgaggtagtatatctttttcttttctttctacacttgggagaaagcaagattacaatgaaataaaagcaaaatgtatgtccaacagggtcatataagtaatgtctgtttgtaaaccactagtctcaggagtaaatccctcaacatgatgaaaaccaagagatgtgtttgcacataactctttttataaagtttttttaattgcaaagacatagtcgttgttataaacttccaacatacagaaattaataatttacaaagtgaaaagcccctttatgcatatattcacttcagctcactccctttagaaataattaatagtaataatcagcgtatagtctcacttttttttttttttttgagacgcagtcttgctctgtcgctaggctggagtgcagtggcacgatcttggctcactgcaacctccgcctcctgggttcaagggattctcatgcctcagccttccaagtagctgggattacaggcacgtgccaccacacccagctaatttttgtatttttagtagagacagggtttcaccatgttggccaggatggtctcgatctcctgacctcatgatccgcccaccttggcctcccaaagtgctgggattacaagtgtgagccactgcgcccagcctagtctcaaatttttttcctagtcatatactaatatatatttctattaaaataaaatcacattgtacatactgttttgcaactggcctttattcacttaaaatatgtctttggtgtcagtgtcaacacatttagttccttcttgtttccaacagctgccaagagtggtaactctctttggctctctgggtacttacccacaaaagcacatgcatttagagctggtggaaaaagtccttcagggcggacaccggtggctcacacctgtaatctcaactctttgggaggccaaggctggcagatgatgtgagctcaggagttcgagaccagcctgggcaacatagcaataccccatctctacaaaaaaatacaaaaattagccaggcgtgttggtgcatgcctgtagtcctagctccttgggaggctgaggtgggacacagaggttgcagtgagcagagctcatgccagtgcactccagcctgggtgatagagtgagaccctgtcaaaggatggaaagagggaagaaaggagaggagaggggaagaagccctttggctgaaacttgcactgccaacaactgaccccccctctctctcaaagcactgacccaaaaaggggcaccagcagagaggctcagaagatcttctcagtccacaccaggagaccagacctttctcagtgcagggagaaggatgagctgaatgaggaatactcacttatacagcagttaatccagaggatgacagaaacattacaaatgtgacatccttgaaatggaactcctctttggagtgtggaagcccagtcatgcacaacccacttggagcaggaaggaaattgtatttgaggatgttaaagtcaagctaacttttattaaaattgccacaggaggccattcatccccacttcacttatcccacttcaaagcctacttcccatcactcagatgtttacttatggagtgattaagttttcttttatcttttctatgctttcatcagatgctctttttctcttttttgcttagaaaaggcagattttttcagcctaatgtcaatatgtcaaacattaagtattcattcccttgcaatgcacagtgtttatacttacataccctattataacaaatgtaatattatttaattatgcagcaaacttacacataattggtgaacaggtctaaagaatactctatacaggaagcatagagtattcagcttagctgaggcctttgttaaacaatatgcaaagttgcaggtgccacattagggaattttgggggaaaggaaatgcaaacttatttggcaggaaaacaagagaaatgattatatctcacagcactttcaagctggacacatttacatgcctctgtcacatcacccagaagctgtggtgttgagggctgaggcaggagatccttttgccacaggaaaaaggatgaaacgagagacattgtgaaaggttgccccaaagtcttaaggctccctgaaaccttgggttttttgaacaccattgtccaatctgttgaaggttaaataatacgttgttcaaaattgcataggtaaagcgcagaatggccaaagggtcagaactacagcaataggtaggtcccattctctgccttttcattcttcagtcttcggaaatgccacagaggccaagtggcactaggtgcagctgggaatcaagatctgtttatctgtaccttaaataggtcaaagtgaaccttttggaaatattgttttggtaaataaaaattcctggtcgtgctaactgtggctatttcgacctgtttctttcagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggtaagatttgctctctgaatttaaaaacacaatttttgaaactttttcattgatcgctgtaatagttaataaacctgtcacaagaaaacttagtcattgcagaaaatggttaaaacaattttgggacatgatgtacaatggattatttaagagccatcataaacatccaagaagtagtaaagtgaatagaatcctcatagaattcttttttcctttttcaaagatttcccacctctaaaaatctttcattccttttatatctaggaattaatcacagcttggtacataggatttttggttcttattttttcgtctttccttgtctatctggtggaaaaggatgccaataaagagttttctacatatgcagatgctctctggtggggcacagtaagtataaaaatacattttttatttattggatgttgtgaattgtttttttttaatacaacgtaatggttcctatggatggtttcaataaaaatattaaattgcgaaagagagttatatggaaaataaatactacttattattgtctaaaggctttccacatctttttaggccaactaagttgtcttgtaaaccatcattaatatttcttgagtgctagattgttgccaaaattaaaaatatataaaatatataaatatatatcatttttaaaatggtgattaaaacattgatagtttgtttatttgttttaactttgtggagcacaaatttaaatgatcaattgttgcattgattttccgctcttcaaaagtttatctggggttaaaaaatgaatggaagctgtgaataaaattgcagcacaaagaaatgaaaaagaagactggtaaccatctgtgagatcagagattatagtcacctaatttcaaaactttcctctcaaaacctactttttctttatattattaaagaataattttccaaataaataaagtaaaatcatgattcttacatagaaagaaaattaacacatgctaaacattcatttaactcattttaaaagtttaagtcattattaatgaagaaaccagtaagatgttaaaaccagttcaaagcactatccaaaggacagaaacatttaaagatcaggaatattgaaatcaatgtgcaaatagaggcaaaactggctccttccacagtgtgggagggaagtcagttcaacctccactaggcagaatttatttacatgtccataggcaagaattattttgcattgctaccagttatcaacaacttacagagttgtaaaatagctcaaaggctatgaaaagagcagagccccataaaatcagaatccaaaaacctggaagggtgtactctgaacaacgcatagttttccactgaagcaaaaattttccctgcattgtaaagaatttatgaaacagtcattggagctatgccgtaataagaatgacatgggatataggagtgctttatgcaatgtataaattacatttctttttattttattcctttaaggtattccaaaggggagttatatgaaaataatcatagccaaacatggtggctcacgcctgtaatccaagcactttgggaggctaaggcgggccagttgcttgagctcaggcatttgagaccagcctgggcaacatggcaagaccccatccctacaaaaaatacaaaaattagccaggtgtggtggcacactcctgtagttccagctacctgggaggctgaggtggcagaatcacttaagcctggcaggtagattataaatgcttgtctaaagaatgtccatatcgttttggttcaaaaaaccccgtgagttctcttttaaaccacccttagtatttcttgagttctagattgttgccaaaataaaaatatatcattttcttaagctgtgatttaaacaatgataggctttttatttgtttgtttagtgaagcacagagttaccaattgttgcattgttccactagtcatcaaaagctcatcagcaagacccagaacatttgtcagagagggggaaaatttgttagggctgtatttagcagaacttgttgtatttgttgattgcatagcagcaataaaatgaataaaaatgagaaatacattcacctaaagattcgaatttttttcttaagttatctaagtaaatgtctacaagattatgccattggtttcaaaggattccgttggtttaataatgtggtttccggctgctcttcactattcacaagcaataatgggcatttcgaaaaagagtggaagcttgaaagagagcagtcatctgacactcttaaaatactttttatatgtagagagcaaatgaaaatctgtgactcatgatgggataaactgtaaactgagaaaacaggaggcttttcttgccagcaaggggaagacagtttatcatcccagccttcaaagcaatggtttgaattcaagtttaatttttgcttctcttggataattctaatgtatttgacttactgaggcacccaggtgccccttttgccactgagatgcagttgttggtgagtttagcctgggagctcattatctttctttttattagtcttccatttctccttattacaaaaaagaattgctgtattgtgtgttaaacagtgtgtgggaaactcttaatatacctctcagttagtcatcagtttgtttcttttgccagaataacccacacggtaggttttcaaaggtcatatctgtgactttcaggggaagaaacattttcattgatttgcctttcagttctgctaatttgactgacatttaacccgtacttaacaggttcctgaatggcctaattatgtttctatttttaaaaaaaatctagtcttgaatatgagagtaaaaattttataagagatcaaacttcgaagaattttttaaggccttattggtccgtagcaggtttgttgatattaactgactcattaatgaaattgtctgaatcctaaaaagacagaagaagcaaacaaacaagagagctcattgtttctattcattttaagaagaacatatactagattcctagtgggaaataaaataaatttagactattataccttttatttatacattaatcaagaccttagtgaaaattatggttgggtatttcttagttaaaattgcgcatgttgcacctaatggaaaccttaataactatggaagtatccagaataaatagggaaatgatagcatcctaaatgagagtatttctaagtgttacactttgatgaaaaaaggaaatcccctatattaaaagatcccacagtatcaacattaagtatcaaaatataggttttgttccacagatacgctgtgccagtgaattttcaatactaactctggaactccttccattaagatagtgagatctgtcccctagatcaacatttggagggatatcatggtgggatcagtgctgcccaaaaaactttgatccctgaaagcagtttcatattagtgaatagcaatacctagttcattgagtaagtgaaatagatataaaagacctggtaccaagaacatagcaagtgcccaatcaaatatgagagctattgttggtgtagacatcattgctgtggaagttaaatgaaagcacctttaatacaaaaggaacaaaaaaagagctatgtgttttgatgcagacccacagtttgaacacagaagaggcttgggaattggaggttgtgatgaaaagatgtcctgggttctgatgtggcaactaaagttgcattgatggcagaaaatggaagagggaagtagctctagtagctgaggcactgagagttgctggaaaaggggatcttctgattgttggatagagctccatttattatcattttctattgttatttttctcatttttggttgttccagatttattctgaaataatttaagaatgggtttccctggagttattttctgttattaaatccttcctgttttgtgggagtgatttttctctttttgatctgctttagatttattttgaaataacttaagatcaggttttcctgcactccagcctgggtgcttgagtgagaccctgcctcaaagactcccttggggagaattataccgtgccacggaaatctaccaacagtatattgttcacctgaacacattagctataaactaatgtacatagatttactaaaaacataattgtatcttcaaaatcaggtcaataaatatttgttgatttgttgcctgaaagaaagaaggatttatatctcctgatttggaattaattctgctattgaaaagaaaaaaaactttagcctaaccagtgtcttaaattataatctgaccatagcctcagccatctcatttaaaaaaaaaatcaagaaaagtctggaccagagttttcatttgtttttcagtattatttctgaggaagaattcctgaatgctaaacacacgaaggtgcccccactccacctcagattttcctaacataattacaactttatgccaacatttccaacccacagattttcagaatgtattttctttcacctgtgtgactgtatttgagcataggaaacataagggccaaaatatatctaagctgtttctatctgcaagacgccttcaaataaatggtccagctgaagagatggtacaaaataccagggattcctgaggccagctgtggggaggtagcagggcaaagcagaccatccctgcccagatcctcatccgccttgttaccctgcagcctgaaaaggcagctgccagcttctcagtttaagaactgtggcaagaaatggcagcttctcacttaaggagaatactactctgcctagaactttactgaaagagatggtggacatttttgtcacttgtaatttgtttttaattttaaaaagtaaattcaaaacgtcatgaccttacctatgatattataaagatcatactcaaaagtcacgagtatgaatcacagaagatttttataataaaaatgtaatctatccagtgcatgttcaccagcatatctcttacaagctctggaatgaggaaaaaaaatggaattatgtccaatatcgtgatgtaaagatccatctctctattctcctgcttctcatctcttacacacacgtatatataagcaaaatgtcacgctcacatgggtgtgggaaatcaaagctcacgaaacactatttagtttacttgcccacttatgtaaatattgtatttgttttagaatagagtagaagctctcagaacttatttcctcttcactgactggccagattaaccaacactcctcactcccacaaaacatactgaggcttgcagagcacaaaatgctctttagtatccacagaattctgttctgaacattgtttgaatgcttgcaaagagtcagcatgttcattaccaaacctttttttttttttttttttttgagacagggtctcactctgtcacataggttgcagtgcattggtgcatttatagctcgctgcagcctcaacctcccaggttcgagcagccctcccgcctcagcctcctgagtagctgggaccccaggcacatgccaccatgcccagctaattttttactaattttttgaagaaaaggggtctcaccatgttgcccaggctggtctcaaactcctaggttcaagcaatctgtctgccttggcctcccaaagtgctgggattacaggcgtgagccactgtgcccgtcccattcctaaacctttttatgtcagttgtatttgtaattataatggcatggtttaattttatattattgcataaactgatgacatatggtacagaaagaaagatggatggtttacgaaaatagaatgctttagaaaagcttgataaatgcaaaatactaaatatgctaaaatactaaaaatacttcaaaatcaggggtgaacacacaactatgtgggggaaaaatcttaaatatttaggactctgttctcagatagctcccacaaaagttgagtttatgcaccactaaaaaaaaagttaattttaaaaaacattaaaattaaggaaaataaatgatgcattatgagtgagatttatgcaaaaaagataaggcagaaccccaattgcagaacacattcttcatcaagaatattacatttatgtgctttaggctaaaataaaatatgcagcatataagtctctttgtgattatctgcattagtcaaatttctgactaagcaaccaagtagccatcataaaagtttcaattaagaagacttctctgtgtattctcatgcattaatatataatatcagaaaattatctcaccaacagagaataacaaggctgtctcataagaacatttattttacattgattcaactgctttatggttctactaattcccttgcagcacatttgctatgcagagtaaaagtctgatgtattgtgattcacttttaacactgtatatattagaagagaattaaatgctttgactcaggaagtatcaaaaatatattagtacaaaaagaacccattaaccgaccacactttagttctttctgtcatcccaaacccacccaatccctgtcatccccacctacctagcccatatgtagtcatgaagcatcctcatggttcacccgagatgaacagagtcactgggtttaattccagcaccatcacccatgggactcaacccttgcaccctaatgccatatgcacatatagaactggcagagaattacacaacaaagggggcgggatgtgatggaagtatcttcaaaggagcaactacattatttatttaatgttggattcccagtctaaagatagtgtaaagggattatttatttaatgttggattcccagcctaaagacagtgtaaagggagtgtgttatttatttgtttttctttataacagtaatccattttttccaaaatcagctctggctctttaacttcatttggcccatattactgtgttaactgtatactgttaagtgataatagcaacctgcccttctgcctgggagtcactgacgtacgcagtttgtaagcatctgcaatacagagatgatgagatacaattgaataagtcatcttcccatgccatgccatcaggatgctgctgggttcttgaagatctgtgagaaatgtttctagaaaacgaactgactgcctcatcacccaattcaattgtgaagtctagatgtgatttcctccaagcccctaaagatcgcatatgcagcctctccaggttctctgaaacatgctgctattccagaatctccccacttattctgaagaacgggtgcccttgggttcttgtgtgggcctgccctttctccgaccctgaacctaaatgaaactaatcattactgggttctaccagtgaaaagattcataacatttttggaaggcagaaagaggtttattatttagcacaagcatgggagaataagaaccaagagggctcctgctactcagttcatgtacaaaggatcaactgataaacattagcagggcctcccaagtgctaggaaaagaaaagaaatataatgtagttgtacagttccaaggagactcactggtacttcaagggcagcttgacctgaaagtccagaaaaatcaatgaatatctatgcagcgctcatctaaggatggtttatcaaatgcagctggtccttgacttaaaatgtcaaagccagatcaagcagatgggtcagggtgaatacctggaaaaaattaacatctttttattgtaagcacatcttaaagacttcataattttatgtctggtgctatctttctgttcacatcatgaagcccaggtgtcctctttgccaccacagaagggaaatgatgcatgcacgctccaggcaaaaaacgagggaaacccacaccaactccctctctggcatagagggggacaaaactgccaccctgttgccagatccttcccaagcctaagctgccaacaaaaggcccctttgctttaaccaggaaacatccctagctcctttgaaatcagaggggagaaagttattgaggctgggggttcagttgctggctgttcaggtcccttgcattcagtgaaatgtgatcatcccggaagcctgaaccggagtgtagggagaaagtgggcagggtctttgctcacccccagaggaactccagagtgctgttctcagatttcacaaccttctattctcccccgcaaaccacccctgtaagagaaaggggcaaccctaaattcagaatgaaagaaagcaggcactcttttctactcaggatgaaacactgagcacattgtcacttggctgtgtcccattcttcagagttagagtcagtggtttaaaacccactctgtgagcactgggccgagcaaatgtattattggaatgaaaagcaaaggaaaccacgaaatgtaacatttttgctgtgaccaaaccatgaaagttcttcttcagtctattattattaataaaccgatgtaaaaggattaagctatttttcagaaaaagtatagtagattaatatctgtcccacatatataaagattaagaataaaattgacctggaaattttttttctgcattctcaaggaattcttttgagaattccatattaatactgctgatgacattagattaatttggctcctgtaaagttctactacatattccctctctctgacattgaatgagttcttccaaccagcagacctcttattaacctgtccttgaccccttctcagaccttcacagcccaagcctctttgcctattccaagcctctgactccccacacatgatcccaccttctccttgtctataattgaaaggacagacataagcattcctaatccttccctccactcacactgaggccacatcatacccccactgtggaagcgctgtcctttcacactgcctgggctaacccctccaactgtgcccttaaccgaattccttcttgggtactttaccccatcaggaagccgccaccccttccctcttcagtctcaccctctctacaaacatgcagaagtacatcctggaaagcctcccttcaagtcagagattcctgggagttcttgccctctacatctcacttcagttgttgccaatgttcttcaaagtattattcatttatttactaaatatttagtgagtttctctcactttgtggcaagcattatgctagatgttggggaaataaagagcaagctgaggttccactttctagttaaggaaataagaatccctacccaaagaaaaatacaacagactatcactcacgttaatgttattacgaaacaaggagctgtaatatagagtaatcagagtctctactgaagataggtaggaaaggcctctccaatgagggagtattttggataagacctgaaggatgaaaaggagccctgggaagagtgaggaaaatggcaattccagctgagggaacagcttgtgcaaaggccctgaggcagaaagatcctggcttgtttgaagagccaaaaggccactgtcattaaagtgcagtgagcaagggtaaaatcaaaatgatcttaggtaggtggagatggcttaattagtagcttagaatttattttgaattcaacagctagccattgaaggattttttagatggaaataagaaaatgataccccttgcaggtatatgaagaaggaactagaggaaagcaaaagcaaaagcagagagagcaattaagaggctactatagcagcctggtctaccatggtggcagcaaagacagagaaaagggggtgaatttgcaaaaacctaaggagatcgaatcaacaggacttgctgatagattccgtggggggagtgagggaaatgaatagttaggatgattctgaggcttctgacatgagcaagtggatagattggtggagctcttggttaagacaggaaggaatatatttggtagaaataagagttctgttttagacacattcagttaaatgactgtgtgacatctaaatggaactgtcaactgcagatatgtgaattgggaactcagaaaagtggtctggcctagagatataaatttggagtgtttagcataaaagtggcatttaaatctatgagaacatttaagatcacctggaaagagagaaaaaagaggggatagaaaagaaaggaaagtctaagaagaatacaatttttaaaagaagaaaaagacttagaacaaaaccttaaaaatccagtgtccaaaggttgaaaagggtaagaggagccacagaaaaagagccaccaaggaatacaaagagaaaaccatggaagtgaagagaagagtgcttctagaaagaggtggtcagctgagctgaatgcttctgaaaggtctggcatcatagaatttgtctccctctttatcaaacctgcttctgaattgttccccctctttcaaagcccaggtaaggtggcatgaccagagcaaccactttctcagtgattgccagtgaccacctatctccaccatattcagtctctttttctcaatgctcattgtccttgttttctttttctctctctctctctttttttttttttttccagatggagtttcactctgttgcccaggctggagtgcaatggtgtgatcttggctcactgcaacctccacatcctagattcaatcaattcccctgcctcaccctcctgagtagctgggattacaggcatgcaccaccacacctggctagttttgtatttttagtggagatggagtttcaccatgttggccaggctggtctcaaactcctggcctcaggtgatccacctgcctcggcctcccaaagtgctgagattacaggcataagccaccgtgcccagactcactgtccttgttttctattaggctgtgacatcagagattacctggtctttgtgaaactctccattctctattgagtttccatttatataaccctttcccgattgttctacttttgaaaaacttgaaaaacatgacatccaaagacattcttctctgactttcctttcccttccattccttaaatgtctgtgttttttgaggtgtccctggaccctttctgtgtaccttttgtaatctcagttatgcacatagctttaacatcaccctgttactgattctaaaacccaaatctcacgccaaaccaaatttctctctcaggactcaagctctcattctcagtttcctgctagacatttctgcattagtcatactgacatttgaaaaaccattatttgcaaaactaaactcttcacctttactccaaaaccttctctttttcattataatgcttttatttatggtgcaaccatcttcccacttaaaattttcaagtcactgttaacttagtctttccttttacctcaatcaataaatttatttctattgaacttcctaaacatttctctttactctccactctcatagtgtcttaactggtctctgcacctctcatttcttcctatttcaatctctcctgtacatttgctgccataatttcagcttctaaaagcactactctgatcacattatgtactttgcttacaaaaaccttccgtcagtatttctgggctgcaaaacaagagagcagaatcctatcccacccatagggctttcattcctttattcagtaaatatatattgagtgactactgtatgccaatcactgtgcaaggtgcttggattcagcagtaagataaagtcccaacccacatacaatttactttctagttgggaaggcaaacaataaacaatttaatcaatatacaatatcatttcaggtattgatacattctatgaataaagatgaacagaataaggatttaggaaacagttggtagggaagtagctttttttgttgttgttgattttcgtggggttttgttttgtctttatgagaaaatgactgttattattatacagtgtcccccagcgattatttttctgtaaattattggggaacaggtggtttttggttacataagtaagttctttcacggtgagttgtgagattttggtgcacccatcacccaagcagtatacactgcaccctatttgtagtcttttatccctctcctccttcccatcctttcaccttgagtctccaaagttcattgtgacattcttatgcctttgcatcctcatagtttagctcccacctatgagtgagaacataggatgtttggttttccattcctgagttacttcacttagaacaatagtctccaatctcatctaggtggctgcaaatgccattaattcattcctctttatggctgagtagtattccatcatgtatatatatataccacagtttctttatccactcattgattgatgggcatttgggttggttccacatttttgcaattgtgaattgcgctgctataaacatgcatgtgcaagtgtcttcttcatataatgacttcttttcctctgggtagataaccagtagtgagattgctggatcaaatggttctacttttagttctttaaggaatctccacactattttctatagtggttgtgctagtttacattccaaccagcagtgtagatgtgttccctgttcaccgcatctccaccaacatctactatttttccacttttttattatggccatttttgcaggactaaggtggtatcacattgtggttttcatttgcatttccctgatcattagcgatgttgagcattttttcatgtgtcttggccattcatatatcatcttttgagaattgtctattcatgtccttagcccactttttgatgggattgtttgtttttttcatgttgatttgtttgagttcattgtagattctagatattcatcctttgtcaaatgtatagattataacgattttctcccactctgtgagttgtctgtttactctgctgactgtttcttttgccgtgcaaaagctctttagtttaattaagtaccagcaatttatctttgtttttattgcattcacttttgggttcttggtcttgaaatccttgcctaactcaatgtatagaagggtttctccaatgttatcttctagagtgtttatagtttcaggctctatatttaagtccttaatccaccttcagttgattcttgtatgtggtgagaaatgaggatccagtttaattctcctacatatggctagccaattatcccagcaccatttgttgaaaagggtgtccttcgcttctcaaaagaagacatttatacagccaacaaaattatgaaaaaatgctcatcatcactggtcatcaaagaaatgcaagtcaaaaccacaatgagataccatctcaagccagttagaatggcgatcattaaagagtcaggaaacaacagatgctggagaggatgtggagaaataggaacacttttacactgttggtgggagtataaattagttcaaccattgtgcaagacagtgtggcaactcctcaaggatctagaactagacataccatttgacccagcaatcccattactgggtatatacccaaagtattataaatcattctactataaagacaaatgcacttgtatgtttattgtagcacttttcacagtagtaaagtcttggaaccaacccaaatgcccatcaatgatagactggataaagaaaatgtggcacatatacaccaaggaatactatacagccataaaaaaggatgagttcatgtcctttgcagggacatggatgaaactggaaaccatcattctcagcaaagtaactcaagaagagaaaaccaaacaccacatgttttcactcataagtgggagctgaacaatgagaacacatggacacagggaggggaacatcacacaccagggcctgtcaggggttagggggctgggggagggatagcattaggagaaatacctaatgtaaatgatgagctgatgggtgcaacaaaccaatattgcacatgtatacctaggtaacaaacctgcactttgtgcacatgtaccccagaacttaaagtataataaaaaagataaaattcagccttaaaaaaaagaaaaagaaaaagaaaagggtgtcctttccccattttatgtttttgtttgctttgtccaagatcagttgactgtaagtaccttggtttgtttctggattctctattctgttccattggtctatgtgcatatttttataccaataccatgctgtcttggtgactatggccttgtagtttgaaatcaggtaatgtgatgcctccaggtttggttgggtttgtttttgttgttgttgttgttgtttggttggttgggttttttgttggtttatttgtttgtttgttttggcttagtccttctttggctatgtgggctctttcctggttccatgtgaattttatcattgttttttctaattctgtgaagaatgatggtggtattttgatggaaattgcattgaatttgtagattgcttttggaagtatggtcatttttacaatattgattctacctatccgtgagcattggatatgtttccatttgtttgtgtcatctatgatttctttcagcagtgttttgtagttttccatgtagaggtctttcacttccttggttaggtatattcctaagttttgtggattttttttttgtttgtttgttttttgtttcgttttgttttgtttttttgtttttgtagctattgtaaaggggattgagttcttgatttgattctcagcttggtcgctgttggtgtatagaagagatactgatttgtgtatgtgaattttatatccagaaagtttgctgaattcttttgcaagttctaggagctttctggaggagtctttagggttttctaggtaaacattcatatcatcagcaaacagcaacagtttgacttcctctttaatgagttggatgccctttatttcttcctcttgtctgattgctctggcaaggacttccagtattatgatgaagaggagtgataagagtgggcatccttatcttgttccagttctcagagggaatgctttcaacttttccccattcagtattatgttggctgtgggtttgtcataggtgacttttattacttttattacattgttatattatgacattttattgtcatagatgtcctttgtgtaccagttttgttgagagttttaacgataaaggaatgctagattttgttgaatgctttttctgcgtctattgagatgatcatgtgattttggtttttaattctgtttatgtggtgtatcacatttattgacttgcatatgttaaactatccctgcatccctggtatgaaacccatttgatcatggtggattatctttttgatatgctgttagattcggttagctagtattttgttaacaattttagcatctatgttcatcagggatattggtctgtagttttcttttttgattatgtcctttcctggttttggtattagggtgatactggcttcatagaatgaattggggagggttccttctttatcttgtggaatagtgtcaataggactggtatcaattcttctttgaatgtctagtagaattctgctgtgaatccatctggtcctggactttttttgttggtaattttttaactaccatttcaatctcattacttgttattggtcattcaggctatctaattcttcctgatttaaactaggagggttgtatttttccagaaatttatccatctcttctagattttccagtttatgtgcgtaatggtgttcatagtagccttgaatgatcttttgtatttctgtggtgtcagttgtaatatctcccatttcatttcttcttgagctaatttgcattttctctcttctttttatggttaatcttgctaacggtctatcaattttattcatttttaaagaaccagctttttgtttcatttatcttttgtattttgtttgtttgtttcaaattcatttggttctgctctgatcgtggttatttcctttcttctgctgggtctgggtttggtttgttcttgcttctctagttccttgaggtgtgaccttagattgtctgtttgtgctctttcagactttttgatgtaggcatttatggctataaactttcttcttagcatcgcctttgctgtgtcccagagatcttgatatgttgtgtcattgttgccattcaattcaaagaattttttaatttccatcttgatttcatttttggcccaatgatcattcaagagcaggttatttaatttccatatatttgcatggctttgaaagttcattttggagttgattttcagttttattccactgtggtctgagagagtgcttgatataatttcaattttcttaaatttattgaggctcattttgtggcctgtcatatggtctaccttggagaaagttccatgcactgaatagaatgtatattctatggttgttggatggaatgttctgtatatatctgttaagtctatttgttccaaggtatagtttaaatccattgtttcattgttgaccttcagtcttgattatctgtccagtgctgtcagtggagtattgaagtctcccactattattatgttgccacctgtctcatttctaaggtctgttagtaattgttttataaatttgatagttccagtgttcagtgcatatacgtttaggattgtgatgttttcctgttggactaggccttttatcattatataatgccctctttgtcttttttaactgctgttgctttaaagtttgtttgtctaagaataggtactcccgtttgcttttggtgtccatattccaaaaatgtctttttccacacctttaccttaagtttgtgagactccttatgtgttaggtgagtctcttgaagtcagcaggtagttggttggtgaattcttatcaattctacaattctatatcttttaagtggagcatttaagccatttacattcaacgttagtattgagatgtgaggtaccattccattcattatgctatttgttgcctgtataccttggttttttgttttttgtttttgttttttaaattgtatttttgttttataggtcctgtgagatttatgctttaaagaggttctgttttgatgtgtttccaggatttgtttcgagatttagagctccttttagcagttcttgtagtggtggcttggtagtggtgaattctctcagaatttgtctgtctgaaaaagactgtatctttccttcatatatgaaggatagttttgttggatacaaaattcttggctggtaattcttttgcttgaggaggccgaagacaaggccccaataccttctagcttatagggtttctgctgagaaatctgctgttaatctaataggtttttatttataggttaccaggtacttttgtctcactgctcttaaaattctttcctttgtcttaactttagattacctgatgacaatgtgcctaggtgatgatctttttgcaatgaatttcccaggtgttctttgtgcttcttgtatttggatgtctaggtctctagcaatgctggggaagttttcctctgttattccctgaaatatgttttccaaacttttagatttctcttcttcctcaagaacactgattattcttagctttggtcatctaacataatcccagacttcttggaggctgtgttcgtattttcttattcttttttctttgtctttatggagtgcgttaactgaaagaccttgtcttagagctctgaaattctttcttctacttgttcaattctattgctgagactttccagagcattttgcatttctataagggtgtccaaagtttactgaagttttgactgttttttatttatgctatctatttccttgaatatttctcccttcacttcttgtatcattttttggatttccttaaatcgggcttcacatgtctctggtgctccctgattagcttaataattaacctcctcaattctttttcaggcaaatcagggatttcttcttggtttgggtccattgctggggagctagtgtgattttttgggagttgtaaagaactttgttttgtcatattaacagaatcggtttctggttccttcttatttgggtaggctctgtcagagggaagatctagggctgaaggctgttgttcagattcttttgtaccacagggtgttcccttggtgtagtactctccccctgttcctatggatgtgacttcctgagagctgagctgtagtgattgttatctatcttgtggatctagccacccaacaagtcttccagactccgggctggcactggggattgtctacagagtcctgtgatgtgaaccatctgtgggtttctcagccgtggatgctagcacagtatttagggtgtctcctaggtccttcaggagcaatctgcttcctgcagggggtctgtgggtcctctctattttcgttttaaaggcagactttgtaataggacacactagtgggcaatttatagttgtatactcataagcaaactgtttaaattatctgaatccaagtttcctcatatgatcacaagatgaggtcccacaacaggtcgtctgcaagctgaggagcaaggaagccactctgagtcccaaaaccccaaaagtagggaagccgacagtgcagctttcagtctgtggtcaaagatccaagagtcccaaaattgaagaacttagagtccagtgttcaaggacaggaggcatcccggatgggagaaagatgtaggctgggagactaagccagtcttgggaagtggcttaaattaggtgatctgggatggttttctgtggagctgacatttcagcaggtacctgaatgcaaacctggaagtaacagaaattcagaaagagaaaagcaagggcaaaggtccttaggcaaaaaaaaaaaaaaaaagagcttggtgtgctgatgaatagcaaggcaggaggggcagaagcagaatgagagagagcatggtagaagaccatatctgagaagttagctgaggtcaatcatgaagaaccctgcaggccatggaggagctgggactttgttctaagagatgtggggaacgcctggagcagtctgatcataggagaggcatgatattcaaagacattccctggcctagctttagcatatctagttaaccttctctttactaatcctttacttttctttcattgtaaattgagaaattatagttgtatatatttctggggtagaaagtgatgctatgatttacaaacacaatgtggaatcattacatcgtgctaattaacatatccaccacttcaaatacatatcaatttttgtggtgtggctgggtgcagtgactcactcctataatcccagcattttgggaggccaaggcagggggatcatttgaagtcaaaagttcaagaccagcctggccaacatggtgaaaccctgtctctactagaaatacaaaaattagctgggtgtggtggcggatgcctgtaatcccagctactcaagaggctgaaacaggagaatcacttgaacctgcgaggcagtttgcggtaagctgagaccgtgccactgcactccagtctgggtgacagagtgactcagtctcagaaaaaaaaaatgtggtaagagaatttgaaatttagtcttagtaattttgaaatgcacaatacacattactaactgtattcaccacactgtgcaatagatctcatatatatatatatatacacacacacatacacatattgttcctgtttaactgaggctttgtgtcctttgaccatcatctccccattcccccaacccccagcctctggtaaccagcatactactctcttctaccatgggtttcattgtttcagattccccatgtagtgaaaacatgcagtatttacctttctgtgcctggcttattgcagatcatctcatgagatgcagaaacatcatttgatcaaattttatttcataataaaaatcctcaacaaattaggtacagaaggaatgtaactcaacacaataaaaagcatatattataagccaatagctaacattatactccacagtgaaaaattgaaatcctttcctctaagatccagaacaaaataaggatgcccacttgagcaagatctagtgctgtgctggcttcaggtctaacccagtgcagtctcagtgatggtggccacaaggctgcttgtgtcgcccctcaccaagctccaggcacctcagcacagagaaagagagactcgtttgtttgggagaatgtaaggaagagaacaagagtttttgcccagtaatccagagaattctttcagatcttattcaagaccaccaaggtgatacatctacaagtctacaagaaccatagcattactgggcttggggtaccccttaatgcagaaatgcctgcagtgaccaaaaacttagatcataatactgaagtcccttcaaataccaggaaagccttcccaaggaggatggctacaaacaagcccagattacaaagactacaataaatacctaactcttcaatgcccagacactgacaaacaccacaacctcaagataatccaggaaaacatgagacactcaacataacacagagaatgaattcagaattttatcagataaatttaacaaataaattgaaataattaaaaagaatcaagcagaaaatctggaggtcaaaaatgcaactgacatactgaagaatcatcagagtcccttaatagcagaattgatcaagcagaagaaagaactagtgagcatgaagacaggctatttaaaaatacatggtcagcagagacaaaagataaaagaataaaaaagaaggaaatgcccaaaatatctataaaatagcttcaaaggggcaaatctaagttattggccttaaaaagtagggagagagagagaaagtttattcaaagggataataacagaacttcccaaacctagagaaagatatcaatattcaagtaaaagaaggctatagaacaccaaacagatttaacctcaaagcattcactaataaacttgcaaaattcaaggataaagaaaagattttataagcagcaaaagaagagaaataaataacgtgcaatggagctccaatacatctggcagcagacttttcagtggaaaccttacaggccaggaaagagtggcatggcatatttaaagtgctgaagggaaaaaatattttatccttgaatagtatatctggcaaaaatagccttcatgaaggagaaataaagactttcccagacaaacaaaaactgaggcatttcatcaacaccagacctgtcctataagaaatgctaaagtgatttctttagtttgaaagaaaaaaggcattaaggaaaaactaaaaaccatctaagggtagaaaactcactggtaatagtaagtacacagaaaaacagaatattatagcactataattgtgctaattatttatattttaagtagaaagacaaaaagatgaacttatcaaaaataactacaacagcttttcaagatatacacagcataataagataaagtagaaacaacaaaaagtttaaaagtgggatgacaaagttaaaatgtagcattttcattaattttctttttgtttatttgtttatgcaatcggagttaaattgtgatcagtttaaaataatgggttataagatattatttgcaagcctcatagtaacctaaaatcaaaaaagcatacaatggatacacacaaaaaaataaaaagcaagaaactaaatcataccaccagagaaaatcactttcaatgaaaggaagacaagaaggaaagaaaaaagcaagagaagaccacaaaacaactagaaaacaaataacaaaatggcaggagtaagtccttacttatccataataacactgaatataaatggattaaactctccaatcaaaagacacaggattgaatggattcaatggattaaaattaaattttaaaaagcaagacccaatgatctgttgactacaagaaacatacttcatctataaagactcacatagattgaaaataaagggataaaaaaagatatcccatgcaaatggaaaccgaaaaagagcaggagtagctacacttagatcagacagaataggtttcaagacaaaagctatcaaaagagacaaggaaggtcattatataatgataaaggaatcaattcagcaagaggatataacaactataaatatatatgcacccaacactggagcacccagatatataaagcaaatattattagagcaaaagagagagacataccccaagtcaataatagctggaaacgtcaacacccaactttcagcattggacagatcatccagacagaaaatcaacaaagaaacatcaaacttaatctgcacaatagaccaaatggacctaataaatatttatagaacatttcatccaacagctgcagaatactccacacacttctcctaaacacatggattattctcaaggatagatcaggataggccacatgttaggccacaaaacaagtcttaagacattcagaaaattgaaataatatcaagtatcttctctgaccacaattgaatgaaactaaaaatcagtaacaagagaaaatttggaaactatacaaacacatgtaaattaaacaatatgctcctgaatgaccaatgggtcaatgaagagattaagaagcaaattgaaaaatgtcttgaaacaaatgataatggaaacacaacctataacaaaaccaatgggatacagcaaaaggagtactaaaagggaagtttataactaaaagtgcttacatcagtaaagaagaaaaacttcaaataaacaacctattatgcaacctacaagagcaagagtaaaccaaacccaaagttagtaggagaaaggaaataaagatcagagcagaaataaatgaaattgaaacaaagaaaatacaaaagattaacaaggccaggcactgtggctcacgcctgtaatcccagcactttgggaggctgaggcaggcggatcatgaggtcaggagaccgagaccatcctggctaacatgatgaaaccctgtctctactaaaaaatacaaaaaaaaatagctgggcgtggtggcaggcgcctgtagtcccagctactcgggaagctgaggcaggagaatggcgtgaacccgggaggcggagcttgcagtgagcccagatcacaccactgcactccagcctgggcaacagagtgagactctgtctcaaaaaagaaaaaaaaaaaagataaacaaaagaaaaagttgttttttgaaaagataaacaaaaatgacaaacttagccagactaagaaaaaaggagagaagacccaaataaataaaatcagagatgaaaaaggagacattaaaactgatactacagaaattcaaaggatcattagaggctactgtgagaaactatataccaataaattggaaaacctagaagaaatggataaattcctatatacatacaacctaccaacattgaaccatgaagaaatccaaaacctgaacagaccaataacaagtaatgagattgaagccataaaaaaaattatcccagcaaagaaaaacctgaaacctgatggctttactgttgaattctaccaaacaatgaaagaagaactaataccaatcctgctcaaactattccaaaaagtagaggaggaacaaatacttctaaactcattctatgaggccagtgttatcctaataccaaaaccagacaaaaaatgcatttaaaaaagaaaactacaggccaccatccctaatgaacattgatggaaaaatccttgacaaaatactagcaaaccgaattcaacaacacattaaaaagatcatccatcatgaccaagtgagatttatctcagggatgcaaggatggttcctcctatatttagaacacaacaaagatgctcattttcaccactgttattcaacatagtactgaaagtcctagctacagcaatcagagaagagagaaataaagagcatccaaattgggaaggaagaagtcaagttatgcttgtttgcagatgatatgatcttatatttggaaaaacctagagtccccataaaaaaactattagaactgataaacaaattcagtcaagttgcagaatacaaaataaaatacaaaaatcagcagcatttctatatgccaactgcaaacaatctgaaaaagaaattgagaaaataatcccatttacaatagctacaaataaaattaaatacctaggaattaaccagagaagtgaaagatctctacaaagaaaactatgaaacactgatgaaagatattaaagaggatacaaaaaaaggaaagatatttcatgttcatggattagaataatcattattgttaaaatttccatatttctcaaagcaatctacaaattcagagcaattcctaacaaaaataccaatgacattcttcacataaatggaaaaaacagtgctaaaatttatatggaaccagaaaatacccagaagagccaaagctatcctaagcaaaaagagaaaaactggagaaatcacattacctgacttcaaattatactacagagatatagtaaccaaaacaaaatggtactggcataaaaacatatactgaccaatgggacagaagagagaaaccagaaacaaatccgtacatccacagtgaactcattttcgacaaaagtaccaagaacatgcaacgaggaaaggacagtctcttcaataaaaggtgctggagaaactggatatccatatgaagaagaatgaaattagacccctatcccttgccatatggaaaaaaatcaaatcaaaatgggattaaaaagttaaatctaatacctcaatctatgaaactactacaagaaaacatgagggaaattctccagggcaaggatttcgtgagtaatatcccacaagcacagtcaaccaaggcaaaaacgaacaaatgggatcacatcacgtgaaaaagcttctgcacagcaaaggaaacaatcaacaaaatgaagagacaacccacagaatgggagaaaatatttgcaaattatccatctgacaagagattaataaccagaatatataaggagctctcatgactgtataagaaaaaataaaataatccaattttaaaacgggcaaaaaatctaaatagatatttctcaaaagatgacattacaaaccacaaacaggcatatgaaaaggtgctcaatataattaatcatcagagatatgcaaatcaaactgcaatgagatatcatctcactccagtaaatgacaggcactaacaaatgctgtcaaggatttggagacaggcaataacaaatgctggcaaggatttggagaaaaggacaggcaataacaaattctggcaaggatttggagaaaaaggaaccattgtacactgttggtgggaatgtaaattagtataatttagccactatggagaagagcttggaggtttctcataaaactaaaaatagagctaccatgtgatccagcaatcccactgctaggtatattcccaaaagaaaggaaatcagtatatcaaagagatatctgcactctcatgtttattgcagcactatacacaatggccaagatttggaagtaacccaagcatccatcaacagacagataaagaaaatgtggcatatatacacaatggagtactattcagccattaaaaagaatgagaacctgtcatttgcagcaacatggatgcaagcggagctcattttgttgagtaaaataagccaggcacagaaagacaaacttcacatggtctcatttatttgtggaaactaagaattaacagttaaggattaagaaaatgtggcacatatacaccatggaatactatgcagccacaaaacaggatgagttcgtgtcctttgtagggacatggatgaagctggaaaccatcattctcagcaaactatcgcaaggacagaaaatcaaacaccacatgttctcattcataggtgggaattgaacaatgagaacacttggacacaggatggggaacatcacatactggggcctgtcatgggggggggggagaggggagggatagcattaggagaaatacctaatgtagatgatgagttaatgggtgcagcacaccaacatggcacatgtatacatatataacaaacctgcacattgtgcacatgtaccctagaacttaaagtataataattaaaaaaaattaacagttaaactcacaaagatagagagtagaatgatgggtaccagagtatgagaagggtagtggagagagtgagcagagagggaagcggagatggttaatggacaccaaaaaaaaaccagaaagagtgaataacgtctagtatttgaaagtacaaaagtgtgactatagtcagtaataatttaattgtacattttaaaataattaagagtataattggattatttgtaacacaaaggataaatgcttgaggtgatggataccccttttaccctgatatcatcattacatatcgcatgccagtatcaaaatatcccacataactcataaatatatatacctactgtgtacccacaaaaattaaaaattattaataaattattagtttgatttaaaaaaaacaaggatgctcacttttgccacttctattcaatatagtagtggaagtccatgccagagcagttagacaagagaaagaaataaaaggcatccaaataagaaaggaagaaaggaaatttttgctgtttgctgacaacataatcttatatatagaaaaccctaaagattccagaaaaaaactgctagaactaataaattcagtacagttacaggagacacaatcaacaccacaaaaatcactagcatttctatacattaacaacaaactttccaaaaaagaaatcaagagagcaatcccatttacagtagctacaaaaattaaaatacttaggaataaatttaaccaaggagctgaaagacctgtacacagtagtctataaaatattaaaaaaataaattgaagaagtcactaatcctttttaaatccaccatgccccagtccagctgaacaactcatacttttcagaatctactctatgtgttctcactgttctgcagctagccacctctttctcctccctagatcaccttctttatcatttctgcttctcaaaatgttacccctctttcaaagcccaggtatgatgacatctccctagtaaagctccctcaacacctcaagcttataataactaatctcttccttgaattcccatagcaggttatttgtacctccattataatacctctctcatcctgttttgcattttaattattcatgtgtggcatgtttctcttattaggccataaatatcttaggacaagaactatgccctcatttttgttccactacaaatcttaacacataccttgcacacaccagaccttcaggaaatgcctgctaaggtaacgaagggacagcctaaattaacataaattattatttgtgtactgatccagtcctaaatccatggtgctatcatttctgtatcactgatggttatccacttacttaaataatctttccttaaatacacttagaaaagacggaaaactgtgttataagggaggaacaagtatgtaggttattcctttccttaaacaaagagaagttctgtcatgcgtcatggaaaattaaagcacagtaataaaaagcacgaacaagatttgttgaataatgatttagtggaaacgttgcttgcctcctgttcataggtcctaactttcctctcaagtacttaagctgcacattctatttattttgtttctagattacattgacaactattggctatggagacaaaactcccctaacttggctgggaagattgctttctgcaggctttgcactccttggcatttctttctttgcacttcctgccgtgagtatctttgcaccaataaagcagtttaaattagatcttagagacttattagagtgagctctcacaaattcgtatgcttgggaacatatctatatcatttacaaatataatttttccgatataatgttgacttttctaaatatatctacttggataatttataaaatatggtcttcccttggagacacttaatctgagactttatttaatgtaggctcatactttgtgaccaaataatcattcagatggctcactttttaggcaacatgctactaagacatttaaaatatttgcaaagatttaaagctatattcttttaaaactgatccttccaatttggtttataatgtgtgctacttaagagacagatgtgcacaatggagtatttttctcttcagatccatttgagtgaaaagcatatgaccttaaagggtgttaaacatgtcagatgatttattcattgtgtcatcatcattgatttttttaatgagcagtttctgtatcttatcagaataaagggcacatttatctgcccccaagcttctgattattttctccttagtgaatgaagcctgcctttctcatacttttattctcttgtgtctttaaaggcagctgttcaaaatattacagtttgcccccatttccaagttcttgcttttgttcgctccatctggggtagggaaggaggagccaataaaaaggagggttaacgcggtgggagcagaagtgcttaaggaaaatagatccagtcttgctccagacacagctcaagctgtgccaaccagagaccccagagcacctctccaaagctcttttaggtggtagggcttctcctctgcctattaataagtgcagagaacacccttgtcccaccagtgcccaacttgagattcaccagatcgttctgccccagaacactcaaaatcacagaaaagagactgaaaaggccatgcatatgcttgggtactagacctcagtttgaatacatctttgtcacatactaactatatgactgctttagtttactagggctgccttaacaagtaccacagactgggtgacttaaacaatagaaaggtattgtctcacagttcccaagactggacgtccaaaatcaaagcattgagaaaccacgagagccatgagagaaagaactgttccaggcctctcttcttggcttatagatggctcttcttcctgtgtcttcacatcatctgtgtccaaatttctacttcctagaagaacaccagtcatatttgattagggtccatcctaatgacctcgttttaacttgattacctctgtaaggaccctattttcaaacaaggtcacattctgaggtcatggggattaggacttcaacatatgaattttggaaggacgcaattcagcctgaacagtgaccctgaataagtttcttttttaatagaatggaggaagaattattgagcccagagaaattttgtgcggaccaatgtaataatgtaagtcaagtgcttgtcatgaagagaactctcaataaatgttacttccctttgcctgtatgaatctagaaatacatgtttcctggaacaaaatgatgaaatccaggagaattaaaaaaaaaaaaatcttacgtatccaaggcaacttcatctggcaatctcaacaattcagaacagagaagagattcactcaataatcagattccctacaggaaaatacctttagaaacaatacaacgcagtcttgggttttttcccaaaataatggcacaaaataattgcagcttttgtgtttatatttatcctgaggccacatgtagagcaacctctatgattcagtgaaaaactatgaacaaggaggtaggcaacctctgggctgttgaaatagacaacaggctatgttctgtcctcataggagagccacttgagacctaattcataacctagtcttcattcagagaaaattctgataaactcacctatatggtttcacaattctttgaagattataaacaacaaatatagaggaagatgatagaacaaacactgcaacagaaagaaatggtaaaagactaacagcaaagaagggaaaaggaaatctgtgagtagcaagcagacatcagtgttcaaaatgtgtatcctgtcagtaaaaataaaattaaattaaaagggaaaacaaaatgtatgaagatctagggccaattagtgttagggtcaacaaacctctggaagttggctgcacccagcacagcaaaaaggcagtccccataatgaaactctaaactatcacagggaggttaaatatgtcactaggttaagttaaaggtcagagactaagtagtcattcttggaaatgtttccaataaagtaagtatgaaatttttatatgcaaattaaattaacctatgttggaaatctgaaaattttgctttcacagaaaattacatttcttaagaaccccaagaaaagtaacctctactaaggatcttttactgaaacttcacaatattttctgagtccttatttattaaatgaaagactgaatggtccatatatacctttagaaaaaaacaagattgccagagattttattatatcctgtgtatctgccaaccaaaagagttgtctgattgaaatttaggaagacacattgacattttgctgagaaagctagaggtggattgtgggctgcccctatgtagggttcctcccacccaggacacctgagaaccaagaaagaaaagagcctttctccatcttaccctcaaagcagaagggccatcctgcacatcacagagtcatacaagccacccatccaaagcgccactgtggggtcacttcccctggtgcccgctccatctctgggctaatgagctcacagaagaagccccagctcccctgtgttaccctgatatgcaggtctttctcctttttagagtgctcccttgtcttctgctagatattcctgctaagagtattttcattgatgaagaaattgagttttatagagactgaattccttgagacctccagctagtaaattcagtgcaagaactagtgctgtttgactcacgatattaaccattccattaaaaatattggccactgtaatccttaacaatattaactaaatgtaattattgcatataataacatgttaaaaaccgtttaaaaaaacagggcatcttgctgggcgtggtgattcacgcctgtaatcccagcactttgggaggccgaggcggtcggatcacaaggtgaggagatcgagaccatcctgcctaacatggtgaaaccatatatctactaaaaaatacaaaaaatcagccaggcgtggtggcgggcacctgtaatcccagctactcgggaggctgaggcaggagaatgatgtaaacccaggaggcggaacttgcagtgagccgagatcgctccactgcactccagcctgggcaacagagcaagactccatctcaaaaaaaataaaaaataaaaaaaataggatgtctttcagcattgcctatttgctatgtgtgggttacaaattaggttcatttaatccagaagataatgaagggtaaatttctttacatttattggtgtcagtatttgaagggatgacatatatgttcaaagcttaagccatgttttatgtgtgtatatacaaatataatagaccttattttcacagacttctgtttaggtgcaccaagctgtgtactaagagagaggtggaaaaaaattggaaaggagccatgatgagacaataagcagacctggtttaataactgctgtaatgtacagtctggcacaagaaatacgtagtgaacatttaccattcactaatatatgtttccgagcaatgccaatgtgattttcagcacattttagattgtttggcagatgataaatttgtgctatgtagggcctgtctttattttccaaaggggattaaactccgaacctcacatccacatcataagtgctcaaaatggtagctagtgctgttaattcaatgtctgcaaaatctaaattatgctccatacaagtggattatacacatatatgcacataaatgcatgtatatatactacatattataaatatatgccagaaattttggtatttcatattctcttacatgtctacactttatgaaaagtagtattaaagggaaaataaagaaatctttcctaaatgatcttacacagcagaaaaaaattagaagttacaaatgacttaagttgttctggatttagaaatggaggggcatttttataacacctaaatggagggaaatgttgtttaaatctataaaccagatcacagagaccaggtttttataaagcttagtttgtacaatcacaacctgtatgagatagagatcttagacagcgtaagacagtcactgaaaaggagagatggaaaacagaacctatgatgtaatttctaatttcatagtacagtcatttatactaattaataatggagtagatcattgctcacgaatagcaaatagtattatcagaccactgcgtattttaaacatgattgcattacttattgtctggttattgtcactgatgtactcagaagtgtggaatctcaagataagaaggaaggttaaaggttatctagagcccaaaaatatctcagccaagttgttattcagttgagacttaacaccttctagaaatgaaaaacccaccacctctccagacagcctatagcatctttgaaccatctttgagctactctaaaaataaaaagaaaagaaaagcaaccattccttacctgtagcaaatactgacttagtgcttataaaatgtccatctctaaccaaagggttagactccttgaagtttaataaaaaactaataatttatagctagcaagtaaaatccacagacttgaaagcagcagagctcccagccccatgctaataaactcaagagttaaagacaaagcccagagactgaatttagcaagctccaaaagccaacccaaggctgagacaaagcatcttgtttttacaaatgttagtagaccagagcaaattgaaaagagtgggggacatcaaagaaccagaattttggcagatcaagatgataagcagaagaaaagcaaactggcccaaaactaatgtaaacctagaagggaatactaatcttactaatcccaaaaactgaataggtgagccaaaataaaaaaggcaaggaatggtaaaagtgtgaattaaaatgggaatgtgctttgcaatgatccacgttcttgtctctagtgtacaaatgggcaaaatagaaaaccttctactctatatcttcaaaactgagtatccctgctctccattttacttttcttttagtaggtgtacagttataacattataaagaactacagctgggacagattttatacagtcctctctcctccatttcatgaatagagaatctaactttcagagtctcatcaaagtgctagaagtattcccatgttcacagcagtgagactttaactccctcagatttaaaatccagctctgtcccaagttgaaattcatgttctctacattccatcactggatgagaccattcaatctaacttaggcaaaaagaaatgtcacagagaaggccacacacacacaaaaaaattttattgtgattttatttataatcatggtgcctatgctataccacaaaagataataaatgacaatgcctaattgacttactaaagaacagaagttgtatctcctggcagtattgcccaacaatttgccattggctattggtattataatggagataaatactgcttattttaataagtaacatgtttatggacaggttacataccgtttgtcttctctcagactcattttagtgactttttaatatttgtattatttaacagtgcttttgaaatttttgagtgccatttttgtattttgttccagggcattcttggctcaggttttgcattaaaagtacaagaacaacaccgccagaaacactttgagaaaagaaggaacccagctgccaacctcattcaggtaaatgtcaatgtaataggtagatggcaacatttgtgtccatagtgcttgatgggtcattttccaatctctgtgcttcattgcttggtagaactactgctttgttcctttttataaaatgaagtcagaacttaatgtacagtcttggatttggacagtcttggatttgttcctcctctcccaaactgaaacacatgtatttttagcaaatggtccatgcattgttcagactaagtaaccatgtcagcaaggccatgcaaaggttagcagttgtgtggctcgtggaattatctaatatgtcttatgaattacttgatgaaacgtaattgatcattaagtgatggagcagaacagggcattgttccctgcattccaattactttctccagccagatgtatgttgctgttttaaagaacaacatatttgtttagaatgtcaaggtttaatacctgtgaaattgcttttagtgccatctagggcagttagcggaaatagctatcctattttgagagctgatgggactatggaatacatcagtgtttgagaatattaaacaataagtatataatttgaagctagctcctaatacataggttgttatttagtatttcattttcttttcactaactcaggattagcttcagcactaaaaggaatgcttctccttttgccatccatatattttccatcctagatccaggttaagaatcacaaaatatattttttgttagattcataatgtagagttgacatttagttatggacaaaataattctacaatctaaagtttctcccctcctgctagggaagtggaagctaccgaatttctaaactggagggtcttgaagtggtgctccaaggccctaggaaacttgccttaaagctgcagtaacgggcacactgttttgttgctgttgttgttttgttttattttttgtttgttttgtttttttttttttgagacagagtcccgctttgtcgcccaggctggagtgcagtggtgcgatctcggctcactgcaagctccgcctcctgggttcacgccattctcctgcctcagcctcccgagtagctgggactacaggcacccgccaccgcgcccggctaattttttgtatttttagtagagacagggtttcaccgtgttagccaggatggtctccatctctcaacctcgtgatccgcccacctcggcctcccaaagtgctgggattacaggcatgagccacggctcccggccacaagcacactgttttaatttagattgtaggtttgggtgggtgggttggtgggagataaccaccacaacccctacctttagtgtttatctgtgactgtgatatatgcagtgcctcccacagacatggagctggggaaagaagggggcagtatggttcagttatatcatgaaggagatctgtttatatctaatcattaaatgaggatattaatttttaaatcaagctattctgcaactgttgacaagaaagtagaccatcaggcatgacttccagtgcaaatcactgagaatctctatttttttacattattttttacaattttttttttttacatattctttacaggttttaaaaggtcactaaagagaaagtaaactctattttcttatatgaagttggagtttaagatctgatgccaaacaataatcagcagaatgaaaagaggagtcacacactttaggacacacgcaaaataccccaaggtccagaattcataggctttcatcctttagcactccttaactggttacacatgttccaatacttctaataagtttttctctttactgttcttatcctttaattttccttcactctagaacaacgttttccaacctgtgagtgcagaagttattgcatgggttcctttcatccgtctgagcaccaagctctgtctacatatggaaccaataatacattttacacaataaaacctcttggaatatcagctgttttgttagaaagtgagctctttgaggaatttctcatgcacatatcaattgtgatgatacaaagctgtgccgctcaatacagtaaccactagctacatgtagctttttacatttaaattaattaaaattaaaaaccaagtttgccaatggcactagccacttctcaagtgttcaatagctacaggtggctatcggctgccataccatacaaaagaaatatagagaataactgcaggaaatctcctgatctaacttgtcattattgactactaaactgtgcaacaataatttccaattgaacttgaaaataaattgttatttctacagcaaatcattggagcagaggcatttatatgtctacagtcaaaatgaggcaaggcctccctcacaggtaaccctgtggaggacaggctaattgaacagttttacctggaggcctagaattttattttatggaactgggttatgtaacatatattgtgatcagtaattgaacttgtacaaatgcaggtaacaatgaagtaaaatcgtgagtttttattttacttaaaactccaacttaaatgttgttcttaacaaaaataatgcaaaatggaatgcttgaagcattcaagagtacttttaaaatctaatcatagtttcattaatcaaagtagaatctactaattttaaaagcaagtgctccttcatttaaatgcaattaatttattacacatagaaataataatataattattaatttgttcattgttcttccttgctatagtctttagacagaattcaaggctttaagccttgattatatattatagaaatttatatttcaggatgtaatagattgaaaagcaaacttcatttaatcatcctttcaccttcttacccaataaacctgacttggtctgctgaacacacaaaccatcaagcccaaaagcgtctcatttattttaggccagagtcactatcttcttaaaagggcaactgagatgcccaaattgcttcatcatttggttggtgagagaactaaattaaccaacatttcagggttttaggaaaaaaatttaaaaccccagaagcttgcagcaaatttagctgtgtcaatatctttgcatgattcttttaaatttgcttttcatttcaagctggagcagtctggaaaaagaaattagctctcagtaatgttttgaatacctgcccaaatgtcacaacttttattaataatgcttaagactcatgaagtgctttttagtttgcagggtgcttctaatacattatgttacttgatcctcgagacaagcctaggaggagctaggactcaaatccctgctgtctgaatctgaatccattacccctttcaaaaagcagcatttacatcctcataaatatatgctttattagaaacagaaacagggaattaagtaaaagtttgtgaaataaatgttggtagggatagattagaagatgttgctttgatgccaactgacccaaaagaaaaatatatatatttgtcttgaaactttggcttcccctagtaaaatgacttagtctccacccaattaccctaaagcgaagccactagtcattaagctcaagccacttatatagagattttacatctttttagtgctccagtcataaataaaaacagtgccaggtgtggtgactcatgcccgtaatcccagcattttgagagggcaaggtgggaggattgcttgagttcaagatcagtctgggcaatatagtgagaccacatttctttaataaataaataaataagaacagactcagaaaaaaaaatcttagatgtgaaaaacatgaaggcaggaaaaaaaacagaaggtaagataaagttgtgaaaatttccctgaaactagaataaacagagattgaaaataaagcaaaaaagataagaaacatgaagtgtccatccaggcattccaatatccagctaataaagatgtctcagctcaagtgcagggaaactaagaggaagattttatcaaagaaatacaacattatgattctccagaacaggaggacaggagtggccacagtagaagagctcaccaagtgtccagcactgtgaaccaaaaacttcacaccaagattatcacagtaaaatatcagaaaacttaccaaaaggggatcctaaatgctttctgagcaggacagagccaaaggaacaagaataaggatgacataggatttctcattagtaatccaaaaattagaagacaatgaaacaatactttcgaaattatagaaattattttcaacctagaactctatatccagccaaaccaccatcaagtgtgagagcagcaccaaggcacttttaggcatgcaagatctcaaaaattaatctaccatttacctttactcaagaaactttgtaaatagaacttctcttccacaacaaggggataagccaagagagaaagagacatggagtcaagaaaacaagagattccgcacaggaaagagcaaaggggatttctatgataatagggaagggaagtcccaagacaacagctatgcaggccttgagaacagaatgagaaggaggctgagagctccaggagaaagatcttcaaggaagcgaaagaatggagttctcagatttcatgatgcatttgaccagaggaattttatagttctgttggaaagatctggaatgtaatcataacaggtacatatatgcaaatcaagaaattaaaatagggcaattataactccaaaaaaaccaaaaacttgtataagaaagaaagagcagccatagtacatcacattgctgaactgggaacagcagttacattgtcataataatattaaatagtaacttagctaagaattgtgatattaaaatgttgataggatgaaaggaggggaagagggcatgtaagtgggcaatatcattatcgttcaggataggaagttaattgataatgtctaaaattgaaaaatcaagaaatataactataagcataatccttaaaaataagcattcttggctggacgcaagtggctcatgcctgcaacccccgcactttgagaggctaaggtgggaggatcacttgaggccaggagttcaagaccaacctgtgcaacatagcgagaccccacctctacaaaaaaattttaaaaagtcaagtgcaatggcacacacctgtagtcctcacacacctgtagctactcaggaggctgaagccagaggattggttgagcctgggagtttgaagctgctgtgagctataattgtaccactgcactccagcctgggtgatagagtatgaccctgtctcaaaaataataataataataaataaggattcttaaaaatagaagcaacaactataagaattgaaggggttgcctctgaggaacagaaagtagtgtgaagaaagatgtggaaagggattgctggttcatagcctaaaactttcaggactttcacattttaaactctgtaccttgaaaaaataagctctgtgttcattattcctttggatggtcagctgaaaccttctaaaccatttccagtaaggatcaaacatgccataatggtaatacttgcaagacaaacaaaatactcccaaaaaaactgaattatactggccttgtacttattgagcaaagtccaaatctctttgactgcctagagcaccagcatcacctgataaatggcaaagttggctctcattttgcttcttgttgatttgtcctttgaattgtatacaccatgtaaattaaccataggaaatccctctaagtgttatttttctcttgccaactactgtgtgattttggctttaaatataggaacatcagctactggatcacagggatgtgggttcaaagttcagctactagaaacaatttgctaagagagacctaagaacaaaataaagttattagagtgtaacgggcatagagttccactttccaccttcatttttactgttaactaatatcagccatgtgacagatgccacctgcaccttccatacctctcatttaaaaggcatttttgggagatgagtaatgaagggaacaagagcttagctgttgggatcaatttgagagaaaaatagcaagacatcaggtctcattgtaaagaaaatctttaattttctcagagtggcctcttttgcccccagttctttataacattcacaggcaatgccttggtcccattcttttgttgttctgttgttttggattttttcactggtatctaataatgtgcagacctgccatatgcttctagttctacaggagtcttgctttcaatgtatcaaaaatcatatatgtgtgacatcttctatggaaattgtttaattaaggcagccgtctgtgtcatcacaacattagaggatctctgggcatcactactacagaagaagctgcaatcctaaatccatgtgttttccttaattattctaaatcactctataaattgtgcaggtataatatttgcaaagattaacatttcaagatgatgcaacaatagttgcattatataagatgtcaagatacttagcacaaatttccacagatttgtagattaaatcagcatgagccatgtaatgaaggcaaggaactttggttcaatcatttaaaccttcctcaaaaatataaaaagtccctcagtttctaccactatatttttctagtttttttatgtcactttctgaaatttcattgaagtacaatgtgcatgcagaaaagagcacatatcttaggagaactgagcacacctgcataaccagcactcagataaacagagcaggacctcctgtgtaccccttcgcaatcactatcccataaggataaccactgtgctaccttctaacagcgtagaatagttttccctggtttttgtacgttatggaaatgtactccttggtgtcttctttttctcactcaacgttattcacatgaagttcatccatgttgttgtgtgtagctatatgtactattgccatatagtattgtactatgtaaatggtgtcacaaattttctgtttattctactgtttctgggtattttggaatttccagctttagtttattagaaaccaacatatagtacatatcttttaatgaacatatataagcatatattttgaaaatatacctaggagtgtgtagttgtatcataggatacttaaatgttcagctttcatagaaacttccagttttcccaagtagttgtgtgaatttttaacttttatttagcatacatttattcaatgatattctcaggaaaaggaatattgttagatcacattttcttcattatggatttcacaatcatgactgatgtgttatgtactagggatgtggcccatttaaatgaattggtctgccaggcatggtggctcatgcctgtaatcccagcactttgggaggccgaggtggcagatcacctgaggtgaggagttcaagatcagcctggccaacatagtgaaaccctgtctctactaaaaatacaaaaattagctggatgtggtggtgcgtgcctgtagtcccagctactcaggaggctgaggcacgagcatcgcttgaacccagaaggcagaggtggcagacagccaagattgtgccactgcactccagcctgggggacagagggagaccctgtctcaaataaataaataataaataaataggtttgtcacataaaataaaatgttttgattaatctactataataaaaaagttttctctgaggggactggagtaaatacctggccattagagatgtttgcagactcattaaaaagaaagaaatttaccaaaatctatatgggaaagtaaggtcgggcaatctctcaaatgagcagttcagatggaagcttttccaataacagtcttcaagcagtcagcaagtctccgtggagggattctatgactgacagccaggcaatctgagatattgtctcaactccaccaactttgtataaacctcttcatttatctgagccctttttttctcacctacaaaacaggaatcttaattcacactttgatggtgaggatcacataaaaatactttgtcttatgtatgccaggtgtaattatatgaaatggagagagttgatgttttacatcaaagagctataaacatattcttagatcatggcataaatccgtaggtgttttgcagctatacacctagagagtacattttccccatcctgttttagttctgcttcttgatatcactatcttcatttttagcattagaagtattacatagttcaaggatttcattaattcaatcactagcataccctggtgttcattagttaactagttagcttactagttgcataatggattttcattagtcctttgcttctcccttatcaaatattgattaaagatcaatctctagaatgtatgctcatgctcaagtcgctcacctaactactatcttggatattagcatttaaccagtcaatcattactttttgttttggataatatagtatctttcccttaccaattcaaaaattacattatattgcactttttgggccttttgcttcttggtatgttgttttgaaaagaagctctggccaggcacagtggttcatacctgtaatcccagcactttgggaggccaaggcaggcggatcacttgaggtcaggaatttgagaccagcctggccagcatggtgaaactccatctctactaaaagtacaaaaaaaaaaaaaatagccaggcatggtggtgggcacctgtagtcccagctactctagaggctgaggcacaagaatcacttgaacccagaaggcagagattgcaatgagctgagatcgcaccactgcactccagcctgggcaacagagtgagagtccatctcaaaataaataaataataaaataaaataaaataaaagaagttctgatgtggtgcaatatgtttaacagccagctgaaaatgccaaagtagccttcttcctcctttgggtatttatcagggctaagtataagaggcaaaagattcttcatgtgtagtaacttaatcatttctctttttattttattctaaatcctgctctcttttttctttttcatgtccccatctatgccacatgcagtgtgtttggcgtagttacgcagctgatgagaaatctgtttccattgcaacctggaagccacacttgaaggccttgcacacctgcagccctaccaagtaggtatcagtgtgacagctgccactgtagttgagtcttttcaagtctgttaaacaaaccatacccacacacacaaaaaaaggtgttaatgtttggcttctcttattctctgttgctcctaaagagattcaaacctatttagtagcagttctggcacaaaactaaatggaatcagtatcattcctcacaatccacagactggggttaaagattaaaataatgtaaattttatagagatttatttttactatttcatgcttactttctaatgtctcatttcgtaaagcccaccagcatcctaaaggtaagcaccacagttcttgaaaaacaaggattatttattttgcacccatcgcctgaccccaagagatgagtgcttagagagtaatccatctttgtacgtttagatctctcaaagccatttctcatctggatcctctctggatggtcctcaagcttttacttgcagatcaaactcacatcagtggcaaaaaaagagaaaaataggagtcctaataggattatagtttacaatgaggcaatgggacccagcggattaaaatttggaatttgcattcacaattttaaagtaagactacttttcttcacatttcattggccaaagtaaatcactcagccatgcctaaactcaaagaaaatggggaagtacaattttaccttttaccatgtgcctagaagcaggcaagaaccaaggacattatggacagtcctaatgattaccacagagatctgtaattaaaaaaaaaaaaaagggcttagtcttggagtcttggaaacctggactccagttcaactatcacagaaaatgttaaatcatattcaccacctaattaaagaagtcctcattgaaataccgaagcagtaagtcatgagaaaggctttctgtgagtcacccagcttgattagcgtagtcagttcctcaggttgttcaaaagttattaaattgctcatccgacatttgagagcaccagctgcttttcttcatagcccaacaaaaccttaatcctagtggcttcatgggattcaggacacctaactactgtgactcacaaaaaaccacctgttcttactgatcttgggagatatcagctgaggaaacctccatgacattccctggcagtaccgtcttaatggaggtttgtgatgcagcagaatgcataccattgggaagcaccagatccatcattaactacattacttccctgttctgcccttggcctcagttttcccacccacaaagagaaggacaagagttgggcaagatgattcctaagctctaatgggaaatgcctcctggtgggtggtatctaaaattcttgtcagcacctaggacagagatattcatagcactccagggatttcagagaggatggaaccttagcatggatagaagcatggatgctgttgaatgcatgtttggattaaaatcctcttttcatttagatcttgaagtttagttgaactttttatggagtttaagaccctttcaacattttgatattaaaaaaccgaaaatagaacctaactcctgtgccatttattccttgggagtatgaaccaaaaataaaaattatatagaaattgtatttcttgtcttcatgaagtttgctaggtaaatgtaaaaagggaatctgagtaggaaaactgatagagaattctcaagtgacagaggagagtggtctattatcatatgtgattatttggcttcccacttactgcagtttttggattaaaagtcattaaaagcctggaaaaactgtttaataatgagtcaaattcccccagtaaatcaactattattttattcacataagttctttctactcctctgatattttccctgtcttaagtgggggtggaggtggaggaggatttatgcaaacacctgtgttcctcatgtcctactgtgcctttccctcactttccttttcctgcaaactcatgaaccatggggctcagctccattgaatgaagaacagttatttgtccagaatgacacagcagtcactggtaaagttcatgggaaactagatgtcctaacatctctccccttccagtgatgcttcattgcttcaaaatgcagaggttcttaatccttgttgatgttttttgttaaaccattgagaatgtgatggaaattatggggtctttcccaagaaagataatcaatgcacgagaaaatcaatactttgcctacaattttaatgtattcacagagtccctgaagccaagttcaaacttttgttttacaaagcaaacttgctttaatcaagtgacaataattttcagtgacttagagggatctttttacatttaagtggcttaccgaatggagagtgttgtagtaagaaacagactacaattactattttatttacattgtgtattttcctttagcattcagcctaagaacttctgatgggaaagatcatttattcagtcatgtatgcattcaacaattactcattgagcacctatgatgtgcaaggcatagttctaggcactgagaatgaagcagttggagtaaaaaaaaaaaaaaagttagaatctctggccttgggaagtatgtattcaagggatgttgggatagacaatataaataaataaatataggatatgttagatggcattaagtgctaaggagaaaagtaaaataaagaaggaatttagggagcatcagaggctataatttcaaataggtggccagggggaagatcaatttatcaacaatatcatcatcatcatcatcaatgttactgttatcattaaaaaacaccagccccatgctcttgttccccagttttaaagacatagtgggatgctttgattccactaaacaggatgaaagagaggtctaagaaacagctgtgcagggcagagagaaatgggaggagggacactcaaacctgccagggatacaaccagcagttccttactctctcttttcaggtctggtttgtctcttacatacactctagaggtcttagcaattctatttcaaagttttattttaataacagaaggatgtatagaagcaagtacttttcttgattttctcctcaaagagagtgaagctgcaaagggcaaaacacaggtaaatatgctatttagggaatgagtcagaaattttatgaggctatggggaattatcaagctccaaaaacaccttgtggtaccttaagaagtggggatttggagattatctaacctaaagcctttgatttactcataagaaaaccaaaacctgcaagcaaataaggtgcctgcccaaaggcacacagctcgtttgcaaagagtacagaccctacaccatggtgcttagacctacatttgctaaaatgagttattacaaatgccacccaacagtataggctaaaagagttttggtaaatattctatgtaccttatttactccaaggaaatttagattttatacgatacaaaaaaaaatctgcctcagcaagtgactgagatacaattcattaatgaatccaggtttagaaaccaaagtctgccagatgcacagagaacagttatgttgtaactagcaacattctaagagcccttgctaattctggttagatcagaaccactttttcttagccatggatagctttggctaatgaaaagtctattgttttttattctatgtgggcagtcttggctttgccaagtaaatgttgtgctatctctggtctgtatcacaaagaatatatgttagcaagttgagtacatttattataaagaacactgcttttgtggatcttgcatgaaaagagttacttaaggtatttgattccccaatctccaatttggccattatcaagtgctataaatatattcactggtttatcatcatttctcttctgcctgcacgcacctgaaggaaagaacaaggggaagcatcaagcaggtttgtgatttctctcttgctacatgtttgtttataaatctgatacctaccaggtgttttaaatgtgtctcatgtgagtaaaatcgatcaacaaatacaagatgattaaaagtgacctttcacaagattgcctgcaaagattgctattttattgatatttcgccccttagtatcaaagtgtctttccctaactcactccctgctttttcaaaatctgcagggcatggaacatttggaggtgggggaggaggggaactgatcttggattagtccttgctgttgttttcccagacagaagtcttatcaaagtattcaaatatggtaatctagagaatgaaagaaagaaattttttttctgaatgtaaaaagtccaggcagcagtctaggatacactccccttcactagggtccttcttttggagtgatatatatatatatatatatatatatatatatatatatatatatacacacacacacatatatatatcatatacatatacacatacatacattatatgtataggtatatatacctatacatataatctttttttttggcaagatgaaaccacctctctgtgacatctccagatctccagcccactgagtgctgaggtctactcaagtgactcaaagagccccatccccatcttttaggaagaagacaaccctcccaaaaattccccaaataatttattatcagtttcccatgacttagatggaatgagtcgtcagattacagcagagaattaaacctagagggaatacgaggtgaaagaaaaatttcttgatctgtgttaatgagtaccaggaagtgcctagatttgagagcaaagccctgaaaaacagagccaggtggaacccagtattaatgatgtgaagagtggcagaggcagaaccagcaaggagaatcccaggtgcctggaaaggaagaagagatacattttttttcctatcattgtcactgtgtttccataaagaaatgaaggcatccacctacccagagttggtccctaagtggaggccagtgtgggcccagggattgttcttttagcttagtactattataataattatattaataataatatatttatgcaatactgaagccagttttgaaagttcacttggtgtattaaggctctggattatccatttttgcattatgtttatatgtaaagataaacaaatgaaaacataaatgcattcgtctatgatgggagataggcacgataggatatacaacatcaggcacatcttctgcgtaggtaacctacccaagggatggcattaaagttctttctcttatttggtagctctaactaccaaataagccaagggctttggatattccttggagatatttccagaaaaaagtcattcttccccacctaagaaacgtttttgaccaaagagaggttctagtcattagattcggaatagtctttgcctagacactggaagagacaagctgaccaattctagacttttagtccattttctagattccatacagagctcaccatccttctgttgtgacaattttacttgaaaaaagttacacaaaataaatcatagccattttaaggtagcttatagttgctttggtgatattttaaaagctttcattgtctcaggagctttccatttactaattatctcaaagggtgatctgcctccaaatccaaaggacagagaccatctttggcacaaattccagagctacctgagagtgcgatcacccatcttagattcatcctccaaaacggagctgttaacacctaaaagagaagtttgtaaatgacatggaggtgcttgaataagtgtaaactctatggcaatcctgaaggaggggtcaccttgggctggcacaatgatattgtactgtttttaaatgttagcacagcagaaaacaaagacaaaattaaagtgtcactgttgagcttctgctcactagtccaaaaacaagcttcctattcagttatcactattcaaaaaaactaccaaccaaattttccacatttatgatgttcgcatatatctacgacatttacctctctgcatgcagcagactgaggttgtcaaagataactcacccataggtttaaatatgtacaaaaccactgaagtgggttgatgacttagagaatcacacatggaaatttcttgcttctctgtggtcattgaacatttggcaaaaaccaccttgaaataagtcctgcactattacttagcctagattcattatttaatatcttatatttcatacacttaggtgtcctatcttccaactagctgtcacatcaccctgggtaaagctattacagaatgtgctcaataaataattcttggatagagtaataaaatggccctgacctcaagtagtttgtgggaagagataaaacaccaacaaaaaatgggaagagaggagaaatataaaaagagaaataaaaaattaaaaacattgcaataatctaaggaaagtaagctgaagctcccatttaatattatgtaagctttcaccttgttgtgctccatacacagaatttataatcctgcataatgaatgcagaaaggctattgtaataacaatagcaacagtaccatcttagaaagtaacaaagttgtccttacccaagcaaaatatcacaaagtaaaatgcatttataatgagagttcttccttacagaagagtagatctgggtccagagtattgttaattaatgcttgaccccatttcaaaggaactaattaacaccacccaactgcagagtaatttactgcctttgggaccactgagttattgatggtgagtcagaaaggcagaggagacaagcttcagcccaagcaggagccaacattttcaccttttagcccagagcttggaatctcctaagtccttcttcatggtttttctttgtgttacaaactgagagaaacccaagtgtagatgaactcaacacagcagccaacatccgcctctgggtgcctggcactctcaccaaaggacggagccatgactgtagagtgggtcatacacagagaggcttttctttctgcaacattgattaagatgtcgaacacatttatagaacccttagttaactacattcccggctttggaatgttcttgttaaaaagggattttgtctttctacactgaggctagggtatgtttaaacaaaatttgcctacgatgtcttgggctaaggaaaaatgtcacattatttatgacagatccaaaacttttctttaaaaatacaatggccaagtgcagtgcctcatgcctataatcccagcactttgggaggccaaagagagtggatcacctgaggtcaggagttcgagaccagcctggccaacatattgtgaaaccccctctattttaaaaatacaaaaattagttgggcgtggtgctgcatgcctgtagtcccagctacctgggaagctgaggcaggagaatcacttgaacctgggaagcagaggttgcagtgagctgagatcacaccactgcactccagcctggatgacagagcaagactccatctcaaaaaataaaaaataaaataaaatacaagccattaatctgaagaagagctttttaaatatagctcaactgagcaatagtgaaaatactgtttcatcagttctttttggtacattcaggtacaaattactgttagtctcaactgagcctgctgttttttcctctactccaatcataaaatacttctttagcatcatttaatcactcatttcttttcctctgaattcccactaaaacagtactaatctcatatatgtggtggtaaatgtgtttattgatttcattctattaaaaaattagttggaaaagtcatttttaaaatgggacaagtttttttctgttttgatataaattgtcattttcagagaactgaatttacctgtgaatccatctgtccagaataagccaatattctcaccttgaggttttatgtggttctcccttcctccttgaccagattatcaaatagtagtcagtcatcacattgatacaagaaggcttttccttctatctacctaagttttattgctacaaaaacagattatattatctgaggttttgagattatctatacatcttgctgcctctagttactctgtcttcttaatcaacaatggttggctatatgcctgcttgatacttaagcttccttaatggcaattttaaaagctttgctagaaccctttcagatttctgagtagactaaagttgctttaccaggtacctgtgagactgttgtaaagatgcatgtcttaaacgttaaggcaaaaatgatatttttatattacattacactcttgtgctgtgagccaccgagtgctttttctgaaccactcctgtgtggttggcttttgggggaagggggagttctgaagctgtgtgtggctcttggagagaactctagaaccctggtggaagactgtgtgctcttatattttttctgcatttattttctgttatttcaattttctttcttctgtgtgcaatgaatgatctgcatgtgttgttaaactaaactcaataagactagattttggtttttttccaacatagtcaacttgtgtccttattggcaaaatgttccattgtttcaaaaacaatctttccaaaatggtctctccttctgttcacatttattgatagaggaaacggatttagtcttctaacaacacatcataggacttaaaataagaaacgtacttttctttcgtttcttacaaaccagcaatctagaatcttttcttctgttttgttgaacatatattctgacaattggttacctatatcaactataaatgcagatgtttcacacaaaccaagaacttacgttttcaaatttcaacaattaatgtcatgaatttattgatttctgtagttattctttgaagttctaaagtacgttattaatcatttatactatgtgttattgatatttattacaggggtagctatattctaaagtatttattcttacatgctaacacagagactatcatcatttgtatgtaatgcctagttcaaatccaatttttcaacctagccgttaagatcactggatatctttcaagcagcacaattaaacaacatagtactctctgcttaaatagtctgtgtacttctatattaaaaacaataaagccaaatggctttgtttttataaaagaatccctgagcactttcctattcgtgaaatgcttagtaatgtgctgctctatttccctcactcctagtaagttctgtagtaataagcagaagctcttcagaatgtacacctcacggaagcagaggtacccagcatccgggctattgacatgagatttgagaatgccaactaacctcaggtgcatgaccaggttacaccgccaccccacctgagccctgttcagagactcactctttctagggacttcttgaatgaggttttcaacccgcttgaaattttccttgttgcctgttgcctgctttgatactctccaccgctgggacaaatagtcggcgtcccgcgtagaactggcagtcagccctttggcgcctccttgtggttggacaactgctgagctgctgcacgcactggattgttatggctcagttgccatattgtgcctgaggcgagaatttgtagaatgcttatcccatgaagggctaaaaccctaattaagtataacaataactacagcattctaagtcccagaggattactgtggggttatgatgatgccacacagttgcctggcagagaacagccggtagtagactgcatgctaggccatttgaataacctgtacatctggttcctagagatgagagaattctctcttgcagggtgacagtgcaggctctgctgagcatggtcctcagctgtaactgtgggactgtaccctaagagagatgctccgatcaatgaccacagcaattttttttttactttctgcaaagcaagacctccttgttggtctcttggggataatccttggcattcttcctaaaaatactgttacataaatcttcaaaaatcatattcgtagatgtcaccaaaaaaaaggcaggaaaataatgaagacttcagtgtttcagtgaagagtctatatttttaatcaattcaatgtgtgttttcagtaacagtcacctgatcagcttaatagtcatctaatcaagacgctgtgttgattttcaaagggaaacaaagtagaaaaataataaagtgagctttttgtaagaggacacaagaacagatctttgccttggaaaagaaaattttgcctggttaaaaagttcttgattagaatcttattcttaactttcatataattatgtcaaaagagaaagtgaaaacattacattttttctaatttaacatgtaatatgccgagtttattttaaaataattcttgggaatctttaaaataatagacattagcaaatatccatgtagttgagaaggacaaaagggaaatgttacttagaatttatttttgtcaactttaagtgctttaaatgatactaagatttagagaatattattcacattttccaatttattcataaggtaatgtcaaaatggttcatagaggcaatttttaaaaatatttttataggtatgatttttaaaatacttttattataaacaaactatggtggattgaatgctaatactttcattttggatgtttttacttttttagtaattgaatttttttaatttttcatattaagtgtttttatgatggtttatccatttcttatgtatttagttgacatagaaaagagatatatcttgaaagttggagaaaataatttgatattaactaaaaccaaccttttatagtaattagcatctgttagttccagaaaaggtaatagataaaatcaaatatagtgaggaccaattgtaatgatatctatgtcaacttgagctattcattaatctgaataaaggtgcagaagtgagcatatgcttcctgaactagatcattgtaaatttaaattatggaacagatgtgttgaaactaaaaagagatttgaaacttttacaatttaaaaaaaaaaaaagcttgagaaaagtagatatttttgggcaccatccctttgacagatttgtttaaataattgaaggctttgggatgacatggaaaacctagcctgagaattaaaagatgcaggtttatgatgttattgttgctcttgtttaatgtaatctatcatttaatcacacatgtgtcaagcacagataaactcttccactgttgggattgttgtaaagaactcttgaacccacctgacctcatcaccaaactgccccgcctgttctttgcatgtgccttcagcgagtcatgctggacttagctgtgtctgcatttcagaggggagctgtcagttgcatggtcaacttgtttattgtttccagaactccctgaccaccagttcatgatttgatttgttttcatgtaaacacacataaaacgtggtgcccttttagaatatcgtttgttaagcaactaggcatggaaaaataaatgttactgtttcttgttagctacaaagcacatatccactaaacacatttgctgttggcatgctgcagttggggacagtggacattgcggtaagtggacaaaacaaggcctccacttcgtctcaaataagccttatccatgagaacgctgctttcataccccacaaaggctgcggctttactctctcagagtagctgctctgagagacttccctcagactcattgcccaggatttcttcaggccctgcagagtcctgggcctctcacattgatgacagtatcaccttctaatgaatggcataatttcactataaaggaaacaagaaaaaaaaacagaatgggtacacaaagcttcttacagttcatttgattcccacaagaatcccttagctgtgttgctatgtttatctccaagttagagatgagaaccctagcccccgtgtgtctgatcccaacctgcccttcctagcacatcatagcatatctcttgattaggaaagtgtgaagatgcactttggattttatgattgttgttaatgcttcttttatcagcccacaacaatttgatcttagccggcatcagagaactgaatgcctgaacaaatataatttaccagtagctgccacagcaaatcaataacctgtttactagcaggaaattgtgttagtgaacataacatctcattctcttcatcagtcatcacattcattatctgttggggctgttctatcttgtgtggttttcatctcacaagaatgaatgtaagcataaaagaaatctaatgttaagtgttgtgtgtttaatattatgtatgtggtgctaccaactgctatgagattgcatgaatttatggataacataatcttgcctggaatataaaatgcatgccaaatgtaggtatatatgtaactgtcatccctgtttacctgtagaaatgtctagaaattacaaagagatatgctcccaaacaaaaaataattttttaaatctcaaaagttgaggttaaagctaaaattacccaactgtttttcaagtgaattccaaaacagttcttagttatctacagtgtaattgtgtacaaaatgctgtatgacctcagtcttttctacaatgaatccaagaaggatgtatgtacctgtagaatgagattgatctcgaatgcaaatatagagattagataaagctcaaattttaaataagggaaaaataattgctatgctcctacgtgctgaaaacatcttgtctattgaaatatatgaccacatgagcttcatcaaattacttacccaagcaaagtggaagaaattgcttgaaatggaataatcatgcctctgttctccacagtcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatggtaagccctgtttttccataaccatttttaattggataggctatagtgagtgagattatgaagtaattaattctccatagtgccacttgaagaaagaagaaaacaaccccagagaaagaattgtttgtttgttttattggaagtttattcattgccttgggcaaatgtacagaacataagtttacttttggaaaccactttggcagctaaatttacattccaaagaagctgacaaaatgttgttaattcttcacttgtatctacaaatttatttctcagacaagggccacattaagatcaatgggactgtcattctgatgtatttgtgacgtctgaccagcaaaggtccaagacccagggacaaccaggtgcttgctctgtgaatatcttgaaacacagtaaggaggatgatcatttctggtcaacaatgaaggtgctctttccctctctcacacactccatctaccagcaaatcagagaccactgcttatcttccttagagaggttcctgttgaaagttatttcgaagtcttccaatgataagtaaaattcaagttcttctcccaagaggaattaacctattttatttatcatattatgtagcagacattcacttgccaacacattttattgagtgccacataattttcatgtttataaaataaaatattttatttttcatttaagataagcttggctttccttttaactaggccccctgggatctcttatactgggcaaggaaccaaaatcaaatagcatttcccattaatgcataaaaactacaaaggctatcagtccttctgttcccttttcctaaataacgtgtattttcccaggccctcaaagctcgaggaataaaattaacaaccaggggtcataatcacaatgatctgaggatccctgcagtgaagtccctggaaccgcagtccacgggtccctctcagcttactcaaaggtcctcagggatatctcttccacgctcaagtgagcaacacaagtcacctcttcacgcctcactccacacccctgtgggtgccatgctcttcagggcgacccctagtggctgcactgacgtggctcctcctggcggagcttgcaggtcccatatgggcgcaagacggctgatcctgccatgcttccccgcagcctgtcctgtgctaaggaaggaaaaacctccgccaccaacacgggacactcctccatcgagccacttgcaggatctgagtcacttgtggcacagcttttcagtgtcctctagtttcctcactctcctcctaggattttggctgaaagcccttgagcagctgagtcaagagttaccagtgacagggctttatgttgcactcaaaataggcttgctgaatataaatgggtacatcctttctggagggcaatttggcaaaatatattaaaagtctttacatatgtctaagcctagacacatcccacctaccaattctatttctaggatataatagatacaatgaaacaatgtcaggcattagaaatgatgctctaaattaaaaattattgacacagaaagatgataacaaaaaaatcattccatttatatatattatataaattcatgtatctataggaacaagtctggaaagatttacaagaatgtgtgaacagttacctttgagtggtgagatcacagttatattttgtttcttcattttttaatctgtatttcctaatatttctacaatgaacaggtaaagctcttgtaataagaaggcaataaaggattttcttttttaaaaaaaaaaaagccctcagtttagaaaaacaaaatgttagggggaaaaaaagaaaaaaaaaactagcccttcaagaaaaaaaattagcccttcctttcacacactgccctctcccctgcccctactctaggggcccttgccctgactgttactcacctaacacctttccttaagctgatttcctcccaagtggtagaaggagcagcttgtcttaatggtgggaaccagtctttgttgagtgcagacatagactatgtaatgatgtttaatagcttctactacaaatggaacttgtattagtttgctcaagctgctataacaaagtactagatgccttaaacaacaaaaatttattttctcacagtctagaggctagaaggccaagtttaaggtgtcagcagggttggttccttctgaaggctttcttcttggctttagatggtcttctccctgagtctttacatagacttttctctgtacccagccatgtgcaaatttcctctacttataaggataccaatcatattggattaggagccactctaataacctcattttaatttaataacatctctaaagaccctatctccaaacagtcgcattcggaggtactaggggttaggaccataacatatgaattttggagggatgcaattcagcccatagacaaagctcatgctcacccacatcacagcatccctggaaagctgagatgtgtccatatcttcatccccggccctggtttcacactgcattagaaatcatacattacatattgcaatggatccatattcttctaacatgtgcttcaaaaagcattcaactttgtagtgtaaggtccttactgttggctgagcatatttaaataaaaaattcatagaatctggatttttaatttggaaaacaaattctacttgtactgtttggccagaggaaaagaatttttcacagtatctagagtcaccactatctatcacaatattttcagtatctgcaaagatgtctcagaggtacagaaacagaagtcctattctctaccaaatcacaaattggagaggtctcctgtcatctattttctaggtcatttcatacgagtacagttttgtttgtttacaaaagaattgcttctcccttgttgatgcccattcaattaattctgagtttcccaagtgaccagaggaccaattgctgttctgttgaaattactttgttggctacccacctgcaagagatagtagctcctgcctcctcatttaatccaatagtccagaatctttacctctgattgaattcaatgttgcgtcttgggaaactggaagttctttttttacaagaaaaaaaattaagtagctgtcaaataaatgtagacttcagttatacatctttacttatagtacctctttaggttttaagtatttctaaaatcatctacttactaccatagaaaataatatataacacttatagccagttttcaattattccaggtctatttgcccattcacttctggggctgttttcttctcctctgctctcctcacatattttcagcattccattgcccattaacatgctcaggagaatagacaaataaaagaaagaataatggaaactcagatcaacctttaagttaataacaaaaagttatatttggaaaataatagacttgcaattgaaagatagtataatagagaaaaaaaaaatattcagggttaatctgtaaattttaataattcctgacaaatctgatactctttactacagacagtagtgttttcataatttaatgactctttaagaaggttattaaatatccatggcatttttctcttgctataatttttaataagattaatatgttacacttaaaaaggacgcagttgtctctcaatattccatacttgtgtgtaccagaaaagtagaaagtagcaggcagatgctgaagccacaaatgacaaacgaaagaaagtaaactctaaaggactgatgtggtgttatcataccaaatttattttgactgctatgatatgaatcatatttttaactgataaattctataataaaagatagaaatactctattcattgacagtatgtaaccctcttcacataattttagaaattaggtaatatagaaatatttttgtcaagtatatgagtaataataatgataaaacgaacatgtattgaattcttcccattggcatgtgttgttctaaattctttacctctattattttatttaattctgtcaatacccctatggagtagctgaggtattatccccattttatggatgaggaaactaagagttgaatctaagtaacttgcccaaggtctagcaggtataagtaaaggagccaccatgcacatgcaggcaattgaatttcacggtcctcctacaaacgtattctaagatgttctcctagatattatatcaatttccctttaagaatctttcatttcttcccctcccccaacccccaccaccctcttcttgccgctgctcttccaacttcaatcggtcagattccccttcccatataagccacttgaccatgaccatgccactatcccatctttctcccagcctcagctgccaaacctctcaactacatcatctcaaggcagccagagctagaagattaggcaaattggggaaatggcctttcaatgaccgttctctgttttgatcaagtatctgggaagagactcaggataacagccatactggtctgtgtctattttccctggagggaggccaatggtagggtcatctgaggcctgtttcaagatgcaaaagatagtgtcagaagatgcacaggtgttgccaacagacaagcaagtggaaggtggcagattgcaagcgagaaatggagcaagcagccaaaatccacaagaatgatactaaggtagagctaggagaaaatcttcggatttctggtgactagtttgctacgaaggagtcctacacttactgaaccccactgcatttgggagtgccttacagaattgcaatcaaagagtacaataacctggacagtgaaggagaaggacgtagctttagggagctccaccttacagtgcttgatattagctaaacccaacgttctgtagtaattagcatgttcgttccagaagtggcaatagatctgaaaatctgtctcacatacatgtataaccatgcatgttttaacaagtctaacattgtttctgcttaaggagaaattaccattcctgctgagcaatcctcagtgctcatgttagctgccatggaaggtacatcctcatcaggtgtttatgggaaaaactggcacagcctgggttcaggagatgtttagggttcaccagggtgggatctgggtgagatgaagatgcagaatatcttccgattgtgggggtccctcaaggctagtgcctttgttccaggcactgatggtaattcctctctcttcactacccttcatgttcctttctcctctcagccagtgtaccaattaggatgcatttagcagcaggtcacaaaagaagcagattcaactaccttaaactataatgcaatttataataccacatagaaagaggctcagagataagacagctctccacagagcctcagggctctggcttcatttctctgattctctgagtcttcttttgactttttccatctgtctgcctgcctcctcctcaggctggaagcaaaatggctacagcagttgcaatatcttctatagatgcaacactttcagaggcagaaagaggccatcttatgtttgtatctcttcttaaaagtgaggagaactgtccattcacatcttattttgcagaatcctcatgcctaaaacaatcaccagcatggaggatgggaccgccatcattggctgtcaccagtcaggacccagcagctggatctcggccagactcccctaaagcacatgatcaagtgtggggggaagtagctggataaatttaaggatttaggtttggggattgcatttggggaaagcaactttccatagtataatatttgatatagccaagaaacctcttccactttggggtgagggtaaggagtcagcatgtccttaaacatggtgctttctctcaaatattctgtctatatgtcatttctgttcctctaaatgtccgggcttttaaaaacataaaagccagatttataatttttttcacttttctctcatcacatcatttccatgaaacaacaagcatagactagactgtctccttgaatttcaaatgaaaggcaaagtgggtaaaggaacaactagcaaaaataaataaattagtatttcaatcatataatccttcctcacatacagtcagcccataaatgttctatcaccaccaccactaagggaaaactggtacagttcccttcctctccacctcctcagcagcttcctgacacctcgctcctcaagctgtttctcttggtgactccttcttccttctgaagttaataactaacccagtctcacctaaaaatagcaaaaaagtagaaatacaccatgtggggtgccagaaccctcaagtcttcttaaagatagttcatccccttcctctcttctcttaacttctacctaggttctaggcccaccagtctaccacaacccttgtttgaaaatatcaagatcactgaaaacagtgacaaaaaggcagcattttaatgcaatggttttgacaactatcctgaactaacagtctcttgtatccataatggcctattttcttccaagcagtataaatcacagactatcagtattttctatttgactaatttatgcacacgagctttcatcttacactaatcctcttttatgcttattttccaatggcatcttcctccctcatgtttttctcagtctccccagttgacatttttggtgtttccacaaaatgccaagcaccacgctgcacatagcatttttcctgactttccataatgatggcccaacttcagccaggccttgattataattttccacatgatgcttcctggcactttctgaaattgcctgataatgactctgcattgtgttgacagaaataattcttgttaaagcagtatcctattagggcttccacttaacctgtttgtgcagatttctggcctgggattctgactgagtagggcacccattcctgtcatcctctatttgtaacaaaatctgagggttttctttaatgttaagaacaaaaggatttattgagaatgactggatctaaactctagaaatttattcttcatatttaactctatattcagcgtaattgttggagtaattctatgcaaaaccctacaaagggtattcagtaggattctaaaacgcactttcagtacttccttaacttattggtaaaaaccattacctgaagaaattgtctcaattctgatccataggtgtcttttttctttagttgtccaggttctttattcagtccctcaggcatcttcattcaaagacatatcctactcctctgctgtgtttcatatgtactcttgtccccctaagatctgcttctcctattgggtggagagtgacctctcaatctctggtttcagaccccaagtgactacgttatttcttggatttctgagaagagttgtgtcttagtttgtttggactgctataaaaaacataccataaactaggcagcctataaacaacaaatatttacttctcacagttctggaagctggaagtccaagatcatggtgctggaagattctgtgtctggagagggcccacttccacgtgatggaaagggcgaggttcctcttgggtctctttatgagggcactaatcccatttattagggctctgccctcatagcctaaccatctcccagagcccccacctcttaatactatcactttgagggttagggatttaacatataaattctggggggacacaaacattcagaccataacaggttgcttcttccattactttttgtgaaatgcttgttcttagtttttagtgacggggaaatgcttttctattttgataagactgaagttccacctggctttctactctaatccaagtgctctttgtattatagaacaggatttctgtcagatttctctaggttctgtcccatggtttgttgttactctacagtgataaggaaaattatattctgtttctgttggtggataaaatagcttcctgcttgagctctgaatggatttcatctcctcccttccagcagaaactgagctgccaaatgaccttcgagtgctgccttaaccataccttttggcttctgtagatccaggtttcattgagaaacccagggttataaactggagccctatattttgtttcatcagcaaagtgtgtgtgcatgtccacattgatactttaaaatgaatctgaatgctgtattagttatctattgttacatagcaaattaccctcaatttagtggtttgaaataacacatacttataatctcacagtttctatggtcaggtatccagaagcagtttagctgaatggttatggctcaaaatctcatatgaggttgcagtcaagctcttggctggagatgctgggagaggacccattaccaagctcaactgagcatttgctagcaggccttttatttccttgccacattattcacaccctaggttgcctgaatgtccatatgacatgcagctggcttcccccagagagagctgagagagtacgcagagagaagctgcagtcttttatgacataagctcagaagtgttatgccatcgcttctttcatgtgtaagtggtcacaaagaccaaccctgtacagtgtaggcagggactatacaggggggtaataccaggagatgagggccactggggaccatgttagagtcaggctaccacaaatgccttcagatagattatgtcttttaaattgcagatttcaaccagtccctattgtctttccaggaacccaaaccaccaattccccattcctttcgacctctccgttacctacctgcctttaacgacatgggtttataacttctggtctaaccattttatgtccagtatcctttgtattatatctcaaaaaaaaaaaaaaatcctggcctcaacctatagctacgcaattatattccactcttagtgcagactctcaaaaggaatattaacaaaatattgagtatgtgattactgcagcaacaagttaaataaaatgaggaggccaggtgcgatggttcatgcctgtaatcccagcactttgggaggctgagggggatggatcacctgaggtcaggagttcgagaccagcctggtcaacatggtgaaaccctgtctctactaaaaatacaaaaattagccaggcgtggtggcgggcacctgtaatcccagctactcaggaggctgaggcaggagaatcacttgaatccaggaagaggaggttgcagtgagctgagattgcacccttgcactccagcctgggcgacaagagcaagactccatctcgaaaataaataaataaataaattgagggagcaggacatgaactagtcagttgcaaaaccaaagtgtcataacttctaacgcagctctctttcttgtacaatgtatggcccctcttcagcttttcaagaggttgaagatatgttcttggttgcttcaaagggcagaagcagaactaaaaggtgtgtgataccaatatttagttcaatataatggcagcttagcacttagagactccacagcaattgagtggattccataattggaagcattcaaatcaaagttggatgatcaacagtcaggaatttctggaagcttaaggagatcaaaccagaaaacctctaagaaattttcttccaaatctgagtttttataatctgctcttctggaccaatgcaaagtatcttccttagccattaactcgtatcctcactagcaattctatactaagaaatagaagaggaaagcaaggattggctgaggaatgccaggagtgagttttctgtccttaccctagtttcacgtctctttgataccgagaaaagtgctacccgctgcttcttgcctctcattcctcccactgtttcttttccactttcactgtcagccatagtcctttctgtcctaagaagtgtatcaggtgtgtcccacccaccattgtgaggtttatgtgtgtgctccatagcggctcattcttagaacttgaataagccctccactggatttcaattcatatcagaaggtatttgagggctgctactcagagctagcatgtttctgggcatttagaaggcagggaggaggcgtgacaactgtcaccccaaagaacttactgtttgtctgtaagttttaccaccccagcccacctcagttacagtattgattggcactgaggggaacaaaaggcaccttcctcattcttcagacttcatagttttcagaaataacctgtgggtgacgtccaaaattcgcacaaaataagcacaaaattaaccattacacaaatcacagaatttagcccatatttaagagaagcacttttcagctgcatggtgatttttccttcatatatctcaaattatttccttcaaagtcacacttagttgtctgctgcataaacagaaaccaatatgacacaattttaaaattatatttaatcgctttcatggtgtgctctacttggtaaagaaggggggaaacaaggttaagtaaaggccaggatcctttttctgcaatggatgactgacatgggaaagagatgagttacccaggctttgctttttgctacctgcagtataaaactccctgacattgtcccaaattgcttttacaggtattttattttcaacatctaatttgttcggcttttcttcccttgccatctttttcttcttttgccatgtataatgcataacaacaatttctgaactccaaaagcatagaaacctcagaataacattacctgggaaaaattaatctctctacctccagctaccaagagaatcatttgcacatgaaaccctgagatttgcgtctttcattaatctaatgcagtagcaattgttataccacatcgttctattggaattgatgactaatcattcccaaaactcttttgaaactattgttcccataattttgtgttttgattgaaaaatgtcatgaccctatatctcttcatgttatctgttgcatagctaaccctctccctcagatttagtggcttaaaacagcaaccatttgtttagcccacaattctgttaggcagttcttctggtcttaagtgaactgactcatgctctgtgttcagctgctgtgttggctggtgctgactggactaaggtggtctcagttagaattactgctctttgctcatgtggtctctcatcctccagcaggctgggctggttcacatggtggtggtgggttcccaagagcagtacattgatatctgaaggcctcttgaagttcaggctcaacctatcacagtataatgtccactatgtcctgttggtcaaagcaaatggcaaggacagcccacatgcaagagacagagaaagagattccacctcttcatgtgagaagctgcaagtgtcgtggccagtattgcaatctaccatcccagccatttaaagcttatttgcttttagtattttcaacatcctgttggttctatgaagacagtgtcagtgtctaattgacttttttatttctccctgtagtatccttcactcaaagagcctaagaaagaaaaggaaaatagcattgttagcacctcatgtatcgaggcattggctagacattttctatgaattggctcatttaatacacacatagccattttgcagataaggaaattgagactcagaaaatgtaaataacttgcccacataattcagtctaaatgccaaaactggggtttgaagttgcacttaggtctaagttcaaagctttttatgttctaccatgcatgctgcttagcatgttttctttcatataattcatgctgctaatgaaacagtataaaccagctgtatgttaactgctagtgaaatgatttattgtcttctttttcagtaaatatggcaagtctgctcaatttattccctttatcattgcatacactacaaatattctctccctataccttcacatgtcaattaaggtatgcaacagtaatttccattttttttaaacaatgcttatgttaccatctctagacaagttagtccagatgattttggggttaacatgttggcatttcctggcactattactgctagctgaataagagttgaaagttggggaaaaatttaccagatctgtattagttttttcgcacactgctataaagaactacctgagactgggtgatttataaagaaaagtttaattgactcacagttccacaacctgtacaggaagcacgcctgggatgcctcaagaaacttacagtcatgtcagaagagcgaaagggaaggaagcgtgtctttacgtggtagcagaagagaaagagacagagagaatgagaaagtgagagtgaagggggaagtgccacacttttaaaccataatccacccccatgatccattcacctcccacccagtccctcccccaacattgggaataacaactcaacatgagatttgggtggggatacagagcgaaaccatatcaagatctatttagaattctccagcagatttgattaacaatatagatttgtgattctgcaatttgtagggtcattataaaacatggctgccttgattgcaatcagatatctctgaatatggttcaaaggaaacagatctcgttcttgtggagataggattacataactccctctcagtcattttgccattgattcagaatgtttctccctaagatgaagtactgttttagcttagaatggtaacagcaattcatcaccaggcacagtggctcacacctgtgatccccacactttgggaggcccaggcctgtggatcacttgagcccaggagttagagactagcctaggcaacatggcaaaaccccatctctacaaaaaatgtaaaaattagctgggcatggtggcacaggcctatagccccagccacttgggaggctgagaaatgggaggatcttttgagcccaggaggttgaggctgcagtgagccatgatcgcatcactgcactccatcctgggcaacagaacaagtccctgtctcaaaaaaaaaaaaaaaaaaaaaaaaaaagcaattcattgatctcatctagtttgactagttcaattatacatgtgagaaggctatctgagatgatgtcaggtgtggagcagtgactatcccagtgatctgaatgtgattgaccacttggcttcaccaggattatctcactgtttggttctaataaaggcagtcattctagtctatgagtttacctcccttttgctacaaacacttcagtgatatactattgaaactataaaaatccataaaaattggtttttgtatgtgagttttaaaaaattgttttcaccaggctgtgagttttatgtctttgttttctattgggatactaatagtgctatgactatagtatgttctcaaggaaattcttatgaaaattgaattaatccgacacagtgcatggttttggagtaaaacagaacttgttttaaatcctagttcccccactaggttgggtgagatgagacaaacgacttaacctcactgccactttaatttgttctctctctctctttagggtggtagaaatgatacctacctaatagggttacgtgagtaataataagatataatgtgtgtaaaattcttgtacaatgcccagcacagaataggtgctcaatatattaaatatattgttattatttattaattaattaatgctgatttctgcattaattttgactaattgaaatcctggacttgcttaatttgcatgtatttgtcttcccttcttccagtacttgatggcaatttctacctgtggtaaatggaacgttaaaagttatatgcttatacaaactttagtcctttattccttggagtgagttttaagagtcctcatgttgaataattcatgtaatcacagaaataatactatgtatcagggaccgcttcctttattaaagataaaggcagtggaaatactgcctttgtcagaaatacttcagttactctgagagagagagacatttgtttactatatgacagcacagtgcatggcaaataatagaagtttggaaaatatttattttgaatgaatgaataatgaacacattgtgaacaaataaatggtttactatttaattattcaggaatcaattaagctttattaataaaaattgtttgggggttttaaaaagcccacacacaaatgagaggcatcacagaggcaaacggtatgacattattaaaatcgttattgctgaatcacagttcagcaataagcaagtgtttgaggcattcaaataagtgagtatttgagtgactctaagaagataatgaaactcctccactgttttacagttgcaataatttttaaggaacatataaaaacatattctagtgtttccatttgaataaagatagtatatataacatatgcaattaaaaagaagaaagaaaacaaattttaatgtgtttttcttttcaccttatgggcagttactagatgtatgatcagcaattttagcagtagagaccttattaattgtttttgaaaactctctagtgcttcacaccgtcactcaaaacagagaaattccttttaattaaatgtcaggaagtattccaagaaattttgccagcatttctgctagccagtaagtaaggttaattgacaatctttaagagagaatcttagagacattcatatcataattaatgtaatttaagatgctgaggatgcatgaattacctactcagtgtaaatggggtctttgattgtgaagagaaatactcaagtgcagtggtatcttacagaatagattccctcattagtgtgaattagtgtttctgaatgttgctaattagcaagcctgggaacaaacacaatgaaaaatcaagtttaccaaatcacaaaaaaagtactggttagcatatttggtaaacatgggtcgataattattttgattgaatctcccagcaacctagtttattgtggttgcaggccctgtgcacagtatgttttacctgccataggtataatcaaccatatactaaaagtttgtaatgactgttgagatcaaaaagtatttcagaaagtcactgagaatatagttttctgagataaggagatgatgttctatttctgatgtgactgtaaaaaggcatagaacttaagtgagaaaacaacaacagtgcctctcattttcccagaatttatttcaactggctgttgagcctgcccttgctctcttaggactcatgttacgtagaaatgcagactgtgtgcagttctggtcacctcctagggaagcactgagaagggagcaagtaataaacctcaggaaaaatagttttttgttttttgtgtcaaagagcagtgggtgatggttttaaacatctgagatagaactggtgataaagaaaagttaggaaagaagacatactgaaaagtaaaattgagggatgtgaaccaggtagaaaatactgtatctaccatgcttttcaagctatggtagagtgtcatgaaatcaaatgaatgggttatgatcagcattcttttagtgaaatgaaacaagatgggatgagaagttatggaatgagatgggcatatctgttgtaaaatgggataggataggacagaataggaaatacatattatagaatgcatcacaagtaataagagccagtgtcatttcttgagccttttaggttttactcaaagatttttggttttaccaaagtggtatatgtatacctggttttaaaggtcaagtaataaagattaacacaaaatgaatcacagatttaaatataaagcataaagcttttagaaaaaaagtaagagaagatctttgggatccagaactcagcagaatgttcttaggcttgacaacaaaggcactacccataaaaagaaaactgataggctgggtgtggtggctcacgcctgtaatcccagcactttgggatgctgaggcaggcaaatcacgaggtcaggagttcaagaccagcctggccaacatggtgaaaccctgtctctactaaaaatacaaaaaattagctgggcgatgtggcagttgcctgtaatccccgctactcaggaggctgaggcggaagaatcgtttgaacctggcaggcggaggctgcagtgagccgagattgggccgctgtactccagcatgggcgacagtgggagactccgaaaaaaaaaaaaaaagagagagagagagagagagggagggaggaaggaaggaaggaaggaaggcaagctgatagaatggatctcattgaattaaaaacctttgctctgcaaatgagactaaggggatgaaaaaacaagctgcaaactgagagaaaatatgtacaaatgacatatctgattagaatatataaagaaccctcaaaacaccacaggggaaaaaaaaaaaaacaccagttgaataagaaaataggcagaaaacgtgaagaacatttcaccaaagagcatataaacatggcaaacaagtgcaagaaaagatgtttaatatcattagccccatggggaaagtccagttaaaactacaggagatatcactacacacctgccagaatggctgaaacaaaaaaaactagggatgacacaaaatgctgggggagatgcaaagaagccggatcacttacacattgctggtgggaaaacagtttagtagtttcttaaaactattcagttagttactatctgaccaagtaattttattctcgggtatttagcccagagaaattgttatgttcccataaatcctatatatgcatggtcgtagtagctttctttgtaatgacccaaaactggaaacaacccagagtaatattaatatatataatatatattttattatatattacatatattattatattacatataatatattaatatattgcatatattatatatgtactatatatatttaaaatacagctgaataatattccgtagcatgtatgtgccacaatttgtttaaccttttgtctattgaaaagtttaaccaataggcaaaaggttaaacatatcgtggcacatacatgctatggaatactactcagcagtaaagatgagtgaagtattgatacacacaacaatgcagctgaatcttgtgagaattatgttaagtgaaaatataccaatcccaaaagatcacatatcattaattattaagtattactgtatacattaatgtagtgtgggaagtgtatatatatatatgtgtgtgtgtgtgtgtgtatatccatttatgtaacattcttgaaattatagaaatgcatatcatattagtggttgccagtaatcatggtgggagctgggagggaggaggtgtggctctaaaaggacaacatgaggactccttgtggtgacggaaatgtctatatcttgactggatcagtgttaatattctggcagtgatattgcactatacttttgcaagatgttaccattgtaggaaactgaatagagggtacacagaatctctgtattatgtcttacaaattacatgtgaatctacaattacctcaaaattgaaagttcaatttaaaataataaaagtcaaatgatataagccctttgttacagaatataatgattttcttcctcaactctcccactctatccctagaccacctttccaggagcagccattttctatttattttagttattcctcttgatatttacatatctccatatttttccaataatatgagtgtactgctaacttctgattaattcattttgaatactgtttactttctattctggtaaatgaagatttcactcttttttcactcttccttctgcagaccctcccaacctttcaatgtaagtcactatagttttttgagaagtcaaaattcagcatctacattatgtatacatattacactgcactatggttgtttcttaccttttgcttttcctgtagtaaataaataccttgttcattgttgctgttttcataattcttcccacatcttcaataatctctcagtaatattttccacaaggtaaattgcgtcaggtaaccaatcagtcccattgtgacttttctttgagaacacattctggaaacctccattctccttttacctgagctggctgctctctaagcctactgcacagccattatcttttgaattcccttttattttcttctagattggattctcagctttcaggatcttgtgtttttgtctttcttgattcactccattatttcagacagtaaaaatccaattttttttacataaaaagatgacatgatgacagaaggcatgatgatgacagctgtcaatgtgtctgtccctcaattcacactagtcctatctggaccaatttccctctccacctgacacactgctttcacacgggaattttccttccctgtcaccctgctgactcctgttgcgtctctctgtgtcaccctgttctgtggctgtgtctcccactctcttcgtttactttgccattttgatgaagtacatcctatcatacattcctgagaagagtgtctggaaggcaaaatttttaagagcttgtatgtctggaaatagttcgtatccattctagaatatcttattgggttttttttttctcccttcattttctctgaaagaagagagaaaatatgaagatatttctcataataaagatatgaaaatctgttatttgaaagttggacttgcatactggccccgattttcttatccttcctctttcattttctacctctttgtctttttgtcctactttctaggagttttagctaatattatcatccaaacctcttactaagattttcatttctgctatcatttctaaggtcctttgtttttgttgtttttgactaagggttcttttattttagtatcctatttttgttgcatggatagagtattttgccttatatctgtgaagatattaatgacaatgttttgaaattttcatttccttagtttctgttaccttctagttgcttttgagctccatttttgtactggaagatttccttagatacatagtaaattgaatgttttctcataataaaatgttggagactagaagggtgactggagtttctgagtgtattagagctgattaactttgatcttcaccataggttgacctgagtcaaccacttttgggggaattcctggcaacagtatctttagctcttttttcttgcactgatcagattccccagagagtagctactcaaactcctagagggaaaaggtcttactaccattattacgataacgagcaggttgtggtggatcctcaacattcaatctgtgtatgatcacttaataccccagcttttggtttaatacctgtcctttgactgtgttggatgtatctttggatgaaggggtgaactctcatctaaagatttctatcttctgctggaataggagaggaccatatgcccaggagtctgggagagattgcacgcaaccttccttatcttagttatcccctctttatgcttggatcaagaagtacctaacgttgccaattcctgagccttttgagttttccaaagtgtaaatcttgttgttcttagcttttctcagtgttggcatagggttttctctctggtgtcagctagtcagttacctaacttgtccatctgctttcccacttccaaaattatgttgttgtcatctcctttccttttctcttcttttatgggtttatgtctttttttaaagtatttcatcactatagttttagtgggtttttcaaaatgagcaagattagctgtatatgttcaatctaccatcttaacccagaaaggaacttctgtcttaattatatgtgtatgtgtgcatctttgtatgtgtgtgtgctgaatcacagcataaactataatccttattgtggatgaaagccaaaaaagtcagttagtccaggccaacaaaaagtaatcaagttcagtcaaaggctagtcatattttctctttgctatgaaagcctcccatagagctgagagagttttgaagacatatgaggacattttttcagaatgtggtattcataggaagctctaagtctatctctttagaaaaaaaaaaggtaagctacacttcctctaatactgcatttgaatgtgtccttcatttctgttttgagtactaagattatttattctaggtcccaaatttttatgtcaagaatgtcataatactaaataagtaaaataaaaaataataaaaataacaagtaatcccagtgctaagttatgcaatctgtatcaatctgtaatcttcaattccactaaaaaaaaaaaagtttgctctccaaattgcatctactttggcaaaaatgcatggaaaatgcaattacctgttcaaaatattaaaattagctctttagaatattgctttaaaagctcaaaaggatatttaactttgaaaccaatatgtgctgcagatatggatacctagaggcttttttttcaataaaaactaattttcagaatttttttcaaatattgtatcatttctacagcctaaaaaaaatgtagtgagagtgtgttcacagatgcatcaaaattgttattatagcattatcttttatttctatgggaactcagtgagatgatttttctaactcttaattttaaaaaactcacttgtaagctattactccaaatctcctaagattcagaattgagtaaacaatggtcacatgattgagattttacaatttgttgctacagtaccagcaatataaagtattgggataaatgtcagtttggaaaaggtgataggtgtgaaatatccaaaagtgacatgtgaagtaatgctatcttgctgtaaagtatttagatttccattagtgttacattgttcctgaagagaaaaactaagtctggattgccttcttttttatattaatatggatgatacagtgagagagagagagagatccctcttccttttgtaccaatgtgaacattcttctattatttactaattataaatatatagatccaagaatttaaagtgggcttacagattgcatttccacctaaaaataaacacgcagcatactatatttattcaacaaatatttcccaagttctactataaaagttactcattcttttactttaaacttcttttgcctcttaaatattttcatgggctaataggggaagattctatttaaaatgtttataaaaagtaaacattatgtggaaattttgggtttttttcacagtaggattttgaagtatacctagtcacgaatgatcacaaaaacaaaacaaaaaaattaaccatagtacaacagaaaataataaggccaaaatcccatgaatgacaaggcacggtcctgccctcatggagctcactgtctaacaaggaaaggggcttgtaaacaatgaaatataatacagtgtaataactgagaagacataggcatacatagtaaaggaaggactgcatcagtcttccttcagaggtggtagactcttgaaaggcttgtcattccagagctaagcctgaggctctaaactccatcacgccaccctgcacacttcatcctctgtgcttaggacctctcaaaataaaagaaattgctagactacaaaataaagttatggttttcaaagtgccacaaaagttacatgtaggctgaaattaaaatggtgtgttctaattattctgatgttctccacattgtgagtgtcccttgctattgttagtgccccatgcatattataatctgcccaccacaaattcagcacctagaaattaccagccaaacaaataagaaaagcaacgaggatggatgagggtgtgtagacgataccccttgggagaatgtccaatgatgatgatgcttgaacagcacctaggaaagcagttggaatttggtgtggctggagaatgggatggaaaggccattataagatgaggctgaatgggagcttctgggccatcagaaccaacttccttcccaaggcaaccagagatgtttaagtttccatctatgctgagaaatcgactttgacattaaacatcaattgatgtacaggaagagattggaagggaatataccaaaacttgataggatttgtcttagagtgttaaaaccacaggtgaattttttttctttctttgtgatttaatttaaaattcaaattttcaaggtttctacaatgcacatgtattactattataatgagagaaaagcaaagtgaaaataaaaactatttgaaaggaaaaacatctagagtaaaaaatacattatccagagtatttttctgggttccttattcatgccttgaggacctagtttgtctcttggttacttagcagcatctaacatggaacaggaagaaaagtccctagccaaggacttagtgaaatgaaattgtgctactgcatcagggcccaagcagttactctaaactctagttggattaaaggaattgtctttggactagcacatgtctaaaatggtaactctaaatctaggatgatatttaaggttttgagaaatgatagcagagggtggcagggggtgagtaatttaaatacaaccagcagcagaaagaaggaacccttggaaagtaaattataattcattacgggatgtaataaattagttatcaccaccattaatagtagccattttaatatgtgttccccatagcataatgaaatagaatcatcacatactttatttaaattcctaaaataaaaatgaattgtgaggttgggcgcagtgactcatgcctgtaatcccagcactgtgggaggctaaggcacgcagatcacctgaggtcaggagatcgagatcagtctggccaacatggtgaaaccccatctctactaaaaatagccaggcgtggtggtgcgcacctgtagtcccagctactctggaggctgaggcaggagaatagcttgaacccgggaggcagaggttggcgtgagccgagatcacaccattgcactccagctgggcaacagaatgagactccattcaaaaaaaacgaaaacaaaaacaaaaatgaattatgaacttctagccctcacactttcactgtaagtaacatatcacaataatggttgccttttttatgcgatgcataaatattttgttacagagtacaaaaatacttttcacgttttggttgattcaaggtttggaaagaatgaggagcagcggcaggcagagtgactgtggagaggtgaacagtacggcagagagggcattcctatgactgttggcgcatccgaggagataggagcagagaagcccaatttgaaaggaaaaggcaaatgccatctatctgttgggtggaggcaggcgctgagtctggaagcgtgtggggccacggggctgggggctcgggcctccctgaagcgtggtgggtgcaggggcgaggcgagcagagagaggccaggcaggatgaaccaccgggggccaggacctgttgctatggtgacagcgtgaaaacaaactgtacactcacatatacacaagcgtaagcgtcttcattcgtgccaggaaacatgcaaaattaaacgcctcgtttcctcgagcgggagctaccgaagcaaagttgggtgggaggtcaggccttgcagggtccaagtgatcctccgagctggatctgagcgcctcagcgagaaggtccccaaatcctcctgggaggcgttggagaaaggcttgagtgtgcagaaaagggctgaggaagaggaggaaggggaaacaggaaggagtccactgtgtcaggcttaggattcacaatttctggggggcagcggcagctctgcacaggccgcccgggggcgggggcggtgggagctcagggcgcctgtcccggcaccaccacagattcccagaaccaactccccggtgaccagactgaagaactaacagaactgacgatacttccatccttgctgggtggtgtcagaggaagggaaccagcgcacctggcatggagggcggcggcaacggtagtggcagctgggtaggtgaacgcagcatgggtgatggctggggtcagctctgtggtgtacaaaggataagggcccaggcctctgggcatgcaggcatcagagcagcccccatcaggtcataggggtcccgagcgatgaagtaagtgtgctcctaggtggggtgcatgttggtgggatttggagttgccattagcttgctcttggccatcttggtgttggctttggcaaactctagcctcatgatctgtgggttttcgggatctaagcgaatatcgttcagcgcatttttggccgcttctgctcctgccccgctgtcaaagatcacaaaacaggctgtctcgcggtgagcttgagtagggactcttcataccccttgaacggccggaagatcaagtagggttctctgggtttaatgtccatggggaggccgctgatagtgtccggacctcctcttccaggacgccgccggaacccgcgctggagccagtacaggtgctgccgccgcgctcgccctcccgctacaggttgctcctggtgcgggggagggggcggggcggcgggaagggaacgtccgggcgagcacggcggcggcgccggccccagcgttgtgtgggcatggttgcctttaagtcctggaattttggaagatttttttttttttttttttttttttttttgtggagacggagtctccctctgtcgccaggctggggtgcaatggcgcgatctcggctcacgcaacctccgcctcccgggttcgaacgattctcctgcctcggcctcccgagtagctgggactacaggcgcccaccaccacgcctggctaatttttgtctttttagtagagacggggtttcaccacgttggccaggctggtctcgaactcctgacctcagggatccgcgcgcctcagcctcccaaagtgctaagattacagacatgagccaccgcacccgtcctggaagattttttttcttcattctgttttcctatttttcaaatacttcatatcaaaaagtatacattatttttgtgatggaaaaattcttaaattccttaggaaactttaaatgaagtataaataatttataatctcatgcactagtacagctaattttatttttacatattctcttctagctacttttcttttcacatactattgtacatagttataatcaacataagtagtttcatattttaatttcattgcacatttttaaatattttcatgttattacatactattcataattgcctttttcagagctgtgtagtacacctgcatgatcaaatgctataatttactataatttgcagttttctactttagggcattgaaacttatataactatttttctatagtaggtgataaacattattgcattaagctacatttctattctttttgaacttattttacaaaggaaacttaccttgtataaaattgtaagattgctgattatatagcaaagacatagactcaatctaagtgcccatcagtgacagatttgataaagaaaatgtgttacatacacaccatggatactatgcagtcataaaacagaatgagatcatgtcctttgcaggaacacaaatggagctggaggccattatcctcaccaaactaacacaggaacaaaaaaccaaataccacatgttctcacttttaagtgggagctaaatgaggagaacacatggacacaaagaggggaaaaacacacactgaggcctacttgagggtggatggtgggaggagagagaggatcagaaaaagtaactgttggatagttcctgggtgattaaataatctgtacaacaaacctgagtttaccgatataataaaccttctcatgtacccctgaacttaaaagtttaaaaatcaaaaataaaaataaaaagattgctgattatacattaagtattttattgtcataaaaattaatccaatttatattgtcaccagcaatgtcaaagtgtaccaaattcatgtcaatttttattagttattattcttttgcaaattaaatcggtacaagttcatgcttttaatttacaattttaaaatttctagtaaggctgaataattttcagtcattttttgctagtctttcctgactgacttatttgtacatatatattttgaattgtgattcattcagataagttccttatacattgtggatattaagccttttttatattttggaattcttccctaatgaagaatttttggcattgtaatttagttattgtgggtagcaccatgttctgtcttcatgatcaaagctgccagctctctcctttataatttcttctattgccccaaatgtgaggacgttattattcctccacagacaaaacaagtgtttccgctatggttttttttgtttgtttgtttgtttgtttgtttgtttgttttttgagacagagtctcgctctgtcgcccaggctggagtgcactggcgcgatctcggctcactgcaagctccgcctcccgggttcacgccattctcctgcctcagcctcccaagtagctgggactacaggcacccaccacgacgcccggctgttttttttttgtatttttagtagagacggggtttcaccgtgttagccaggatggtctcgatctcctgacgtcgtgatccacccgcctcgggcccccaaagtgctgggattacaggcgtgagccaccgcgcccggccttccgctatgtttttgacaattgggttttatttttgtctgtgactgtgtaagctgcttgtgtttaaaagcagtagtgatttctttaaaagagaaagagggccaaagcctgagaagagggggttttttgatggctgcgagtagaagacaatgactggaattcagcaggctgaggccttcaagctcaattaaagatgactagaatgttgtgataggacaaaaccttgttcctgtatcaccaatttatcaaaggatttttaaattgtttttctgttttttatgatgtagtcatttactgctgtcttgtgaggcacgtatgttgtctcaaattgctcctctgcaaaatatatcagcagcaccaaggaacacaggatggcggattagccaaacactgctcagctctggctgagggagaccaggagatgtcatttttctacctacaaccagtggtctttgcccttggctatacatcgcattcttccagagagctgggaactccaacgcctgggtcctagcctttggtttctaatgttattggtcttgagagcatcctcattattgggattttttttttaacactccccaaatgattttaatgtgcagccaaggttgaaacccactgtaatcatttcatcaagaaatgcaaagaagatatccaaaagaaaagaagtcaatatattgaagagatatctgtactcccatgtttattgcaacactattcacaatatccaaaatatggacttaacctaagtgcccgtcagtgaatgaataaagaaaatgtggtatagatacacaatgaaatattattcatccattaaaaagaatgaaatcctgtcatttgcagcaacatggataggactggaggccattatgttaagtgaaatgggccaggcacagaaagaaatagatcatatgtgctcattcatatgtgggaccgaaaaaagtggatctcatgaagacagagcttagactggtggtttccagaggctgggaagagaagttggaaattggaagaatgggaatgaagagaggttaattaatggctacagtctgatagaagaaatcagtcctagcgtttgataggtcagtagggtgactatagtttacagtaatctgttgtatatttcaaatagctcaaatagctagaaaagaataattcaaatgtttctagcataaagaaaagacagatatttaagatgatggatagcccaagtacactgacttgatctttacaagttttatgaatgtaataaattatcacatgtactccaaaaaaatgtacatctatgtatcaatgaaaaatagaattatttttaaaaagaaatgcagaaagaatctaatccgtaaaagaaggtgactaagaaaaagaactagaaactacctgtccttcttccataaataccttcaatttgatggtaaaatttcatagtggaaatagaaatatggtttttggacacagcagaagtttccaaaatggtcttctttaccatcctctctcttcatcatctcaagtccaagtggccctttccaaacagtatagaaagtagcaattagcagtttttcaaaattcaaaatttggcttagatctttttattttatttttatttatttatttatttagagatggagtttcactcttgtcacccagactagagtgcaatggtgcgatcttggctcactgcaacctccttctcccacgttcaagcaattctcctgcctcagcctcccaagtagctgggatcacaggtgcctaccaccatgcccagctaatttttttttttttttgtatttttagtagaggtgggttttcaccatgttggccaggctagtctcgaactcctgatctcaggtgatccacctgcctcagcctctgaaagtgctgggattacaggcgtgagctgccgcacccagccagcttagctctttttaaatgtcagggaacagagtacttgaaagccaatccttaacactgctaatcaataggaaacaggaaaggcttggggaagataaacagttgtattttatatttatttttctccctaatgccaagcatggaccattcatggggctagatctgccagggaggatcccaagaggatccctcacagagagcaggactttggggaggaccttattccattggcattttgcccttttctgagtaggttttgactaggtgctcacatgagttcacggtcccataacctacatctcccaaaataccaggacagagaggcaaatgtgtagttggagaacagagggccagcctcagctggaaatatagcccctcctaagtaccttagcattcagaggggtttaagcccctaggagtaataagaaagacatttaatgtgttactaacttcactggaaataaaattgacaactcaagatatagcaggtccacaaataaaattgtttccttcatcatcgttttgttagatggatgaggaaaaaaaaattggttcttggctggaccactgtctgtgtggagttggcacatcctcctcaggcctgcatggattttctgcaggttctctggtttcctcccatatcccaaagctgtgcactgaagttcattgacgtgtctaaatgatcctcatctgagtgagtgtgggggtgtgtgtgagcatgctctgctctgagatgtgccctgtccatggctgttagctgccttgtgccctctgctgccaggatgggctccagccaccctcaaccctggactgaaataagtgggttggaaaataaatgaatgaatgaatgaatacaaattattgtaaaatcaaaatgtgtcagaccagactcagtggctcacacctgtaattccacaatttgggaggcctaagtgggaggatcatttgagatcaggagttcaagaccagcctgggcaacataacaagacctctccatctctgcaaagaattaaaaaataaaaactagccagacatggtgacctgtgcctgtagtcctagctactagggatgctaaggaggaaggataacttgagcccaggagtgaagttgcagttacctatgatcacaccactgcactctagcctaggcagcagagggagacgctgtctcaagaaatatataataatcaataaccatacatctggtagtaaaatgagtttggttaaaaataactaaataggccaggcatggtggctcacacctgtaatcctaacactttgggaggtcgaggccggtggatcacctgaggtcaggagttcaaggccagcctggccaacatggcgaaaccccgtctctactaaaaatacaaaaaattagctgggcatggtggcaggcacccgtaatcccagctacttgggaagctgaggcagaagaatcgcttgaacccggggggcggaggttgcagtgagccaagatcgcgccacttcactccagcctgggctaaagagcaagactctgtctcaaaaataaaataaataaataagtaaataaaaaatagcatacaataatcatacaaatacacaacaattgatgcagtaggaaagcactcagcaagcccaccaatatttgctcgtttttttaactgtatagtggtaggaggtgccccttctaattttcgctatgcaatcatttattctttgatttaacctcccgccattatgaccactgtcactcactgattaaccaaaaattaggtaaataattatcttacttgtttttattaatctttcttaaatgtatatgtagctcacatttgtttcagtgtttaatattgtgttttgtgtctttatgtagaaatttggtgacgtttttgtgaccagaaatatgccataggactttaactcttctttagatcaaatagctatggtaaaatcattttcattatatgtgatttcacttaaagtcacaatttccaagaacctaccgaagacattaagtgaggacttggtgtacttatgaagcagaaagacagcatcttgctcatttttgtagctttgaagcaagaaaaaaaaattccctaattcactcctgcctcaacacatgccagcaaagatatatttcctattcatttgctctaactacacctacccaaaaaaaagcagaattgagtgtttaatttatggcttaaacaatcaagttataaagtgctgtataaaactgcacaatcagatgcatttgagtataatgtaattgatgaccgactctcatcctctgtccagccctgttcctaaacaggatgagtctcttattggggtacaggatgttgatggggagtgcaacattaggctgggaggtaatgtcttgtaatcatctgggatgttcgcaggttcatttatgtgtgaacaatatagtttcactatctttacttttgtgcttattgtgacagtaaacatctgctgaaagaaagttttccattaacctcaaaattaaaggactctatattttatgctatttcattatttggacctgcattatcatattatggctggttatacagtgttttcaaatacagaaattattaatataggcttgcaggatctgtcttgtaaccactccagtgttccccaactttctgagatatgagaagagactaagatagaagtacctctcattcagtttcagatgagggaaagcagtcatatgcctctgttttgaaggacagcataaaacactcttgtgaattctgtactgggaatcttttttttttttaagagagtgggtctcactctgttgcccaggctggagtgaagcagtacaatcatagctaactgtaccgttgaactcctgggctgaagctattctccctcttcagcctcctgagtagcttgaatgactacaggcatacacactaccatgcctggctttttttatttttattaatattattatttgtagagacagggttgcccaggctcatatcaaactcctggccttaagcaatcctcctgccccagcctcccaaagtgcaggattaaaggaatgaaccaccatgcccagctgtactgggactcctgataaagtttgttattcaatatttcctttggggagctaacatctgggcatctcccagggctctataatgatggctggtggcttcagttttgtcagccacccagcctgtatatgagtcctctattccacctgacctttccacatcccttacacaacccccttgaatttccagggtctgtatatttccaaggctcctttgggtgtggcctggcccagcacatggccatggtgaccacattgctcaaaatcaaatctcctctggatttgatatggggtccacaccgtgccaagtgcaccagccctgtgaagaaaaatgtaatgcaggagatgggaacccagataccaataagagatacaagaagggcagccccatgtggtggttcacgcctgtaatcccagcactttgggaggctgaggtgggcagatcacctgaggtcaggagttcgagaccagcctggccaacatggtgaaaccccgtctctactaaatatttaaaaattagccgtgtgtggtggtgggcacctataatcccagctactcgggaggctggggcaggagaattgcttgaacccgggaggcggaggttgcagtgagccgagattgtgctactacacttgagcctgggtgactccgtctcaaaaaaaagaaaaaaaaagagagagaaatacaagaagggcaaatctggaagtggtcagaggtgaggctcagggtcagacagctccagaacccaactgctggggttaaagttctcattctgtcatttattctccaggtgtcgctcggcaagtttcttagccttctgttcctcactttcataatctataaaacaagaggtaatggtaaaacacactcaggccgggcgtggtggctcacgcctgtaatcccagcactttgggaggccaaggcaggtagatcacgaggtcaggagatcgagaccatcctggctaacatggtgaaaccccgacactactaaaaaaaatacaaaaaaagtagctgggcatggtggcgggcacctgtagtcccagctacttgggaggctgaggcaggagaatggcgtgaacctgggaggcagagcttgcagtgagccgagatcatgccactgcacttgagcctgggtgacagagtgagactctgtctcaaaataaaaaaaaaaaaccgcttcatggggttttgatacaattaattaaagttcttggcacataattagatttctctaaaaaaaaaaaaaactcttattactatcatcatcattattgtcctggagtaaagaattggaagccatcagggaaagttttcccagctgtattcatttcttgggctgccatcccaaattaccacaaatcaggtggcttgaaagcacagaagtgtattatctcacagtacgggagtccagaagtctgaaatcatgggctcattatggttgcttccttctggaagctctgtgggagaaaccatcccctgcctctctcctaacgattggtgggggccaacaatccctggtgttccttagcttgtagatgcattactccagtctctgcttccatcttctctgtgtccctatgtctttgccttttctgtttcataaagacatttttgctgcatttagggtccccgcctaatccagtgtgatctcattttgaaccttacataattacatctgcaagacctttattccaactaaggtcatattccgatgttccacgtggacataaatcttggggtgactctattcatcctactacagcaactaagagcaggttacaataaaatcagagaaaccatgaacaattcctggaaagaatgtcatcaaaccatgggcacgatgtttatgggctaaaaagactgtgttgtgtgggtggtcaatccagcaaactggctaccctgaaggtcatcactgagtcagaaccaactgtcaaacacagagttaatcaatgtactctcattccaactggggcaaatttctctggagaaaacatgtatctgacaggagcaggctgtacacatcaggcaacacacacgtgtagtgagctctttgccctgtctctcctgacatattgtagtcacaatttaaccccaaactcgttctgatactgcgtaatgcaatgcaaagggcatgggctttggagcctcagggaactggattctaatgtcagcctctgcaacttactagctccgcttgccaccttcatggcctcagatgaggtacttaccctctccaagccttaatttctgcatctgaaaattggtcataataccactaacaacttgtaaagttgctctgagtatgaaaattaatatatgcagaagctgcacctaagtacctggtgtaaatttcaatgagcagttgctatttgtcttagtctatttgcactactataaaaaacgcctgagactggataaccagtaaagactagaaatttatttctcacggttctgaaggttggaagttcaagatggcaccttgctactgagtctcccagaagagacaaatgctatgtcctcacatggtagaaagaccagagggtaggagggcctacctagttcactccagcccttctataaggtcgctaatcccattcatgagggctccaccctcataaatgaatcaccttctaaagttcccacatcttaatactatcacactggtgattaagtttcaacatatgaatacaggaagacaaatttcaaaaaataacactattattatcattattgtgaggtagtagtttcatctctctcctactaggcttaaaggcaagaaagccaaagggacctcgaagaagagctgtgaagatccatgtgtctacatgtatctcatcatctcttcccgcaccaccgcctgcattacagcacaaaagtaaactgcataaacacacagtaaatattcattgatgtaaatgacacacaaactgcattacaaatataagcactgcctcaatgaatgaacctccaatagcctttcaaaatttggagcccaaccaggacagcccatggcaaagtcttttcctttcatgacttagcaaatgaacactgcacagagcaaaggcaacacaaagtagtattagtcctctagtgtatgtcaacatttagagaggcttggaccatataaaaatggtatttggaggccaggagcaatggctcacccctgtaatcccagcacttagggaggccaaggcagacgggtcacttgaggccagtagtttgagaccagcctggccaacatggtgaaaccccgtctctactaaaaatacaaaaattggctgagtgtggtggtgcggtcctgtaatcccagctacttgcggggctgaggcatgagaattgcttgaacccaataggggtggtggttacagggttacagtgagccagatcgcaccactgcactccagcctgagcgacaaaacaagactttttctcaaaaaaaaaaaggtatttggaggccacataactcctctttcatgagagcatttttattactttactttgtattgccaaagtaatacatgttcattggagaaatgttagaaaatacaggcaagcaaaaacaataaaatcattcttaatttcagatatgcagagagtttttttctttaacaatatactgtgacactttcccagtcattagtcttcaacatcattttttaaagttgtctaatattccattatataaacctaccaatattcatttgacctatcctccatcacaggaattttaacttcattctaatattttgttactgaaaacagaaatgcaatgaaatgagcttattccttatttgctttacaaattcataataatttggcatttattataaccctgctgccttccccaaacatttgcaattaacccaaaagtaaatttccttggtttacgaaaaactgattttttatccagtctgaaaatcgccctcagctttggctgtatgatctgaagcaagctctttcctggctgcctgtatccagtaactaataagtagtcagcattcttggctccggctacttagcttacttgttcaggacataaggctaatggggtcagtgtcatgggatatgagcttgatatatacaggccagttagttacaagtccaaaaactatttctgtaactccagacagctgtcacttaaaagctggctgttagtttccaaggaactgggcaaaagagcataggtggatcaacacaaatccatcaccagtactggaaagataatgtgtcgatagcttcatcttgcccgtagaaaacagttcagaaaagtattcatatttaaaactggggaggctgtagaaaaagaagaaagaataatattggcaagacaattggctgaccttatacatatcttggtttatcagcttactctgtgagtatcccgccatttccacgtgagaaaaattcagcaacatgtttcaaattgcggatggtggtgttatttaactggcaatattctcttgcagctgacacagcccttggcactgatgatgtatatgatgaaaaaggatgccagtgtgatgtatcagtggaagacctcaccccaccacttaaaactgtcattcgagctatcaggttggtgaaaatcttgaacaacgtgattcagagacatacttatgattaattgaattactatgttgctaagttctttttctgcaggtaaatatcctggaataaccactttccctttcctattcatccatatgcctattgaattgtgaaatatttgtttcttaatacaaaattctgctgtgttcaacacaaagagttataaaacgtgggtgggatttgaaaagccaggtcatattagagagattacacgagtcttggcttgtcgtgtgtatttgctactttaaggacatttagtttattgatgcaattggattttttaattatttttatgacttgctccaatctgtattctgtacagaattgtatatcaaagaaaaggccttgtaggttatttcaaaatgggttgagttctgaaaatgggaaacctaaagtattttgcagtgacttagtcttattatctgaaatgtaattgttaaaggctgatcttaatttgcttcctctactgatggcagagagctaagagagtatacctagcaacttaaatttaccttttccatgacctttcccaccacacacacacacacacacacacacacacacacacacacacgcaatcaagatctggactagatgaattgctgcatgctcagctggcccagtttaacccttttgggagaatttgtatttgtcaaggaatgctgagtaactatattgcaaaaaaaaaaaaaagaaaagaaaagaaaagaaatacctctgcctgttggtgaaaaactagaagaaagttaaaaatatccaaaccaggccaggtgcagtgcctcatgcctgtaatcccagcactttcggaggctgaggggggcagatcacttgaggtcaggagttcaagataagcctggccaacttgacgaaaccctgtctctactaaaaatacaaaaattagctgggtgtggtggcgggcacctgtaatcccagatacttgggaggctgaggcaggagactctcttgagcccgggagatggaggttgcagtgagctgaaatcatgccactgcactccagcctgggcaacagaatgagattctgcctccaaaaaataaaataaaataaaataaaatatccaaaccaatttagctattcacatgtttggtctaatcttgaatgttagcatgattgattacttacttctgtttttagttggtcatttggcatcatgttagacattgatttgccctatagctgagagtcactgggaaagcagaaatgagttctaaagattttcataaatgtttgtgggggcaaagaaaatcatggtgtgatgaaactccagaagatgtttaaacactatctgtagcagcagcctaaaaaaaaacaaaagttcagttacttctcaatggaaccctcaagtcacaaaccctatgggtggagagattataccttcctatctggcctggacagtccagattatgcctctagtctcatcataagtgttaataatgctcccatctttctcaaagtatcccagtttggacaatcaattatatggtcaccctatctctagtgaacctagaagtcttgggtgatgtataagcccagataacccagaatatgtagtgaaatgatgtctgaagccttcagttaaagggatagaggatttagaactgcactgtccaatatgataaccactggctacttgaggctactgaggctatttaaatttgaattaattaaaatgaaatacattttaaaatttagtggatcagtcgcaccattcatatttcaactgttcgatagccacaggtggccagtggctacttcattagacaaagaaacgaaagatttcccatgtcacagaaaattttattgaacattactggtctagaagtcaccttgaaatttttcacatgttgagtatatccataaaagaccctaaagtaaaggtgggacaattcagtccacgaattaatctgacttgcaacaagtatggaaaatcttatctagtgagagcagattaggcttcctaaaagtcatacttaacccagtttatgtcatttcccaagaccttctgaagctttctgcttttgctttacaacctataaaaaggattgtgagctgcaagaaagaaaatgaaataggtttattctgctagctaagcacttcagcaacagcttaagatttactttgttattcttcttgaaacttgactgatttttgtgaagtctttgcagaattcccttgcttttcagaattctttcttggttcttatttttaatggaactttactatttacatgtctatctttttgtggattcttgacattttctgcttgctgcattgtggtacctgagggggatgtttttctcctccatatcctgattctgcctagtggtttttcatcacttctaaattccatttcaaattaacagattgtgtcgcttgaacccaggaggcagatgctgcggtgagccaagattgtgccactgcacttcaccctgggcaacagaacaagactctgtctcaaaaataaaaataaaaataaagagaatacaattaaattaacagattctgtaaaaacctaatagatacactcaatagcttaataacctaattgaaaatattttactcatggtgtacttaatttctaaagatacataatttaaaaaccaactaatacaattagcagctctaaaaagaagtttgcaggtataagtcctaaatcttatgcagaagggttcttttcctaaggtgtttaattatgttcgtaagttcaacatcagttgccggagggtttttgccagaacatgcccacctcttgcagctcccctgaagcagtatgtatatgtatattacagattgcaggtgtgaaacatctattattcatctcaaaatagtaactttgggcatttttcttgttattttttaattgttagaatatttaatacgaatatttaaatatgccttttgtatttcagtaactcttgcaatagtagtttttcctagcagccaaattaaaatgtgtaacaaaaaatatgtattctactgcaaggatgacagtatggaaaataatattactaccttcacaaagagcaaagtaagagttcttattttcagttatcaatattttttaaacatctgccattttctagagatgactaaggacactctctgaatttgtctggattctattatccaaatgcactctgacactttttaaaaaataaataatgtcactgttcatggtacatagtaaagaattactattcttagactatttccaaaatatgtcttttactcagaagaaaacttagttttgtatatttcttccagaattatcatagatttttctcaaaatattatttcagggaaatgcaaaaatgtgctggaaatgtgttttcaaactcacctttaggagtgaagattgtacttatttttaacaaaagccccatattttagtgattcagttcaaacaatgttaagtttctttttatccactcatagaaattagttcctaaatggaaagataaaattagcaggaaagtaaacaaacaaatggatagactctagaggattctacacactcacatatacctatttcgtagtagatcacccatttttctatcactgtcttaaaaatatagcccataaattacctagatatgttccttcaaaatgtcaagtatctggctaattgggactatctgaaggtaacagactattacttttcatgctagtacttggctttgtagtcattacatatatatacatgaatcttgggcaaagttttacacaaaaattaatatatgctgtttaaatttaaaataacagggcaggcatggtggcttatacctgtaaacccagcagtttgggaggctgagttgggcagatcactttagctcaggaattcaagaccagcctgggcaacatggtgaaaccctgtctctaaagggaaaaaaaaaaaagaatgacactaaaataacaaatatttgaaagtcatatacaactgcatatttatggaagagccccagaataataacttttttaaatataacagaaattgtatttatgtactgaacaggcaggtaatttatcagatatgcacaccaatgcaacgtataagtactgtgtaaaggattcaccatttggggaaagagctttgttaaaacagtgcaatgcaaagcttacctgcttcttaccggtattgttttcaatgaattactacatctaggatcaaggctactcttttttttttttttcaatttttaaaactatttcaacagatataaaattatcctgtcaaattgctattaaaagtttctaagcactaatctcttcatggattggtacccaagagttggtgaagcagctctggtcctcagatcacacttttaaggccactcttaataagatcctcagtgacagttgttttcctgtccgtttgttttatacaaccatgttttatgtcagttgtcaagaactgaatcaaaatactgtgaaacctgttctttttgtgaatatcaacaaaaccactgatgcagattattcattattctgaagagaaatgaccaagacgctatcgattgtgccttgctcttaccgtctcttactatctccgtgcaataatggtcatgcctgctatgtttcactttatgaaaccttttctttcccaggccagactagccttttagagaatcaaatgaatacatgaataaggtccagggtgaaaactcaaagaagtctttagttgaagctgacaaacgactttacactggtaccattggctaattctatcccctcctcccaccctccctgaagctgctagggagaggtagtccaagaaacaggacagcctctgtacatccttgagcaactcatattccctcttcaagcctctgtttcctcactggcaaactggggatggtaatggtattgacctcatagggttgtagtaaggaatgaataaatgaataaacatttgcaaagcacttagaacggtatacacggtcagcactatgtaaatgctaatattattacccttgagttgtctggactccttatgccttccagcatgctgcctccactgcccgtcctctgctctgggtcagtcttttcctttctgagctccacccgcttccatgatgagtcacatgagaagagcactttgttctgtctttgaatcagggtgctcccatcttccaaaacatacacagcctcacctgcttgcatctccttcacctggaagcacttgccattttccccttgaagttaccttcccactacctggactgagaaattactcagagttggaagagcagttttttttttttgaaacagagtttcactcttgttgcccaggctggagtgcaacggcgcgatcttggctcactgcaacctccacctcccaggttcaagcgattctcctgcctccgcctcctgagtagctgggattacagacatgcacgaccatgactggctaattttgtatttttagtagagacaggttttctccatgttggtcaggctggtctcgaactctcgacctcaggtgatctgccccccccttggcttccctaagtgctgggattacagacatgagtcactgcgcctggtctagaagagcaattttttcaaccatgaagagcaatcatgagccaatgttccaagtaaatctcacctcttttctcctcagggtgagcttgctgccttcccaggcaccctctgaagaagcaacaggataatgaaagggagaagttagctcttccctctccctccctgacccttgtcgaagcctgactatagactctttaaaactcttcccagcgttcagtgcatgcatttgaaaaataggtcttgagcttcaactgtgcaccaggcacagagataaacgttaacaaaaaagatggatccctgcttagagttgtgaggaactaccagaaaagtagagtcaattacaatgcagagcagcatattactacagtgacaggacggtttgggccaacctatatcggcacttttggggaaggtggcatttgggaagactctaaaagaaagaaaagaagaaatctggtagatatgtaggaactagccaggttactaaggaggatatagaggctgggcagagagaactgcaattgcaaagaagcagaagtgaaggtggcattagaaagcacgggtgatggttgaaggtggaggacaaggatgaggagagtaaggctgaagagaagagcaggaaccataagaatgagcaggaatgtgggggattctaagtacagaaatgaatttatcagatcagtgcatgatatggtttggatctgtgtccttgcccaaatctcatgtcaaactgtaatccccaatgtcagaggaggagcctggtgggaggtgattggatcatgggggcggatttcccccttgctgttctcataatagcaagtgagttctcatgagattggtggtttaaaagtgtgtagcacctccctcccgcttctctctttcttcctgctgctccggccacataagaagcctgcttcccttttgccgtccgccatgattttaagttccctgatgcctccccagtcgtgcttcctgcacagcctgcagaaccatgagccaatgaaacctcttttatttataaatttttcagtctcgggtatttctttacagcagtgcaagaatggactaacgcagtgcttcatttgaaaacttggaaagatgactctgattgcaatgtaaggaatgtattgggaagagagaactattattacaatacctggatctgctggggcctgagctgggcagtcatgatggagaatagtcaaggatggatttcagataggatttggatatttactgattggagaggatggagggaaagaacaggaggaatcaaggatggcatatctggaggatggtgagacaggctggcttgaggggagatggtgcattattgtgagtgttgagttcaagcagtcacagtagggctcagcaggtaggtggatctctggatctgacacccaggagagcagtctggaatatggacaaatttggtagctgtcagcacagagataaatggtttgtggaagtctcaccccagggagtaaaaagagaagatggtcaacacagaagtctaaggctcacaaacaggagctgcaaaagtaagaatgctctgaaggagatagattcaaacagccagacagatggaaaaccaggagagcgtgacagaagagaagccagaggaagaaagtgtttcaagtaggaggcagatgtcaacgctgttaaatgctgctaagaggtcaaagaagataaagagtgagaaggtcctttgaaagtggcaacaaggaggtcatctgtgacttcggagaaaaattcagtagaaggaaaagggtttgaagccagatggtaaatagaacacttttttaaattaccagaatctctcactctaatatgaacatagatgaagtgtcaagaatttctttgtaactagcaaaggctcatcaactcttctaaaatagctcagatctgatcagtgaactgaagaaccactaatgacatttcagagttcctgaggtggatatgcaaatcaggcctcactgttaccctgggttgggtgataaagtttttcagttttcttgcccctgtgttattcctgttctgaaaggcatgtatgggaccattatcttgaccatccctaaaatgcaatctcagctgtgaatccttcttgcatctcacttcatatttcaggcaagaatactccgcaagtaaagaagaggcacgtgtttgccattgcgggttttgttaaatctacaagctgtttaatcatcaccagttcttaattttgctgatggcatctctgctattttagcagaggtgatgagtctttgtttgcaagtcactattaagacattcttgacagccaatctatgacatgttacagtaaaggacgctgctaaagaacattttatggatcatttagcacatatctttaaaatcagctaatatactccctggaatgttgtttttgcttgtttttgttttgaaggtaattagttgtggctacatttgctccgaggctgtgttaaagtagtgttttcactgaagatgcacttactttgtagcatgtgagatattaaaccttttctttggctataatttaaactgagttttctattatttgctaaaaatatagaatctcctattccatgttaaaaatattttaaagtagtcaacatgtatagtcaatttatttatttacttattcatttcacactttattatttggtttttttttttacactttaaaatttatgcaagattttacactcctaggaacacaaaatccccaaatttagtcgccatatcaatgcttacaaattcctggcaggaaagacttcttcggatctggaagttcttgcttgggttttactactcttatacccttaaaagaaaatccaacaaaaatctacaggaggggccaggtgcagtggctcatgcctataatttcaacactttgggaggctgagctgggaggatggcttgagcccaggagtttgaaaccagcctgggaaacatagcaagacccatctctacaaacattaaaaaaaaacaaaaactctgcaggagagcctactagatcctgcatataaaggacaataatggcaagcattaggagaacaagtctactctcagtggtggaaacagtgtggccacagaatgtctgaatgtcctaagtgagccaaatggaatatctgcttgcccctacagtgagaatatcagacagactgtacacacgtggagctaatttacatttctctatcaagagttaaaaccaagaaaatgagacagatcagtgcatccagggactcctggggttccttggtcttgtctagtaacccgatctaagatgaaagaagagtagaggaatcttagatatataattttataacttgctttgcagattataaaactgtcagagtttaaatactgtaaacacaaatacaaatctatattgttgaattatgtttatgtattaacaagaaaacaacattaaaaagtattctaaataactaacacatatgccttcaatagtgacccaaattatcaagctctgcagccctagttgtctgctggatttgtcccgtgatcaatttcgagtgagggctgcctcaggggaaattctgtgatcaaaaggctctgggtcacctgaaggatgagccttggggtccgtgcttttaagacagataaatgctgtatttctcatggagagtcagaaatcagaagatagaattttccaaactggaagagggagtatttcagtctgttttctgatgtttataacaatatctgaaactgagtaatttataaggatgaatttatttcttacagttatggaggctgggaggtccaaggtgggcaggtgtatctggtgagggccttcttgttggtggggactctctgtggcaccctgaggcagcacagggcatcacatagcaagcagagtgagcatgctaagtgctaacttaggtctctcttccacttcttataaaaccaccagttcctctctcatgataactcattaatccattaacccattaatccataatttattcatacagccagagtcctcatgatctaatcacctcttaaaagttccacccctcaatactgccacattaggcataaaatttcaacatgaatttcggagggggcattcaaaccataacagagggatgtggaatgcatgtcggtagtgtaaattaacccaaataaccaacataaagtgaggggttaagggggagaaacccacatccaccccacaaacataagatctgcaatcacaagggggccattcagcaaccttcagaaacttaataatatccccataaatgagggtgcagagtaggtaaagcactgtcatctcctccagaaatcatttctgatcacctctaccagtctgggttaaacacccctcttctgcattcccatatcaacctgggcttcccaccaccttgcacatcacaaagtgaattttaactgtctgcctacttgtctgtctgccctactagactgaaagtgcccaagcaataggatttgtttcttcattgctgtatccctggcatctagcacagaagctggcatataataggcactcaataaatgtttgatgaatgaatgaatgaatgaatgaatggacaaattctcgagtcccactcatcaggcatcactaggggaggcagccacatggagcttatctagagagctccaagctctggacaaatgaaactctcaaatcctatcagagctcacagtcgcagcaaccattgtcttgcaccatgcttgtagagaggaagagaccaaggaccaaatgatcattgtcatcacgtaggaggcttctttaactctgccagcgcccagcagttaacagttcagagcctaacacaatactcagcacaacgtcataggtactcaatgaatattcattgaaagaatgaatgaatcagtcactttagcacttcctttcccttccaaggtaatcctttgaaaaattaatggaacttcttaactacttcttgcatgaaacttcagacctcactcaaggacggggaagcatttcagttctgattagaggtctgacaccaaggcacactaatgccatgtcaatgggtctgacatgtgcgacttagaagattttgcaagctggcatgaatcatgatcacttctttgcatgagagcagggattgttccacccccaacacactccaccaccacatgccaccatcaccccaatcctgtctctactccagtggctctcaaccttggccacacattagcatcacctgaaaagttttataaaatctttggaccatgccctggaacaattaaaacagaatttctggaggtaggacccaggcattttttaaagctccctaggtgattccaaagagcagccaagcttgggaagtactgctgtcttgacagtcaatcaaactgcctcttcagttcacagttggctgagccctctccgcccttgcacatggtttggctgctggctgggtccgtccatctgtttggcggtggcagcagtcactgctgcttctgttttctcatcgttcttatctctgcatattcatatgcaatatttttaccctaatttagaggattggaataagacttttgtaagattttagaactcatggcagcacaacaaatgcacctacatttccttataagtgcacatgtgttcgtgtgtatatatagatgtcgtctacccagagtttcactttgctttagttatttcttcatgctcagaaaattgtatgagcagacttcagtttcaagaggaggtactagtttaggtttgtgatgaatcttttacaccctctagtggtactgctggggcatatcagttttgtgcaatgggtttattagactcctagtctcttcataaccaacagcatcaaaggagactaaccttagaggtcttttgctctttgctgctgtattaatcccagtgatgcaatctaccctcatgaagaaaagaagcagatgagtatgtaacttattcctcagccttttgctggtcctccaaagggctcgtcataggtacttaatgaatattcatgaaagaaaggatgaatcagtcacttcagcactccctttctcttctaaggtaatcctttgaaaaattagtagaacttcttaactacttcttgcatgaaactttagacctctctcaaagaaggagagacatagtaaaaacaggacattcacttagcaaaagtgtattgaacacttactatgtgccaggcacatgtgagtaaaaacaatcatatcatatcaaagtgtctttttcattgttgttattttgtgttaaagtatgaagatcttaatgttaagacaatagaggaaccttatgattaagagctcaaagctggagccaaactggttcacgtcctaattccacaattactggatgtttaacatcaggcaagttacttaacctctctgtgcctcagtttctttatctgcaaaacagggatggcaatagtacccttatcataggattatactataaagtgctatctaatattatcattttaatcattaaatgtatcttaaaggtcctaatttaactctagaatgatttgcccagaaattcctttctagtaggaaatacacaagtcatatcaaacttcttttgtaagcatgtaagaggccaccaaggtcttctgcttcttccccaggccagttcatgggctttcatttattcttggcttcagggcattttctcttagctcttcttatctaaaccaggggtcagcaaactatagccaggggatcaaaatctaacccaaggggcttgtttttataaataaagttttattgaaatgtagttacactcattcatttatttattgtcctatggctgctcgcatgctacagtggctgacttgagtagtttcagcaaagaccatacaacccacaaagcataagatatttactacctggccctttatagaagaagctttctggcccttgtctagactctgagtcgctctgggcttgctcccagctgtgtttagagagtaagacacagaaggtctgggctagcctatgtgagaactaagcatgaaaccaggtttcactcttctacctgccaacaaggactcccctactcctctggtctcccctccaccccctcatcctgtagttaaagcccttagtatatgaaatgcaagtcttagaaaaaaaattgaagaattgaaagaccttttgaattcgtagttgatacctactttgggacattttcctcaattttcagcacccacatattttttcctggtgtctagaattattgaactctgagcttccttgctccctgcaagtaacaagataatggcctactctctcctcttatcaaaggctaattgggtagctttttgctcatgatatacgttgggaatatattacatatatttgctggaaaatataccctgtaaagcaaaactaacagactccaatgagactgatgtatatatcctacaaatgaggtaaagtaagcagacagcccctaaaatttgtgataaaagggaaaacattacaattactggaggtaggtaacccatattagccatggactgattcccagaagggaccttatgagagaatgcaggtggccaggttgaaaggcagatgttttccaagtatgggatcccctctggaaagacaaggacagagatgaataaatgactaatgtggccttggattcatttgtgtgagaatgtcagagcatacaaggcagagtaggaggtcagatccatagacagcctaaacattctccttaatgtttacaaggttgcctgcctgggattcactctgtgttgcagcactgtgagtggaatggtaaaaatgtgagccttggcatctgcagtaaccttgttcttactagttctgtgaccttgaacaggtaactcaacctcctgagctttacttgacccaaatgtcaaaggtggaaaattcttagagttttaagttgacagaatgcaggtaaagtacttagcactgcaccagccatccagccaagcacaactcttggagacccactcaacattaagttgaagagagcaagatctatgtcttgttcacctttgtatccccgccatccagctctgtgtccagcagatggatagtgggtgcccaggttaagttcattgcatcatagagacagaggcagttccaggcattccaatgatgaccagagaaataagaaaatgctgcagggggcaaggaggacaatactaaatactcagagatgctttctcaaacttagcttggacacaaattttcctctctctaccttctattttgatcatgaaaatcgtgtactgtcctgaaagaagtgagaggggattgggtggaaagagggaggctgagataattgaataatgtaaacatgtcaagttatgtgaccccactgacctggcatcttcattcacagagtatgatggctaaaacaggagccccagagagcatccctcacacctggtcctgcttagagcaagacaggcacacgtgatttttggaagcactgatagcaatctcctaggaatgaaaaactgaggttgtattctttttagactctagccacatgttttccactgttttcttgatggtcttataatactgtaaatttcattcaaccaatataattccatcccaacaggctcttccctctcttttccctggacagttttgttttgctattaggtctttctttacttttgctgcttatcatgttgtagtattacatatttcttgacttccactgttcttgcctttctccttatttcctcaaaatgatatgttgttgcttgcaatgctgttgctttgtgtgatcctaattacgttagcaatctaaggaaaaagaaaattatgttttcatgattttcagtagcagttctatttaaatgacttttctgaaccccacatggtcctaactattgaatgagtgaacatttcttttactttagaaagtttttttattcatggaggaaactcagaggcttatgctctttctgaaatgtgcctgaagaacttcaatctattctaaggcattctttttagaagatctgtacaagagtctgccttgtcacagaacacaaacatctttgaactatggaatagcaaatcctcatttatttcttcagctagcatttaatgaaccccctaatacttgccagggattatgcagatgctgaagtaaagagcacagttcctggcatgaataaattccagtgggtgagacacactgccacagatttagctacctcacagtgcatttgaaagcacagagaaagaccatctaccccagtgagggtggttaggaaagatttcctagagcacttggtgcttgagctgaatctggaacaattagcattttaggtagagtgcaaagagacagaatcctgatgaatgagcactttggtgacaggaaaatccagatgggctggagagcaggcagcatgcagaggaatgactagagatgagtatttggagagagaaggggggaattctcaccattcactaccctcttccttctagagttgcccgaagtctccacagtagagcttctaaacaaataaacctcccatgttcattaaactctgggccaagttttgggatatgaagagtagaagacataatccctgcattcaaggttctcacacagtctggtggaggaagctagaatatgagtaaataattacagtgtggtgtgttaggtactaagctagaggttaacagagaagtgattaactgttttgttggaatcataaaaatttctatgaaagaagtgagctttttttgagacaaggtcccactctgttacccaggctggagtgcagtggcaagactgtcaaggctcactgtagcctcgacctcctgggcttaagtgatcctcccacctcagcctcccaagtagctgggagcataggcatgtgccatcatgcatggttaattttttattctttgtagagacaggggtctcactatgttgcccaggctggtctcaaactcctaggctcaagcaatcctccctcctcagccccccaaagtgctgtgattacatgtgtaagccaccacacctggccaaaagaagtgactttaaaacagagttttgaaaacacagcaggatttcaggaaaaagaaatagcaaatggaagtaattgaagtatataattgattggctagggtttttgtggacctacacatactttattgttgctggaacctaaagttccaaggacgaagtggaaggtgatgaggcaagagagatagaggccagtttataaacagccatataggatgtgcttctaggagtttgatgtttatcctataggccagggaaaaccagtgaaggactttaggagggaggtaatatgcccttacttgcattttgaaaggtttgttctttctaagcctatagcagtggagatgcaaatgaggggacagctttgagagctattaggacatgcctagtcttcttttaacgaaagtataatgacagggtcatcattctttatataaatcattgatttcaaaaatatctatgggccaagtgcagtggttcatgcctgtaatcccagccctttggaaggccaaggcagatggatcacttgagctcaggagtttgagaccagcctgggcaacatagggagaccccccctatctctgcaaaaaatataaaaattaaccggtgtgggggtatctccttgtaggcccagctacttgggaggctgagatgggaggattggcagatctgggaggtcaaggctgcaatgagccatgattgtgccactgcactccacctggcgtgacagagtgagaccttgtctcaaaaaaaaaaaagagaaaaagaaagacagtctatgcttttaaacattccctccacacttataaaccatagaacctgatttagaactttcatatctcactttgaatctctttaatgtttttgttttcaacccacaacacagccagttgagaaaatctatttgatctccatcttcaaaaacttaatccttaataagtaagattttttttagcatcagtaatgcactggtaaatgctgaacaaccagctcttcagaaggaaatcctgatttgtattgtttgccaatttctgtagtgtaaatactcctgtcatagctgttttcaaactaccaatgtgacatcactgagcaggaattgagaagacgagcaatattacattattagatagaatttccatggtacagacgcaatagatgtgaacaactcaagagcctagagagtaacatacagtaaaataattaggaaatggtgaggtttgagtacatattacctttatttttaatataatgtacttgattgtaagtctatgtaatttaatttttagtaacagctgtatttaataaccaccaaaattctttttttaaaatactttaagttctagggtacatgtgcacaatgtacagttttgttacataggtatacatgtgccgtgttggtgtgctgcacccattaactcgtcatttacattaggtatttctcctaatgctatccctccccctgctccctaccccatgacaggccctgggaagtgatgttccccgccctgtgcccaagtgttctcattgttcaattcccacctatgagtgagaatatgtggtgtttaataaccaccaaaattcttttttttttttttttgagacggagtcttgctctgtcgcccaggctggagtgcagtggcgtgaccttggctcactgcaagctctgcctcccgggttcatgccattctcctgcctcagcctcccaagtagctgggactacaggtgcccgtcaccacacccagctaattttttgtatttttagtagagatggggtttcaccgtgttagccaggatggtctcgatttcctgacctcgtgatccacccgcctcggcctcccaaagtgctaggattacaggcgtgagccaccacgcccggcctaataaccaccaaaattcttaaaagtagtcagtgcttgggagtcaatgcaaggttgctccaggcaccactgcacatactcctcttttctaaataattgaaatgatatttattaatccaattttcactatttaattctcatacataaagtaggaaaatctgtaagtaaagcactggaaaaaaggcaataccacctgaagagtggtatgatgtataaaaataaatgataaacctattaagagttttaaaatctactctgttttgcatacttatcattatgtgagtatattgaaataacataaaagataatcagtttcatttttagtattgatcacaattataaaccatggattttaattttaactttagctagctagctcataaatagcaaattatgtaagtaaaaatgaaattatttaaggtttgcataaactatgactgcgtgagtgctagagtgcaatattatctatcaaatgccttcaaaatgtactttctgttaaaacatctctgaaaggaagagagaaaagcaacaagcaacttttgatgaattatctgaaagagctcacataacatcccaccaagaaaaaatggcagatccccattagggcaaaaaaggcagttggaagtatgtaggttcacatctgggcagatgcgtcccaaaccacaaatgtgtgagctacagccagagagaacacactgacgtatgctgtagcttgcgcctcttctaccaccataggaaagaaagaactgccaaagatcccactcagacttctcaattctccagaattgatgccatgggaaaaccaggaggtaatgtggcagtggaaaccagacagatctgggtggaatcctgattttgcctaataccagttgcttgttttggggggcaagttacttaagttctttgaacctcagtttcccaaaatataaataggagaaaggaatatcttatcaagtgctattgaagacatacaaagtacttcacataacaagtggtagacagatgttatgaaaacacaaacaaccacacaacaacagcaaaaccaccttgggatatatgaagatgattttccttttttcctgcccacccagtcatcattagctactttgaagacagcaaagaagggttctaggctgttagattagctcttctggttttattcttaatatgactcaggttagagatcttctctttatctctttctttccttcctcctcttattcaacaaatattttttactgtgtcagaaactgtgcgaagctctaagcacacaatgtcatagtagaagtggtaacaacaatagctaacttttattaagcactgactgttgaacaaaagacatctaggccgggcgcggtggctcacgcctgtaatcccagcattttgggaggctgaggtgggcagatcacaaggtcagaagttcgagaccagcctggccaatatggtgaaaccccatctctactaaagatacaaaaaattagcaggtatggtggcacgtgcctgtaatcccagctactcgggaggctgaggcaggagaatcgcttgaacctgggaggcagaaattactacgagctgagatcatgccattgcactccagcctgggtgaaagggcgagactctgtctcaaaaaaaaaaaaaaaaaaaaaaagacatctatgtctgcctttacctaattgacagtctggtatatggaaacagatatttacataattgctcaggaccagaaatttcacatgtaacatattttgttatttttctcagtttttttgatacaggacactaagactctatgaaacctaaatgctggtaaaccaatttggaaccaaagctcaatactaagaggttaaattaaaacactaattttctttactttctgctgaataattttgcttaaatggttttggggggaaatacaaaacctatactgaataaagaagagattggtgaaaaatatgtggttagagaaagggagtaagaatattacagataaatgattcaggaataattaggatataattaattgaaagttaataatacaattgcaaggtagggtttaggctttttaacctataaaacaatttggattccttgaaatcagctgtcacctaagatagacaatggatgttttctttttcaactttacatttgttcctaatcttcccactttccaccaagtgacaacaaattttgtctcttagtgactgattcccagcctggaatctacaagtgtgataatggaagtctatgggccatttagtagctgaaaaacaccaacggatttaaatttacctgcaataaggctacacaaactaattcaaatgttatgtttctctgctttcatcagaaattgcatcaagttattgcaggaactagttatcttaggcagattagctattgatggcatcatggaatttgttgatgaaatatcattgtaaaagatggggcccatgttgcaggaggcattgttataagaggtccctggttctgaaaagcttaggctcccaagcttagttaagaaatgtgttatggcaggacccagtggctcatgcctgtagtcccagcacttagggaggctgaggcaggaggattgcttgagcccaagagttagagcctgggcaacacagtgagacctcatctcaaaaaaaaaaaaaaagtgtattatgtttaaaacaaaaagaacttggctagctaatccagcagtattctgcaggaataatttatgggaaaaaaaaaacacaaatttccatattaatgtacatttctctagagagaatagagtgttttgcaaacacatttgtatctcaaaaatgcatgtagttccataaaagaccattttaacagcctttatattttttaagggatgctattactagatgttgtatcttggacttctggagattgcatggaaaagttagaattgcattttgactttaacttacattcagggtttcaacggacattaaaaaggcaaaacacttagtgttcagcctcttttttagtgtgtttttctattcttaaggtgttgtctcacatgagatgttcttaaattgtccactgtaatctcaggcttttatattacacatctgcagaagccaaaaataatttgatgcatgacttttccccccagagtttcttattatatttactggtaaactattttggtaacttatattaacagagttataaagattaatatgtaatatgttctcatacagaattatgaaatttcatgttgcaaaacggaagtttaaggaaacattacgtccatatgatgtaaaagatgtcattgaacaatattctgctggtcatctggacatgttgtgtagaattaaaagccttcaaacacggtaagcaatggaaatgtcattccttgtaaaggaatgggcatagaacctatctaggaagaacttctctttagtagagtaaacctctgaactccatatttttcattcatttttagtgggcaaatggaatttgctttaaacattgattttattttgcttttaacatagatataactcaggcattcaaagcatccaactgtctcattttccttatctgtaaaaatgggaagaaagttagttcttgccttatagggttgtcatgaggattgaacaagttaatgcatgtaattcataacatgtaacaggcctggtactgtgtctaataaacatcaatggttgttgctgatgtttgaattattactgctgctgatcctaaattatctaaattccatttattatctaaattctaatcatcctttgggaataacgtactatttctccttcattaagtttcatccaaccatccaacctgtgaagacgggcctttctctgacctttatacagtagcagagtctactgcagagcacaagagcactcagaatctcggtgtgctgggccaaagttgagacttggcccttgtgttgtttcctggttgcaagtgtgttcaccttgctctggactaagactgaggtccttcattcatgtcctgtacggttctacaaatatactatcctcctagtagcatcttattgagtgattaaaagaaatgaattccacatgttaattccaaccacatatggttgattgtgattatctcaaagccaaaatattcagtaaattcagttttttaagagccttgctttattaccagcacaaattaccagcatttgtgattgtatagtgcccaaaatgcaaggactgagacttgaacttttttttatgccccccagcacacttagcccagtgtgaggcatataatgggcccttagtaaaatacctgttcatcaattgttatagaaataacaatttgttaattcatttagcaggtaattattgagcccatcatgtgtgccaggacctgtggacatccagagattgataaaataatgacccagaccttgtagagtttgcagtttagtaaattagatgtcatggcaggaagtgagtactgcctatgtttctcttcagacaaagtaaactggaaagttgtctatactcttgataattcaattctaaacacatacaaaaaaagaagaaagtgattctcatttaggctggtcaagttctcttggaaattgctttaattcattctgtaacatctgtaacatgaccagagattgtggtcatattgcaatctctgcctagatggccatggccttctaagttctttaataaaactgtctacagctcccaaggttttataaagttgaactgctacagaatttatagaaccaatcttgggtttctagctcatgtatcttctccaacttgaactccgaaagaaaaagaccatggctttcttatctgcttatctttcacacatgtacaatagatgctcatagaataatctgttctattaatgtaagatctctatagttatgatttttgtcatattttgaaatggttaaattcaggaactgcctgatcagaggtagaaacatattactttgtagtttaggacacttttacttccagaagatcacccataagtgatttcatcttggaccagaataatgagaaaattaatttcatgtgtaatctcatgttcaaataagcatatcaactggaacaagttctttcttatttcatcttacataaattgaagataactgtatttaatttttttttccaaaactcttcattctgacctagggcaatctccaccttcagccctcataatcagatctcctctttctctgatagtgttgatcaaattcttggaaaagggcaaatcacatcagataagaagagccgagagaaaataacagcagaacatgagaccacagacgatctcagtatgctcggtcgggtggtcaaggttgaaaaacaggtacaactcaactacgctgggtatctttttagccagaatttttttaatcaaaatttattataggcaattgtatgtattccagtgattattttaaaataaataaaatcacaaaaagagtgaataaaattaaattttctttgtgtgtagacagtgctctctgaaacactctggatttccctttaaggaatagaaaatctcatctcatcaattaatagttaattggaaacaactatagatttccaatagttgaaaatcgtttaaaaataacaaagatctattcttcatttgtgtttcagttgtttttattgtttcttttttaggtcattaatttttttttttttttttttgagacagagtctcactctattgcccaggctggagtgtagtggcatgctcccagctcactgcaacctccgcctcctgggttcaagtgattctcgtgcctcagcctcccaagtagatgggattacaggcatgcgccaccaagaccggcgaatttttgtatttttagtagagacaggtttcaccatgttggccaggcttgtctcaaactcctgacctcaagtgatccgcttgccttggcctcccaaagtgctgagattacaggcgtgagccatagcactctgcaggtcactccttttaaaagtaaaacaaggccgggtgtggtggctcatgcctgtagtcctaacacttttggaggccgaggcgggcagatcacaaggtcaggagttcaagaccaacctgaccaacatggtgaaaccctgtctctactaaaaataaaataaaataaaataaaataaaataaaataaaataaaatataaaataaataaaaataaaactttattataattctgatgacacattgaatgtttgttaacctcaagtctgttgcatcttcatatacaaagacaattttccagaaatcaaatggctcccccaatttaataaaaaatacttcatatattaattccggagcattttgtacctttatttttttatgtaactttaaattcagaatcacctagattgatgcttaaggtattggtttcattatagaataagttccttactagatttctgtagagtttcagaatgtcttcatagaggagacttaggaaagacaatctgacaggaatgggaagtctttttttttttttttttttcagacagggacttctctgtcacccaggctgaagtgcagtggcacaatcatggctcactgcagcctctacctcctgggctcagtcaatcctcccaactcagccttcctagcagctgggactatgggcatgcaccaccacacctggctgatttttgtattatttttggtagagacgaggtctcaccatgttgcccaggctggtctcaaactcctgggctcaattctcctgcctcagtttcccaaagtgctggcattacaggcatgagccactgcacccagcctggaatggaaagtcttaaagttgcatttttatagtgcttatatgacttttaagaggcactatttaaagaagtggtgggggagagatgctaataaagactgtatagaagccaaagtgtccctctcttcctaagtcctcctctggccccatcattgctaaatgttacattcactaagggtcaagactgcatcgtactttatattcaatatttctttaaatgtgttggcacaccttgacttcatttttcaaaattaaaaaatgaagtccattcttaataacagattatactcatgtgtaaccattttcctcacttctaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacattaaaaagatgtctataa

SEQ ID NO: 1609 - DNA, 577003 bp, Homo sapiens; identical to SEQ ID NO: 1608

SEQ ID NO: 1610 - DNA, 577003 bp, Homo sapiens; identical to SEQ ID NO: 1608

SEQ ID NO: 1611 - DNA, 577003 bp, Homo sapiens; identical to SEQ ID NO: 1608

SEQ ID NO: 1612 - DNA, 577003 bp, Homo sapiens; identical to SEQ ID NO: 1608

SEQ ID NO: 1613 - DNA, 498224 bp, Homo sapiens
agggctgcagtcacggggcggcgcggagggccccagcccagtcaggggtgtggccgccgccaccgtaaggctaggccgcgagcttagtcctgggagccgcctccgtcgccgccgtcagagccgccctatcaggtgtgtttgcagccgaactggcagtgcccgcgggcggctgggccgaggccttggctcctacccgcgggggtcgggcgggctgaggctggagcaggccaggggcgggggcagagggggacggacttccagcatcgctcattcgggggcgtgacgggaggacctggctggggagcggcgggttgggagcctgtggctgccccttcggtgacagtggagtcaccgagcctagaaatggggaagctgtgacgtgggggtggtggagggtgctgcgggacagcagcgagcacggccctcagccgtccttcccaacacggtttcacttcccctcagctccagggctcagccccaagccgcccccttcatcccccatctgcaaacaatcctggtccccctgagcctccaatatgccttatgcagttcttttggggttcctttcgcattttaccgtgtactttcgcttttgatgcgtctagtttctgctactggactctcctagaatcgaagttccatgagggcaaagtcccatctgacttaggactcagagctactcaataagtaattgaatgagtacctatgccgtagaactgagtgaattaacaaatgagtaagtgaataaatgagtgcatacgagatacagctgaatcaatcagtgcatgagtgaaaataaagatgtatgaagtggaagcagtggagacgcaggcttacaactcctgttttttgatagctttccaaaaagttgtgtgaatgtcgcacttttgcaaatggaggcattctgattgggaccacttaaaaagagttctatgctgttcaaatggtctctggaaacgccccctggtatttccatttttgttggacttggctatatgtgtttgcttaaaacaaaatatgcctaggttttttcttgcttgtgttttgttcacttctactttggacgtttaaagaatcattgtcactataatattatttcatgtatttcttaaagataagggtgactctgaaggcagaaccatatgactctgacttgtttgtaaaaccaggcttttcttttgaattcagagttgttaagaatcttgtctgttttcctgagacaggtgctggctgatttgcaggtgactgaagaaggctacataaggcccagaaagacgcttatctgtttgtaaacaaataggcttagcacatagctttaatacagttggtcactgcagccgttcttacttgccaggtccaggttccagaagagctggatgaccttggacttgccacttgatctctttaggttttaatttcttaatctccaaaatgaagatgtttagctaggaaccctgcctgagttaaacctctgggattcttttgtatcagggttagaaggtgaaattacagatgatttcatggagttctgcttacttcacctcccatagcattttgtctctgctctcttctttgctgtttacagctcatttcctttcttctccacatctgcaacaagaaagcctgggagctcaagataagtgtaataaaccctaggctggtggggagaaaggagggtaagattttcttctacattgtcacaggctcctggtcctgggtctgacttttttccagtgcaacccagtctgacaatgccatatattcccagtatatctggggaactgcatcactatttcttcgcatgcatttgagattagttatcatagatcacattttggagctggaaggaccttggagattttttaaaggcacttcaaaagtcattatacatacatatttaaatatttttgcatgctacatttaacaaacacaaagttccaaatgtgttaagtaaaatgaaattaatgttacctacttcagtgaattcaagtttataaggagaagtggaatacacatgttgcttggtgaaaagggccaactttctcacactgttttcccaatgaggtcatgtgtcatacaggcatggaatgttacaaagctgatatttatggggcactgaccatacaccaggcactgttatatttaacctttttacttatattgccccatttaatcatcactatatatctaagagctagatactatggtaagtcctatttgatcttcttaactagaaacagtacatggaaaatgggagagttaggactcaaaactcaagcagatggaaacagggtttctcccagaaacaagacaatcctgccaggaaaaactgtgtgactttgaagaatgtggtctctgtgtgtgttcaagcatatatacaaaccctgggttatttgggtaaatgaatttagaatgagagcacagggtgaaatgatgaagactgaattataggggagttggttgttttatcattttgaaaattattgaattccattgagattccaggagactctgatactttgacctaggtgcccatgcatcttaattttaaatgtgttcagacttaccaatttagggaatataaaatgagtgacatcgacagctgccatcagtgaatggcacttaagggctttgaaccatgagtgctaagcagtgttgtttcttggactagctttgtgcccttggtaaggcactgcctcccaacctctttctttataagaccaacaacccctagtatagacaaagaacaatgcctacatctgtgtaatccagagacaagaatgcaggatgggtttccagaacccttataattaattgaagagagcaaaagacgaaaagagaggcccataaaataaatgggaaattattttgtttctttttcgtcagccaagtttagccccatggaaagcagagaccagttgtggccgcctgaaaaactaagagctgatgccagtttgatttagctcaggaggctgaaactttctgccccgaaggctggtgtgatggaatagaccttcccattgctcacaatattatgaaaaaaacattaaagcaacaatttttattacttgccctgcagctagagctttaaaatgtactttcttctcccctaccctccctaaaccacttagcttttaaaaacaaacaacccattcatgtgtttgttacagtcacattattagttctttctctttattcctgggcccttttctttaatgcagcaaagtatttggagggatgtacttgtggatctgtggaattttactttattttattcagaaaatattaatttcaataaccatttattgagtgtatactatgtgacaggtaaagatgaatgagaacaaatctaaataggagagtgacccatctgcaaacaattgcaccacagggtaatgtggaagtagtggccactcactcttccaggaaagaggtatgattggaactcaggaagactttgcagagaaggtgaattttgaactgtgttttaaagcctaaagaccaagcagagggagaagggtattccaagaatggagaacaacaagagcaaggaaaaggaggcaagtatgaacatggcattcttcaggagatgggagttcagtgtggctgtggtagggaggtgtggtaaggttagggccagacagtgatggtccttgaatgtcatgttatttaaactttatcacagtctagataatccttttcagcattatttttgttttgttttgttttgaggcaaggcctctctctgtcacccaggctggagtgccgtggcaagatctcactgcgacttccgcctcccggttcaagtgattctcctgcctcagcctcccaagtagctgggactacaggcacacaccactacagcctggctaatttttttatttttagtagagacgggactttgccatgtgggccaggttgatctcgaccttctggcttcaagctatctgcctgccttggcctcccaaagtgttgggattacaggcatgagccactgtgcctggctcttttcagcatttttaagctgaattttaaacagaggaatgatatgattggattttccttagaaaatagctacagtaataatgtttcagaagaattggggaaggaagagccagaaggccacaggaaaatgaagatgctattgccataggtctaatgaaataggataaggatctaaactaagataggtttgagagactatttgaagacagagcaggattaatgactagctggagctggatatgggaaatatgtttgaaaataatctgaggttttggaattgcttaactgggtgagtggagatgccactaatgagggtaagaaatataaggtgaggaagaagtttcgggagaaagacggtgagtgagcagaggtagctgtggaacatctgggtggagatcccaggatatagccttttctgtagctgtgctgtgatgtcacacagtcaagaccttggccaaacattacaatagggcctcagtctaaaaagacacatcaatttaataactcacttaaaaaatacatcatacttatctaatgaccattacattatatttcaggcaagttattagagaactctgattcttatgtaagtgccagtgaaggaaaaaagattggagactcaaacaatgaggagttattataagctgccaggagaaactgaaaaagagaaatacagaccagagtcattcaaaggaacaaagataaggaaatggcaggagtgttgcagaaagcagtggtttctgaagacacaggtataggcagatatgaaatacagagaagaaatttgagctggcgcttccaaataactgtacttctttaatggtaagatatcccaagctttgatttctcatcttattcagtttgtcaggaagagacaaacaggtgtgggtgctgggcagagggcttgatctcattttgcagagaaagtgtttggagactttgaactaagcaaagagtaacagggaaaataagataaaaatgaaaagggtaatgattcggagaaatttttcagagaatttaaggaattctatgacaaacaggtgttaaagaaaaaggcagatcaacgcagtgttctcttgatatagtggtattagacttccttggaaaaaagattcgcatagcgccttatatttaaaaagcaattttatatttgattgttacaagaacctaggaagcaggtgcagccaggcattattatctttcttttataaacttaaaatctggcatgaaggaggctgcagtttgtttcatggctcagacggctcagatcccatggctggcagggactcagagccttctgactttgggtccattgctttgtccattgtatcaacgccttgccttaccttggaaccttggccttctgcagtgtgcctccttcccttatcatatcatatcacataaatgtaaaagtaaagcagatggtatttgaagaccaaaagagccaagatctctggggagacaggcagtgatgtgaaaggatccttagcactgattatgctatatacaatagggatgttcatgaagagttgtgcatagagtgttatctacgtaaatcaaatgacactttcagtgcagtaggggagtccacaatatccaaagtgttatgattaaattttttatgaggcaaataatccctttataaaatgaacaatcagtcactccttgatatattatctgaataaatccagattttcaaatatggggttgacttaaagcaagatacatctctagtagcctacatctatatttatcatatatgaagatttttctgacttgggtattgaatatgaagatggggatctggagctggatcctctaattgttagagaccatttaaaatacaatggacatcatgacttgcagctaaatccattcagctacctttactgtttaccaagcacctaacaggtatgccattggatggggcaaaactcagctgggaaatggagagagaagcccagcactggcactgccttgagtctgacagttagaccacaagaaagtcataaatgtaaattcaccaatatagtgagccagggtaagaaaactagaaactcttatggtccttgaattctacatcagtattaaaatgaaaccaagtatatttcaaagcaaagactgttatattagacccagagttattctgtactgacaaaagataatctttgtaaggaagaagaggtagttgtgactctttatgcatcaaacatttaaaaatgcatatctttaaaacatgtaaaactaatgattagatctatgagaaataagcgaagctatttgtaggacactttagatctgttgttttacatgacaaatcaagtagacaaagtcaaatggtaatacacaagatttgaataatataactaatgaggttgaataatataatttatgagtgaatagggatatggaacatttaatagtatattttattattaatcaaaaaattatgttatgtatgaatatatatgtacatgatatatattgggatatatatggggtatatgtatgtatatatgtctccttttttgcattaataagttcttttttattttactgtaaattggcaaattatggttgtatatatttatgaaatacaaagtaatgttgatatatgtcataatacaaccttccatacaatgtggaatgattaaatcaagctaataaacatacccatcaccttaaatacttatcatttttgtggtgaaaatatttgaaatttgctctcttagcaattttgaaatatacaacacagtataattaactatagtcatcatgctgacaatataatctcaaaaaatttattcctcttgtttaattgaaactttgaaccctttggcattccccattttccccaacccctcagactttggtaagcaccattctactctacgcttcttagttctgttgtttagattccacgtagaagtgagatcatgtggtatttgtctttctgtgcctatgtctggcttattgcatttagcataatgtcctgcagcttcatccatgttgtcacaaatgacagaatttcctcatttttaaaggcagaatagtatttcattgtgcatatgtgccacctattctttagccatttatctgttgatggacacttcggttgattctataatttggctattgtgaatagtgctgcagtgaacatgggattgcatatgtctctttaatataattatttcaaatctttggctatgtacttagaagtgggattggtggatcatatgatagttctatctttagtttttttgaggaccctccatgaagttttctgtaatggctatactaatttacattcccatcaacaatgtataagagtttcctttacttcacattgtcaccagaatttttttttgtttgtttgagacggagtcttgctctatcgcccaagctggagtgcagtggcgccatctctgctcactgcaagctccgcctcccgggttcacgccattctcctgcctcagcctcctgagtagctgggactaccggcgcccgccaccatgcccggctaattttttttgtatttttactagagacggggtttcactttgttagccaggattgtctcgatctcctgacctcgtgatccgcccgcctcagcctcccaaagtactgggattacaggcgtgagccaccgcacccggccccagaattttgtttttgaggcaggatctggttcttttgctcaggctggagtacaggggcgtgatcttggctcactgcaacctctgcctcccaggctcaagccatcctccctcctcagcctcctaggtgactgggactacaggtgtgccactgggcctggctaatttttgtatatttgtagagaaggagtttcgccatgttgcccagactggtctcaaactcctgagctcaagcaatctactctccttggcctcccaaagtgctggattacaggagtgagccacagtgcctagtacatttgtcattttctgtctttttcataatagccattctaactggggtgagatagtctcattgcagttttgatttgcatttctttgataattaatgatgttgagcattttttaatatatctgttggccatttatatgtcttttgagaattgtctgttcaggctctttgtccattttttaatcaggttgcttgttttcttgctattgagttgtttgagttccttatacagttcatccttgagcaatgcggggcttagcggtgctgactccctctacagttgaaaattctagtataacttttgattcccccagaacttaactactaatagccaactgttgactggaagccttaccagtaacataaatagccaattaacacatattttgtatgttacatgtaatatatactatctgcttacaatagagtaaggtagagaaaagaaaattttattgagaaaatcctaagggagagaaaatatatttactatttattaagtggaagtgaatcaccataaaggtcttcactcttgtcatctttatgttgagtaggcggaggaggaggaggaagagaagggattggtcttgctgtcttaggggtggcagaggtggaagaagcgaggaggtgaaaggcgagggaggagaggcaggcccacttggtgtaactgtctggaaatacataataatttctgtatggctacttttctctttctaaaaatgttgtaaagtttatcttaaaatgtttctatacagtatcagtctttcttctgctatttgcattagcttcagtgcccatatcatagaagcgttcatgtcataaaagaagtcaaatgcagtcttaaataatcagaacgcttctgccagattgtctgatgttaatttgctttttggtacttttatatcctcctcatcatcataaggcactggttcagaagcactccgtcaagttgtcttctgtcaattcctctggtgtgtagtgtctattagctcttgaatttctccaagattcatatcttgacaccttcattcaccaccttttttcccactatatttacaatcgctttcattatttccttgaattggctttgtcataaaccctgtgaagtcatacacaacagctgggcacagttttctcctgcaggaacttattgttggcttgatggctttcacagctttttctataacaatgatggtgtcttcaatggggtaatccttctaggctttcatgatgttctctctatcggggttctctaacatagcactgacatcctttccatagagtactgtgtataatgagccttcaaggtccttatgatcccctaatctagaggatgattagagatgttgcgtttgggggcaagtaggacacttggatgtctttgatgttgaactcatggggttctaggtggccaggggcattgtctaatatgaaaataattttaaaaggcattcccttaccagcaagatactttctgacttcagagaaaaagcatcagtggaaccaatccagaaaaatagttcttgtttaagccaaaagactggtagctgatgtttatctttttccatcaaggcttggaggttagcagctttatagatgacagtcctgaccataaacctgactgcatttgcatgaaacagtagttagcctatgccttcctaccttaaatcttggtgctcacttctcttccttactaataaatgtcctttgtggctttttttttttttccagaatacagcatgttcagctgcattaaaaccctgtttaggcaggtatcctttctcctcaatgattttttaatggctttgcaatatagtttgatatcaggcagtgtgatgcctccagttttgtttgttttatttaagatcatcttggtgattttttttaattccctatgaattttagggttattttttctgtttccttttaaaatatactttctggccatttttctctctcttcgtcttctgaaattatgtgaagattagttcccttgactgtgattgtgtcacataattcttgtaggttttcttcatcttttccattcttttttctttttgctcctctgatgaataatttcaaatattctgtatttagctcattgattgtgctgcttaattgagtctgctgttgaagatttctattgcatttttcaattaagtcattgtattctttatctcttgggtttcttttttattgtttctacttcttctatattctcattttgtgtattgtttctcaaatttcatttaattttatatccatatattcttgtagttcactgaactgctttacaaggatttttctgaatcttttttctgccactttatagatcttcattttttagtctgttattggaactttgttagtttcttttgatgattacagatgctctttgacttacaatgggcttatgtcctattaaacccatagtaatttcaaaactttgtaagtaagaaatgtgtttaataccccagtaaaccaattgtaatgtcaaaaaattatgagttgaaccatcataagtgcagatgctccttgacttacaatggggttatatcctgataagtccgttgtaaagttgtatagttgtaagttgaaccatcataaattggggaccgtctatatttgtaatccttgtgttctagcattggtgtctgcacatttgaagagacagcttcctcctgagtgcagtggtataatgacagctcactgcagccttgacctcctgggctcataagattctcccacctcagcctcttgagtagttgggaccacaggtgtttgccaccatgcctggctactttttgtattttttgtagagaggggtttcaccatgttgtccaggctggtcttgaactcctgggctcaagtgatctacttaccttggcctcccaaaatgctggaataacaggcataagccactgcatccagccccaacagcttgctcttctggtctttacaggtattctttgtcagggattgacctttacttcttagtctaggctgtgattctagttgggtcaggtggtaatgaccccatgcaggcagagctcgctatagttggctgggtgctgcctttgctctgaggtctgatggggctgctggctcggctcccatgcttcggggagaccactggctgagctctgctataatttctgattggacaaggttgtagggtgtacttcctggctgggtggtactacttttttggttcaacagttgagcagggctgcaggctggactctgagtttaggtggagttgctgctcaggatggatggggtctggagtatatgctgcatagaactgcacagttgaggattgcctgtctctgggcagggccttagagtgggctctgagtctggattgagtcactctttggatttctgcgtcaggcaattccaacccctatgatccacagaaatgccctgtgatggtcatctccacatctcccgcctgggtaaggcattgaggtcgcctctgaggctggccgtctaaagactcaaagcaggctgaccttctcatcatgtttctgtgaacagtgaacttggctttgcaagtgagccataccattggctggtatctctgattgtgcaccaccactgggaggaacatagagccatcaccaaaatttgcacactggtccctgtgagctctgcctcctttctttgtttatacctaacccaggaggtctagccatgtcattactgccagtattccccatgaggtcagatgggagtgggctttctgggaagtgtctcagaatgctagggagctggatgtctagaaactctggttaccttttttttttttttactgtatgggcccagttaaaaagatcctcttggctgggcacagtggctcacgcctgtaatcccagcactttgggaggccgaggtgggtggatcacgaggtcaggagattgagaccatcctggcaaacatggtgaaaccccgtctctactaaaaatacaaaaattagctggacgtggtggtgtgcgtctgtaatcccagctactcaggaggctgaggcaggagaatcacttgaacccaggaggcagaggttgcagtgagctgagattgtgccactgcacttcagctggggcaacagagtgggactctgtctcaaaaaaaaatcctctctctgtgtgtcaccatgctgatctgggggagcaggaggggcagtgtagtcaacgtgagattgttcctcttctaatgtggtttttatttgattcagtggcctattcattcagctgtctccgtttctttctcaagtttgtaagttttcacaaaagtgttcttgtctttggattgttgcttgttggactttctgtagagggaagtgaagccaagtgaagcctgggacttcctattctgccatcttgctgatgtcatgcctacatgtttacagaaaattcacatcctcttataacatttatgagacattgtaaaaaacaaaacaaaacaacaacgacaacaaaacccaaaagccttaaatgaagactttagtgaattccagagtccttcttactcttactggccttgtgccttagccctctggtttagcccctgtttccagctagcttttaacaggttgagatgatgaaaagaaaacatacctctctcctttcataatgctgtgaagtagctcatataattcatcttccacgtttatatacgtatgtctcttttgtgcccagagcatcattttgagattcttttttcattatcaaaatacattggatctatgttattcataactaatctgaggctgtatttgttacatttgagtattttaaatcattaatgccatatgtattgtataccaaaatttaccatctaaaacacctggctattcttttgtagggtttttcttttcattagcttttttgagctaaagcttaaagaaaatcagggaccaaaggaaggttagaaagtggctggaggtatcataaacaccaactaagttctttgagaagcagaaggtgcatcatggaaatcagcattattctgacttcatttcattgcctactcagtccaaattttagggtttacaacttaaactaataactcactggcaccttgcatttcctgtggcttaatggttaagaacatgggctttgaagtcattgtcctgagttcaaatttgaggtctaccaccatcacctatgtgactttgggccaaacacatatactctttatacctccatttcttcatccataaaattgggataaaaattataactgtctgcagtgggcagaatactgtcttccctaccaccccctacggtgtccatatcttaatccctgaaactgtgcatgttagattacattgcaaaggggaattaaggttgcagatagaattaacattattaatcatctggccttaaaataggaaattatgctggattatcctggtgggcccaatgtaatcacaaaggtctttaaaagtggaagagtgaagcagaagaagtcagagagttaggaagatgtgattatggaagaatgttcaaagagagacagtgccactggctttgaagatggaggaagggggccatgagccaaggaatgtgggtggccacgagccaaggaatgtgggtggccactagaaactgaggaaagcaaggaaatagattctctcctaaagcttccagaaagggatgcagtcctgccgataccttgcttttacgtgatgcatacagtgtcagacttctgacctaaagaactgcaaaataataaatttgtattcagataccaaatttgtggtattttgttacagcagaaataggaaataaatgcaccgccatatggggttgttgtaagggttaggaaatgtaaacctttaagatagacctgccacatggtaaatgctcagttagtattagccactattattatccattggtactttagtttcccttctgtctttgctcttttgtggtagttgtcttgtaattacccaaatttgtggttatcttccctacaaagactatggccctaggtgtttttcactctcattttagtctatactcagcctccagtaatttgtcaaaattaccatttcagagttcctaccattttgtggttccagcagcttctgttccaggtgagtagatcttggctgtgactctctggatttgcctgtctctccagattttagggtggtagtttgccctgcaacttcagttctgtggggcatccaaggaaagtcgctggttttcactttgttttgtttcattattgtaaggacatgagtgctgacttccgagttctttacatgttggtactgaaattggaagtgtgggcagtgctctttaccctacggctttaataatctttctatacacatgagatcttcatctctacactttacttctttctgatttccattatctggttttcacttcattcatttcatttccaaacatgctttttctgtattttctatttaggttagtggcatctcaatccaagggatagtagttaatttgatgtgtctgaaatacagggtacaaaacaggctcatagtcggggagattgcccttaactctccacctttcctgaatccttttcttcagaattagtaagtcgccaagggctgttgtgtctatgaattttgcccacatccttgctgtcattacgctagtcctaactcttgactcggccatgcagaatattttaaaccactttatcctctacactgcctcagagttagatcataagttggatcatgttacttcctctctcagaagacctacattttgaaaaattgcttgtggaataaatcccaaactcctaatttggcatttaaggttcttaaagatctgtaattaaggtatatttctaggtggattcatagtgcatgtacctactgtatttgctagtgctaccacaacaaaatcctgcagactgggtaggttaaacaacagaaatgaattttctcatggttgtgggggctggaagtccaagatcaaagtgtctgcatgtttggtttcttctgaggcctctctttttggcttgcacgtggccatcttttctcgaggtacttacatagtcttctctctgtgcatgcacacccctgatatcgctctgtgtattccagtttcctcttcttatatggacaccagtcagattcttttagggcccaccctgatagtctcattttaccttaacacctctttcaaagccccattttcaaatagtcacagtccaaagccctgggggttagggctttaacgtatgaattttggggaacacaatttagcccataacaccgactgtatccctctatgtattctgtactcatgaatgtataatggatcacctaggaagatttagaaaatactgatttgggggtctcacccaacttcttgtaggttctgaatcagtaggtctgaaatggggctgagaatacatttggtgtgtgtgtgtgtgtgtgtgtgtgtgtttatacttctccctagtgctttcccagctttcctagactctttaacattattggtgaacatactataaatgttcatacctttgctcatatttgttttttaactgaaaattctcttcctaccatacctatgaaatttaatatctatgaaaattaattcagccttctaggctgatctgaaatatcatcttttctgttatctttttcttattctctccagagataatcctgcaatactttgttgtgattttattttactttatataagtactgaagaatttattttgttttatatgatagtcatttgccttcttctttcactagctttctgagaccaaagaggacatattctttatttctgtatatatgaaacagtggcagttgctctgaacatagtagataattaatcaatctttgcagtgtgaaaaatgaactagttaagaaatgctaatatttttattgtgactttttataaaatggagatcattgggtaaaaaatgaacatatcaaatgtaaaacaagtggcagacttttttttaaaaaagactttacttttttttgaaaagcagttttagattgagaaggtgtagaaatatcccatacactacctgcccctcacatgtgcattccctaccagagtggtacattcgttgcaattgatgaacccatatagacatatcatcatcgcccaaagcccatggtttgtattagcgttcactcttggtggtgtgctttctatgggtttggattgccctaaaaatcccctgtactctacttgttcatccctcccttcccctcactcctggcaactactgatcttttctctgtgttcgtagttttgccctttccaagatgtcatatagttggaatcatacagtatgtagtcttttcagattcgcttctttcactgagtaatatgcatttacttctcctccctgtctctttatggcttgatagcacatttctttttagctctgaataatattccattgtctgggtgtgctacagtttatttatccgttcacctactgaagatcatcttggttgcttccaaattttggcaattatgaataaagctgctctttacatccatgtgcaggtttttgtgtttacatgttttcaatccttttgggaaaatattaaagaatgccattgctggattgtatgttaagagtatgtttagttttttaagaaactgtcaaactattttccaaagtgggtgcaccattttacattctcaccagcaatgagtgagcattcctgttgctccacatcctcaccagcatttggtgttgtcagtattatggttttgggccattctgctaggtctgtagtggtatcttgttttcttttccatttccctgcttacatatgatgtgaagtatcttttcacatgtttattttccactttatatcttctttggtaaggtgtctgttaaggtctttgggtcattttttaattgggttgtttgttttcttgttgctgagtttttaagagttctttgtatattttggataatagtccttatatttaatatgtcttttgcaagagtggcagaatttttgttcattatttttttcttgaattaaatatccttaacattacacataaacagtatttttaatgtgtattttcaatttggaacttttaacatttaaaaatttctcttgatgaagatatgtgataataaaatggggggcaaagtgaagacattgtaacaatttttgataatcgcatcttcttctgcattgcatttttcagggcagagtattaatggtccagttcttaaagataaatggattcctcaatgtttatttgtagtatatccttgtttattctcctaatgaagaactgcatccttaaagctggcataattaggtagacttgtctattagctgagctactaagctttattttcctgggccaatgaataacagaaacaattctcaaaataattaaatctgttaagacccagttttggggtaaggagctggggtctggcatttcctttttgttggtttttcaaaaattattaaaacttcaatgcttggccaggtgtggtggctcatgcatacaatcccagcactttgagtggcaggcagatcgcttgagcccgggagttcaacactaacctgggcaacatggcaaaacctcaactgtacaaaaaatatgagaattagttgggtgtggtgtggcactcctgtggtcccagctacttgagaggctgaggcggcaggattacctgagccctgtaagggtgaggctgcagtgagccaagatcgcaccagcactccagcctgagctacagagcaaagccctgtctcaaacaaaacaaaacaaaatctcaacgttaaactttctagagaatgggtaatcacctttcaagtcatttttccaaacccatttctgaaccaggacaggcaataacagagattggcaggggaaggactgatgtctcctcacaagggaaaaaggactctgcattgaaaacacagatgagcctttggatgtggaaatttacaaggctcagagagccccgaaacatcttcagaagtggagcccagcagaataatgggaggctgtgtgctggcttggcactggagactgtctggcacaaactacactgtaaacaactcctcaaacattttcatctgcatacatgacattagattctccaaatgtccaattaaacacttgtcaatggaagaaatgtttgtttcctcagctgacctgttgtcagccttggccttcctgatggggaagcagtttcagctgatactgttgtatgctcttcctttctgggcctgatcttgtccctgttgagaactgtggagactgtgccaagctgtggaccatgggattaggttaggtaactaaagaaaatatccaggctgtgagcacttttcaaacctaagaaaatctttagtttcttttgcacagttgtaaaccgtttgtgcttaaaaaattataaaagtgattgcagttgagatagagaaaagagcagtgctgatatgtgtttatatacttctaagggctgacttcatttttttcaacatcttaaacttctattgaacaaatattgtgtgtgtaggtgtgtgtttgtgtgtgtgtgtgtcatcatctctgttgacagaaatgctcaatgataagtctctgtgactggaagagcagtgaaggacttggacacatgctgtagaaacataaaggaagtgaggaaggcaatattggagaagaatcaaaggagtttaaattattctttggaaaagttggagtttataaattaaaaaaaaactgtatgaccttgagcaaatttctatttttactagtgtcagtttcctaatccataaaatagggaatataatgtcaagaacatcgaaggttattattaaaattaaataaaatgatctatgtaaaatgcagcaacacttgccacattgtaaattctcaagaaatgctagctaatattgaaatatgaaataatacttctttggtccaaagatgtttaagcattcctatttggtaaagagaaggagcaaaagaacaagagaaaaattagataattggtacagtatgaacagagtatttggctttggaaaggagggtgggcagttctttcactgggacaggagctcagaatgactctataggtaaagggatagaagaactttaaggtgaggatgaagaaagacaaagcatgtcatggtcattctattgtctcttcagttacgtagaagaggagagctttttctgagcatgagggggaataggagtgaaatttgaggcttaaagagaatggaaaagtttcatagcagctgctgtggagaatttgatacgtgtcaactgaagataaatataagggttgtgcagcaatgcagaggatatggctgaggtcagacagccttagtttatagtggcatgattttgggaatgtagatgatggcattatgtaccctggagcaaacacagagaaaattcaaaattacctttgaggaataagaaaggaggtgaggagtaagggtaaaggcgtcctaaggtgctaatgaaaatgctgttgaaatcattaaccaccaagtaaagttgtgagccaagattaatctgaaatggtgatttgtgtggatagaagtacaaatagactggaggtggggaggcccttcactggacaggcaacattaatctagctgccattgtaccgcacacatgctgaatgatgatgatacaggaatgaaggaaacataattcacttgggcagctcaagagcatttttttaagctcttagtatatactggctagatcatccatatgacagcaatgcttcccttgaaaagctttaagtctagtgatatgctctggataatttaaactcagactgtggggtactttgaaggaggtaagcagagggtccgaggaaacaatagaagaggacattcaacatgacctgtgaaaagaaagggcaggtcagtaaaagtatcctggaaaatatcttgcttgagctgaatcgattgtagagagccagggtaaagaatggcagaaagggagaggcaaaagcaagggagaaaaagcaaggaaaaaacagagcaagggagtgatttggctagggcagacaaaagatttcagagaagggataattaagatgagttacatatgatactattactaagtgagagaaataaggaagacatgaatgaaagtgataaacaatgtgttggtaggaacagaagaaagaatgtcaagagaacagaatgatgagatttaatgactgattgaatacgtggggaatgaatgggtgattttacactcttgatcctgaattatagggacaattatggtttccttaacagaaagagggaaatcccgagttagggaagatttaggggaaggtgatgagtttggagatgttgaatcagaacatatggtttcaagtgaaagtaattcaaccaagatgggattaaaccaaatgagagaatttgtgatgttcataattagtaagttcataggtgcttctggatttaggcatacctggctctccagggttcaaatatgatatgggcttatctctattcctatgatctctgtctcttagattagcttgtcttgcttgttttcattccaaagacaggctctcagtatatggtaggcaaatgggtacctccaggttcacattccagcgatcccggtggaaataacttttatttgcaacatccatatattttaaatgtaggttttattattattcagatatggtgaggccaggagattaggagaaaattgccaatggaaaatataatttgttactcatatctcctatgatatgggggcacacaatgacatgcagaccacacagggaagcaccagggtcagttaggaagcagaaggagtgagggaaagagcctttattgtggggtttgtgggaaggaatggatgagtcaaagcaagtaggcttaggtttggctagtttgaatgattttcgtgggctctgggttgtagagttctttagcaagacgtctggtacctagccctgtggttataaaggcaggagaatattggctaggtgtatgaggatttgataagggaggtcatgctggtgggatgggctttggattggctagtttctgtatgaaaggcatgcttacaggggtgttatttgctatcactagcaattagctaatgctgtgagggacagtccctcctggtccattgagtccctggatgccagaacattaagaatacagaaaataagagaatatagttaatacattgtataccaacgccaggaaagattctgatttgccttacttgagtcattccagctctgtagtttaggtgcagagtacagggtgaggaatggtattgtgattgacagtcaacctagaccagagtgtagggatcagggaggactaccctaaagaaaataaagccagaacatgggaaagtatgctggtaaatcaaaaactgtatcgactggtctatcacaaggtggctagagccgtcttggttgagatgaccaggtggccattcaaatatggctcttggcctctagacttcgaagaggctaaggatttttatttttgttttagcagctctcgtacaccatgtattgctcccgggcttgatggccctcttctgtcctgcttttctaaagcctatatagttcctgagctcagtgttaaaaaccaaactggagttttaggcatcatttaggttttctgattctcttggtgaggtaccagtgttttcctcaatgcctacctcagaaaccttagctttgactcccttcctttcccttctatcaagtcatttatcttcttctgaaatagctcccagatttacttcttccttactcatattagctgttgcctttctagtctctcttttttaatacggctttctgaatattgccagagttatctcactggggaaacatcatccccacttctcccacaaaaaaatctaccccgccatttggacattacagagagtaaatggtgtgtacatattacatgggtgagtgtctgaagacctagattcaagtcacttcacgttcctcctctgcattttattaaagatatttggtagcttacataagaaaatgcatgttttaaaactttttataaatcataatgtagttcagatgatggtgattttttgatttctctaattttgaaattctaattttcaggcttatctttttctttttttttttttttttgagaaagtctcacactgtcacctgggctgaagtgcagtggcacgatctcggctcactgcaacctccgcctcccgggttcaagcaattctgctgcctcagcctcccatgtagctgggattacaggtgtgtgccaccacgcctggctaatttttttatatttctagtagagacagggtttcactatgttggccaggctgatctcaaactcctgacctcgtgatctgcccgcctcggcttcccaaagtgctaggattacaggtgtgagccaccgcacctggccttatctccttttctaaatgaacctctccgtcgccacacttaggccaagtttgtttctatctttatatctttctatattgttcccaacccgaaatccccttctttgctctactgtctgccaactaaatattagctatccttcaaagtgtgtctgaagtcctgtctcttatatgaagtcttgtctaattatctagatcacctgtattctctatttttcttacacttcaatttcactactgattatttacctttaattattatatatcttttattctccacaatatgtttgatgcttctgagggcagggatcctgacttttacttattttgtatcatggacagttctgggcataaatttaaaaaaaagttgctaatgattaattattaattggggaaaagtactaatttgcaataatcacactttggatatagtttgtgagcttcccttttcctcatggggagaaataagtttggattgattggactgacagatgttgaaacaatttggttcagttagacaaattcttattgagttctaggacatatgggtaactgctgaataaatattcatttgttcatttattcagtcaacaaatatttattggatatccattgtctgccccacactgtgcaagttaccataatatatgtctgcaatcagacatttagatattgaaaatctaaacatgaatcttacatggttctcatcttcaatttgctttattacatgaccaaggatgagatcattgggtgattataaagcattgcagaaaagtaaatgatatgcttgtggacatttgaagaagggagtaatttattctgactcgggtagctcagaagaggattcaaagagaccatattcaggaaaaaatgaaacatgtagaaaggaaatattaacactcatgtttgctttgtgaaaattttgcattttacacagtgtgttgttaaaaattaacgtgttggagagtttccatttccaggaagatggagtaaatgtagtttttcctatttgtctcctaagtgcaactaaaaacccttgacattatatatataaaacaaatataagaagactctgaaaggtggagagaataaggcaaaccagctggagacctcaggacctgaggaatgacacattactgagttccctgggtttttctttttgccttgtatatctcagacttagagctgaacaaatgggtaacttggagatgccaatggtgcagacaaaaaaaaaaaatctccagcaaaagcctgttttctctaacaaaggacccaaaaagggataatccagcaaaacaaaacttttaaaaagtaaccactctattgcaaacaaacagaaaaaattgtggccccacccttatgtattcagcaaagactgagtggatatcttagatgtctactctaataaggctgtgatgaggtatctgaatatccctgccagggtagggtcagagaagaccaagtagaggtactttccttcccatcaaccagtaatgagcctcctgctgcccccaccacatccccacttgtgatgtcagcggggatcttggacttgtggcctaattgacaataatgcacctctcccttgccctgctggcatgatgtcagaggagatctagtggacttttaccgtttcccagaagtattgaggccatcttaccacagtgtcagtggataccacatggaggatctacaactctcactttcactcagaatgtatgaggagaccctgcccctccttgagtgtcaatggaacctggacttgtacctctatctggcattgatgaggcagtgacacctcccactctccattgcccctgcagtagtgtcagagaaatccaactaaaatggatgtggagtctcataacataatataaatatctgggtttcaattgaaaattacttgtcacagaaagacaggaggaaaaaaaacctagagaaacaaaaaacagagaagaaaaatagaaaataagaaataaaattgtggacaagttctaatatatcaacaattacattaaatgttaatggcgtaaatgtaacaatttaaaacagattgccagaatggattgaaaaacatgatcaactctatgctatgtacaagaaacttacttcatatgtaaacatataggcaatttggaaaggagagaaaaacatatgtaattgattcttgttaatcatggtagttatgttctgtaaaactgctgtgaatgctgaatttgtaaatactaaactgctgttcctaggggaaatacagagctagattcctgcaagcctctggtcacatttttctcaactggtcaatgaataattttattttatgtgttctgtttaaagacaccttactgagtatatattatcgattcattaactttgaactcattgccaagagctctagaactcatatctgaacaaagcttatcgcacacacatgttttctctgtaaggtacatcagagctttcatttgcttaggaacaatagggctttagtactatgcttgaggccattttaaacagtaaaatcaccaacaaaaagtacaaacatatcaaaaccgtggcactaaataaactgtgagaacagttgtttacagcatgagagctaaaacaagaaggcaaagtatttacttgtttgacctaggctaggaacatgtgtatggagtgactcaatttttttttttttttttttttttttttggctgtactgcacttgtgcacaaatgactgcaaaagcaatgcaagtatgattttggggttacaaataaattttagtgagtaggcaaattagcaaatatggaatccacaaataatgaggatagatggtgtcatgcaaagatcaatcaaaggaaagcagatatattaatatcagataaagtagacttcagatgaaagaaaattaacagagacagacattatctaatgataaaagccttatgctaatgtttataacagctttatttgtaatagccaaaatggaaagaatccagttgtccttaaattgatgaatggttaaacaaactgtgatatatccatactatggaatactactcagcaataaagaggaaaagattatttatataggcaatgacctggaagaatctttagggaattctgctgagaaaaaaatcaatcataaaggttatatacacgtttctatttatataacaatctttaaatgacagaattatagaaatgaacaacaaattagtggttgccaggatttaaggagtttgggtgggggtgggagtagagggatgcgtgggtgtagctgtaaaagagcaacaggacggacggatccttgtggtgatagacatgctctatgtctggactgtctcaatggcagtatcctgcttctgataaagtactgtagttttgtaggatgctgcactggggaaactggggaaagtttacataggatctctctgtattctttcttataactcaatgtgaatctacagtgatcccaacataaaaactgtaatttaaaaaacttagcgtactttactgtatgtagctcctttccttgtacttgataaccttaagtctttttgtcaaccagtgatacactggtctacaaatatttattttgaattcctgcttcgttctcagcattatggtggctggaactattaggaatacaattacagaagcataagatttagagtacatataaaaaagcgtgtgtgtgtgtaaagcatatgcaagtatgtctgagagagtaaacataattctcatctttcaaaattttagtgttccactgtaaattgtaaaagctatagtgtaaagtagcatttgtaatcctattcagctcttaacttgccaagaatatcctctcaggatgtgttgcttcactacagtaccaaccattgtgttgtcaaatccatgtgaattatgcaaaacaaaagaaaaacaaatggcctacctaaggtttggcagctgcaacaaggaaactatcaatttgaggtttattgtaatacattaaatttgaaagaatattcttccaagtaattctagggcttggaatgaatgaaggatcatttgaaaaatctgcaactcatttctaaaagattaggaaaaaagagaaaagaacatagttgccaacttctccttggtttgtatttatggaatatatgaaggtttagcattttagattctttcctaattctcagttaatttacctgtagaatctctttgaagaactacttttacatttctttcattttgatgagaaaattgaaaacttggggcaactaaaaagaagtgtttagcttgagtgatagttcattaatatgatttttaggggcctggcagaaacaaatagatcctagcaggtcttgtgatttagaggattattagagatttgggtgaaatagataagtatttctcctttgatagaatcagataattgtctctctgtgcaatgtccaacaccagctttctatgtaataaaaataaactatgaaaacaaacaggaggcaaaaataaagcttcatgggcttcttaaactgtttgtgaaagttgttgttctagagatcataaggtagggagttaataaatactttgttccttgacagggctaccccattgtaccactccaaaaccatgggaatggtgtcctgtgaggttgtatagtacacagtcagccttgttctgtgcagcatccctgggacctgccatgtactagacactgttctaggtactggggatatagcagtgaacaaaacagatgagaaatatccctgccttgatggaatttccattctagactggaaattgagacaatgagccaaatggataaattaattttatagcatgcttggaggtggcatattctatgccaaaaaataaagcaaaggagttggaaaacaattgctaggattggggagttgtttcagttttaaatagggtggtcagatcacttgagtgcaggagttcgagaccagcctggccaagatggcgaaaccccatctctactaaaaatacaaaaattagctgggcttggtggtgcgtgcctgtaatcctagatactctggaggctgaggcatgaaaattcctttaacttgggaggcagaggctgcagtgagctgagcttgcatcactttactccagcctgggagacagagcaagactctgtctcaatttaaaaaaaatggggtggtcaaggagtgcttctttgagaagtgaatgttgtttctttaaaatttttttttaaaatgttagattcagggggtacatgtgtgggtttgttacatgcatatagtgtttaatggtgaggtttgggcttcaagcatagccatcacccaaatagcaaacattttcaaccaagatgaaggtgtactgttcactctgggtaagagtgtgccaggcagaaggaacagttactaccaaggtactgaggtgggaatattgcccttcagcaaagaggctagagtgactggagcagagaaggggaatggtagatgttaccagtggagtcttgactaggagtcatccaggttcttggcagtttgaacaaagaattggacaaaacacacacaaagcaatgaaagaatgcagcaacggaagtacagatttattgacgtgaaagtacactccacagaatgagagtggacttgggcaagcagctcaggagcagtggttacagaattttctggggtttaaataccatctagaggtttcccattggttacttggttacatcctacataaatgaggtagtgggccatgaccagtctgattagtcgcctttcatgatcagtcagagactgaagtggttacaaagttacacccctatgcaaatgaagactaggcctgtgaccagcctgattggtggtgggaggggacaaatcagaggtactttccatttttcatctgataccggaaggggtgtgttgtaaagggagtagcctctgatacttttgttacatgggcttggaaagttggggttttccttatgatttagttctaggaagtcagtgtgaattggccttagggtccctgcctcctggcgctattctcctgcctcagtagagatgagatctgaacataagatgggacttgtgggacatccataagacttcagcttttattctgagcaagatagggtgcaatctgagggctctaagctgggaggtgacattagctgactagatagctgtgggtagtgtgaacactatattgtctggctagttgggaagtggctcaaatatcatattgaataaatcgcaataaaatgctaaagttggagctgtaactgaggaaaatggtggttagaaaagagaaatgaaaaacaaataaacccgtgacaagacttttctattacttgtaagaaagtggaagtggaggaggggggatactgtcttgtaataaaaacttagtcttatttctaaaaagtaattgttcaactagaagcaacaaaactaatcatagggaatctgttttagtaggtaatgcagtatgtcaaccatttttagagtatctcaaaattttcaacattggcaaaatacccaaagctggcattacagcttggattcttcccagtggaaaaccaagttggacacaaagttctgaagaggaaaggagtctgagaaatagaaagaactgagatgcgtgtatttcctgaaccttttttccccctgtccttaatgatgttgtggttaaaacacttttgtgggtttattgagactgataaatacgctcatttacatctcattaatgtcaaattgatgtggctgaatagcatagtttggtagtctctaatgtgtgagacttcatgacttaagtaaacttttctattactctgaattagtgtcaccaagggcataggttttttaaagaaatgcttgtagagactttaaaataatgaaaaatattcaacacacctggctaagagtgattgtattacattcctgtttctttagataaaggtctgtcagcacatccattacaggcacatcttttcaggttgaaacttggcatagcagttctaaagaggaaagagattcaaacaaaatgtgaacaaaatgtttcttttgcttgaagaagacattcccttcataccctgatgcagctacatcccataaaactttgagaatcttattttcgttttgtttttggtaaaataagaagcgcctttgaaaaacagtttatctttggacacgaaggtaaagaaaaaccttttgatgtttggcaacagatttgcttaagaacaaaaatgatttaaaggactttttgaaaagagttagtgttgtctatttttattttctcagacagaccataatcacaatgactattgaaacaccgatacccttaagggctaaatttatcccgcctgtccctggaacaaaacaagaatatccacaaacatgacaccctctttggcagaatagacactaagtgcatatttgttgagaattgagaagatgcataagtcagagaaaagaaattatatttaaaaaggctttacaaatttttagtttttgaggtaatatatacaagtggaacacaactcaaaaagagtatgtagtgaaatgtaagtttccttcttcctccttgctctaagccaccactgggttaccctccacagagacaagcactgttatcagtgtcttatgtgtcatttaagagagcatattcttttttctttttagttaattggtagctttacattttattctgcaccttgctttgttctcctgacatttcattttggaggctgttcaatatatgtatgtagagagctacttctactgcattctttttaattagcttcatgttctaattggtacgttacatgtaccaatacacatagatgtaccatgatttacttagtctatacataaacatttaaactattcctaacttttcctattacaaacagtgtaacacaacatcctcgtgcacagatcattttgtgtgagtgtatctgcaggataatttctagaagaggaatatttatgttaaaagtatatgcatgtatgtagactcttctccatagaaattgtacacgcccagcagcaatatggaagtgtgcctatttctccattccctttccatcacaatgtatatcaaaaacttagtaatgtgatggaggggaacagcactctgttttagtttgtgtttttatcatgagtaatgttgagcatctttttataagtttaagaatcatttgtattttctatgaactgtttatatattttcttgcttttagaaaatattattgatccttttcttattgatatgtgaaaactcttttttaaaataagtgttttctcaacacacactagtgcatttttggtgtatgtaagttccaattggctttttatcataccaaaaatgtttattttttcctatttttatagattaataataattgtacatacttatggagtatgtgtgatattttgatacatgcatacaatgtgtaacaatcaaattgggatatttaggatatctattacctcaaacatttatcatttctttgctttgggaacatttcaattcttttagcaattttgaaataataaattattattactatgtcaccttactatgctgtccaacactaggacttattccttctacgtttctgtatataaccaatctctcttcatccctcccactgcctcacacccttcccagtttctggtaaccatcattctactctctatctccatgagataaacttttttagctaccacatgtaagtaagagcgtgcaatattttttctttatgtgaatttattcctgggttttctattctattccattggtctatgtgcctgacttatttcacttaacataacgacctccatttccatccatgttgctgcaaatgacagtatatcattcttttttatggctgagtagtattccattgtgtatatatatgccacattttctttatccagtcttctgttgatagacacttgggatgattgcatatcttggttattgtgaatagtgctacaataaacatgaaaatgtaggtatcccttcgatatactgatttctttgttttgtatttgcttttttaaaagtaatttttatttcaatagtttttggggtgcagttggtgtttggctacatggataggctgtttagtggtgatttctgagattttggtgtacccatcacccaagtagtgttcactgtacccaatatgaagtcttttatccctcatcccctttccaaccttccctactgagtccccaaagtccagtatatcattcttatgcctttgcatcctcatagcttagctcccacttataaatgaggacatacaatactggttttccattcctgagttattttacttagaataatggcctccagctccatctaacttgctgcaaagacctgattttgttcatttttatggctgagtagtattccatggtctgtatctaccacattttctttatttacttgttgtttgatgggcactttggttggttccatatctttgcaattgcaaattgtgctgctgtaaaaatgcatatgcatgtgtctttttcctacgtgacttcttttcctcttggtagatattcagtagcgggattgctggatcaaatggtagttctactttttgttctttaaggaatctccatactgttttccacagtggttgtaccagtttacattcccaccaacagttctaaaaatgttcccttttcaccacatacacaccaacatttattgttctttgaatttttaattatggtcattcttgcaggagtaaggtggtatctcattgtggttttgatttgcatttccctgatcattagtgatgttgagcatctttgcatgtgtttggtggctgtttgtatgtcttcttttgaaaattgtctatatgtcctttgtgcactttttgatgggatttggattttttttgatggtttgtttgagttccttttagattctgtatattagtcctttgtcagatgcatagtttgtgaatattttctcccattctgtgggttgtctgtttgctctgctgattatttcttttgctgtgcagaagctttttagtttaattgggtcccatttatttatttttgtttttgttacatttgcttttgcagtcttattcatgaattctttgcctaagccaatgtctagaataagttttccaatgttatcttctagaatatttatggtttcaggtcttaggtttaagtttttgatccatttgaggtgatttttatataatgtgagaaatgaggatccagtttcattcttctacatgtgacttgccagttttctcagcaccatttgttgaatagggtgccctttcctcaatttatgtttttgtatgctttgttgcggatcagcacttacttaatatatttggctttctttctgggttctctattctgttccgtcggtctacatgcctatttttatacccctaccctgctgttttagtaactatagccttgtaggataatttgaagttgggtaatgggatgcttccagatttgttctttttgcttatcttgcgttagctgtgaggccccttttttggttccatgtgaattttaggattattttttctaattctgtgaagaatgatgatggtattttgatgggaattgcattgaatccgtatattgctttgggcagtatggtcgttttcacaatattggttccacctatccatgagcatgggatgtgtttttatttgtttgtgtcatctatgatttctttcatcagtgttttgcagttttccttgtagagatcttttacctctttggttgatatactgatttcctttcctttggataaacacccaatagtgggattgctggagtgtatagtagttatatttttagctttttgagaaacctccatgatgtgtttcatcatggctgcactaatttagattcccaccaacagtatataagcgttcccttttctttgcatccttgccagcatttgttattttatgtccttttgaaaatagccattccaactagggtgagctatcttttatttgcatttccttcatgattagtgatgcaaagcattttttcatatacatgttttccacttgtgtatcttattttaagaaatgtctcttcagaccctttgcccactttttaatgggattatttgggcttttttttttttttttagctgttgagttgtttgatttcctgttatgttctggatattagttccttgttggataaatagtccgcaaatattttctctcatactgcaggttgtctcttcactctgttgattgttttctttgttctgcagaagatgtttagtttactgtgaccccgtttgtctatttttgtttttgttgcctgtttttgaagtcttagccataaaaatctaatgtcctgaattgcttctcctatgtattcttctagtagttttatacttttgggtcttatgttttagtatttaatccgttttgagtttatttttgtatatgtagtaggggtctactctcattcttctgcatggatattcagttttcccatttgttgaagaactgaatgctttttctatgtctactgagatgattcatatggtctttgtccctcattctgttgatgtgatgtatcatatttattgttggtgttgaacaatccttgcatccctgggataaattccacttgattgtggtgtattgtctttttaatgtgttgttggatttggttagctagtattttgttgagaatttttgcatctgtgttcatcagggatattggcttttagttttctttttattttttagtgtgtccttgtcttgttttgatttcagggtaattttggcctcatagaatgaattaggaataattccctcttctccaatttttttgaatagtttgagaagaatttttgttagttcttcttcatgagtttagtagaattcagcagtaaagccatctgctcctggtcttttcttaacttgagacattttattaatgattattactaatttttattctgctcaggctttctgtttcttcctggctcattctttgtaggttttatgtgaccaggagttatccattttctctaagtttttccatttgttaaaatatagctgtttataatagtctccagtgattctttgtatttctgtggtaccagttgcaatgtctcctttttttttttgtttctgattttatttacttgaatcttttctttctttttcttggttactatagctagcagtttgtcaattttacttatattttcaaaaaccaacttttcatttcatcgatcctttgtactttttcaagtcttgatttcctttagttttgttctaatgttattacttctttccttctgttaatattaggtttgatttgttcttgcttttctagttccctgaaatacatcattaagttgtttatttgaaatctttctacttttttgaggtaagcatttattgctataaacttccctcttggcactgcttttgctgtatcgaataggttctggtatgttgtattcacatcttcatttgtttccagaaatattttaatttccttctttatttcctcattgatgcaatagtcattcaggggcatgtggtttaaccttcatatatttgtacagtttccaaagttcctcttgttactgatatatagttttagttcattgttgaaattcccaactgatatggtttggctgtgtccccacccaaatctcatcttgaattcacacgtgttgtgggagggactcagtgggaggtaattgaatcatgggggcttgtctttctcatgctattctcatgatagtgaataagtctcatgggatcttatggttttaaaaacaggagtttccctacacaagctctttgcctgctgccatccatgtaagacatgacttgctcctccttcctttccaccattattatgaggcctcccagccctgtgtaactgtaagtccattaaacctctttattttgtaaattttccagtcttgggtatatccttatcagcagcgtgaaaacagactaattacagtaaattggtaccaggagtggggtgctgctgaaaagataccccaaaatgtggaagtggctttgggactgggtaacatgcagaggttggaacagtttagagggctcagaagaagataggaaagtgtgggaaagtgtggaactccctagagacttgttgaatagccttgaccaaaatgctgataatgatatggacaatgaaatccagactgaggtggtcttggatggagatgaggaacttgttgggaactgaagcaaaggttatgttttagaaaagagactggtggcattttgcccctgcccgagagatctgtggaactttgaacttgaaagagatgatttagggtatctagtagaagaaatttctaagcagcaaaacattcaagaagtgacttcagtgctgttaaaggcattcagttttaaaagggaaacagagcataaaagtttggaaattttgcagcctgacaatgcaatagaaaagataatctcattttctgaggagaaattcaagctggctgtagaaatttacataaataatgaggatcctaatgttaatccccaaaacaatggagaaaatgactccagggcaggtcagaagtcttcatggtagcccctcccatcacaggaccagaggcctaggaggaaaaggtgttttttttggccaggcccaggtccctctgctctgtgcagcctagggacttggtaccctgcatttcagcagctccagccatggctaaaaggggccaaggtacagcttgggctgttgcttcgcagggtgaaagccccaagccttggcatcttccacatagtgttgagtctgtaggtacacagaagtcaagaactgaggtttgggaacctcttcctagatttcagaggatgtatagaaatgcctggctgcacaggcagaagtttgctacaggggtgaggctgtcatagagaacttctgccatggcagtgtggaaaaaaatgtggggttggaacccaacacagaaaccctacttcagcattgtctagtttagctgtgagaagaggaccaccatcctccagactgatagatccactgatagcttgcaccatgcacctggaaaagctgcagacactcaatgccagcccatgaaagcagccaggaggggggctataccctgcaaagccacagaggcagagctgcccaaggccatgggagcccacttcttacatcagcatgacctggatgtgagacatggagtcaaagggcaccattttggaatgccctgctggatttcggacttgcatggggcctgcagcttctttgttttggccaatgtctcccatttggaatgactgtatttacccaatgcttgtacccccattgtatctaggaagtaactaacttgcttttgattttacaggctcataggtgaaaaggacttgccttcactaagatgaaactttggactatggaattttgggtaaatgctgaaatgagttaagattttgggggactgttgggaaggcatgatttgttttgaaatatgaggacatgagatttgggaggggccagggcagaatgatatggtttggctgtgttccccacccaaatctcatgttgaattctcatgtgttgtgggggggacccagtgggaggtaattgaatcacgagagtggatttttcttgtgctattcttgtgatagtaagtctcacttactcactcgtgatagtgagtaagatctgatggttttaaaaagagaagtttccctatacaagctctctctcttggcctgctgccatccacgtaaaacgtgacttgcttctccttgccttctgccatgatggtgaggcctcccagccatgtggaactgtaaggccattaagcatctttcttttgtaagttgcctagtcttgggtatgtctttatcagcagcatgaaaatgggctaatacaccaactattgttgtactggagtctgtctctccctttatatctgataatatttgttttatatatctaggtgctctgctgttgggtgcttgtatgtttggaattgttatattctctttctgaattgatcccttcatcattatataatgactttctttgtctctttttacaggttttaacttaaagtctgttttatctgatataactatcactattcctgcttgcttttggtttcatttgcatggaatatatttttccatccctttactttcattctatatgtgtccttacagatgagatgagtttcttggagacagcataaaattgggtcatgctttttatccattcagcttgattatatcttttaagtgaagactttaatctgtttacattcaaggttattattgataaatgaggaaatattcctgtcactttgtaatatgatttttggttgttttatatatcatttgtctctttcttccttttttattttttatcattgtggtttagtggttttctttagcggtaatgtttcacttctttgtctttctcatttgtgtatcttacttttatactttcatgtgtttttatgatggtagagattatccatttgctttcagatgtaggattccgttaagtatttcctgcagggctgatctagtggtgatgaattccctgtttttgattgtctgggaaatactttatttctttcatttctgaaggacagatttgctaggtatggtattcttagatggcagggttttttcttttggcactttgaatatatcattccattctcttctggactgtaattttttgctgagaaatttactgttagtcctaatcagacttgtatatgataatccccttgtatatgacttggcactttttctgtttttagaattctctctttgtctttggcttttggcagtttgcttataatgtaatttagagaagacctttttggattatgtctatttgtgagtttttgtgcttcttgtacctggatgcctaaatctcttgcaagatttgggaagtttttaagtattattctgttaaacaggttttctatgttgttatctatctcttgcccttctggaactgccagaattagaatttttttctttttatggtgtcccatatattatctaggcttccttcattcttttaaatccattttttctatttttttcttttctcttttgtctgactgagttattaaaaaaaaaaaacctgtcttcatgttcagcagttcttttctgtgcttggtatactctattgtagaagctcttgattgtattttttatttcatttattgaattcatcagttccaggcctttggttttgttctctttggatatctgtctctggtatttatcattcagctcatgaattatttttgatttctctgtattatttatctgtgttttcttgtatctcactgtgtttctgtaatattattctctggaattcttttttaggcattttataaatttcctttactttgggatctcttactggataattattgtgtttcttttgaagtgtcatgtttctttgcttttttgtgttttttgtatccttacattgatttcagtgcatctgacataacaattgcttctgattttatgcattggctttcatggagaaagactttttcctgtagataatctatagtgttggttgggtaaagtgctttggttttgattctggttgggcacggtagtatagtctgcatgatttctttggctgtaattagcatcagtgttttctctgagttcctcagtggcttagactgcagttgttaatggatgttgtggtgaggctttgctggagatgggcatgccatgcaggctggtccttgggtaccagtggtgttggtgaggcatgcctgtcctcaagtccctgatggtggatgcaggtgttagctgtggcaggtacggttaggactgatccttagacccccacacagtatgctcgggtgcaagcaatcatggtggtgggtgggatcggcttgtctttaggccccagatgatgtacttgggtgccatcagtggtggcagtggatagggtagccctgtcttcaggcccctggatggaacatgtgggtgccagtggcagcaagagggatgggttgatttccaggttcttggattatgtgcacagataccagcagcagggaaagtgagcctgtcctcaggccccctgatagtgtggggaggtacgagcaacagcaggtggagcagattgatttaagagttagctcagtgttggccagacttggtggctcacgcctgtctcccagcactttgggaggctgaggtgggtgtatcacgaggtctggagttcgagaccagcctggtcaacatggtaaaactccatctctactaaaaaaaaaaatacaaaaattagccaggcatggtggcgcttgcctgtagtcctagctacttgggaggctgaggcaggagaatcacttgaacctgggaggcggaggttgcagtgagctgagctcgtgccactgcattccagcctggggtgatagagtgaaactccatctcaaaaacaaacaaacaacaaaaaaacaaaaaacaaaaaacagagttagctcagtgttttatgatttataaatattttcttaattttctaggcatttgtgttttgattttttgttatgaaatactttttatttctatttttattagtcaaatttatcaattttaatgggttctgagttttttgacagaattagaaaatctttattgctctgagatcttttttataaaccatctcattttttaatggtactttaagggttcttatgtttaaatctttaatctgtctcagatttattttggtgtaaggtgtgttatatatatctagcttaatttttcttcgattagttatcaaggtttttttgtttttatatcactttttgaagttcattttttccgatgggattcaaatatacttatgacattaaaattttctaactatatttgtgtctatttctgggttctctgttctgtttcattgatctatttttctgtttacaaaccagcaactcaccattttaaataatagctttacaacaggtttttatatcttgcattgctaatcccgatcatttgtgttctttttcagaatgtttcttgttattcttatttttcctgtgaacttcagaatcaaatcaatttcttttgtttcaaatagtgttaattgtgtgtgtgtgaatatgtgtgaacatattaaatttatagaataagtcaggtagaactgacatctttaacatttagagttttcttatccatcaatatccctcacttttccatttgtttaattcttgtgggtccatcagtaacattaaaagttttattcacatatttcttgttatacatttttctagttactctataattttggttgctacttttaatgcaatctattcttactttggatctcctatttgcgttgtttgtatgtatgaaaagtagtggtgtcacaatattatttttgtattcattcacttaactgaattctgtcattatttatagttttccagttgattctcttgtgctgtccaggtaaataatcatatagtttccaaataatgatattttagttttatctcttaaaattttacctgcattttactgtctagttatgttattcaggacctccaaaaaattaatggtggtcatagtagacactcttgtcttcaacttattgttaataagaatactaataatagagttttcattaagcatgacatgctggcttttgagatgcaacagagatattttgtcatattaagagaggaaacccttttttcttggtatagtacatgataaggatttttgtcaaaaataacgttgaattttatcaaaagccttttcataatttattgagatggtattttagttttctctttttattattaacatggtaaattatattaatagatttattgttatacattattcttttatttggtgcataaacaccacttagtaatggtatattatactttaatgtgatcctggattctatttgcaaatactcacttagggtcttttttcatgatattcacaagtgagtttaggctatatttttattttttttctgtgctttttattgtggatttatatgttataaatatacatttgaagattttctttttttttcctatgctctacaacactttgaatggcattaaagttaggtgtttcttaaaaatttgtcagtattccgctagtgaaaccaactatgtgttgaactattttgttgggagtaaattgacaatttgtcctccttttaaaacagatagtgatatgttagattttcaaatttatctgggatgtgatttcttagaaaagcatcttaattctcaaatttactcacactgaattgatcaaactggtgttataggagtcttttaattttttttgtttctgggatcttcctcattgtttcttgttctttgtatttgtattttctatccttataattaaaaatgttttggcgagttaaaggttttgtttcgtgttatttctcctcctccacccatgaaacatctgttgggtttacttattctttcacattccatttttcttttcttttcttttcttttctttctcttctcttctcttctcttcttttctttttttctttttctttttctttttttgagacagagtcttgctttgtcacccaggctggagtgcaatggtgcaatcttagctcatcgcaacctccgcctcatagattaaagtgattctcctgcctcagtctcctgagtagctgggattacagacgcacaccaccactcctggctaatttttgtatttttagtagagatggggtttcaccatattgaccaggctggtctcgaacttcgcctcatgatctgcctgcctcggcctcccaaagtgctgggattacaggtgtgagccactgcacctggccacatgccatttttctaattcattatttcactttttatgtttattaatttctttttttctattttcctgtttttcattttattctaacttcttgagtgcttatattatctctttcattctttcttgtttattaatatttcagctatatcacctagataattgtatattgttctttcttcgattgttatttcccagatatcctataatttcagttttgattttatatttgatgcaaaacttaacagaattttaaaatatcctgatagtagattattttcattttctgggtttgttatttttaagttttattacattatgagcacagatgtatacattgtttttcctttttgaaaactgtcaaagtttttttttgtttgcaaatgggcagttttgtgaatgttccatggaaacttggaaagaaggtgtagtctctatttttagagtaatgtatatcacttaattttatttaggttttccatattctgaaaaaaatttttttttgcttattctgtcatgtcctgagagaaaagaaagtttcctattgctgagattttattttctaatttaagacttctgttttctgtaggtttttctttattgatattgcttctgtattactgggtaattagatagtcataacatttaatctacattttgtattgtgccctttagcattacaaggtgtttatcttttttcattgaacatatactatgctgcattaaaacccatctgatattaataccatgaacgttattttctttttacttgctcttgcctgttgtaatctttgcctttccttttattttcaacccttcttggttacttattgatttgtcgtattcttgtgtgcagcagatatttggattttgctttgaggcccacctcatttttcttttaatgagtatgtttaggccatgtgtagttgtagaaataagtgtttacttttaattctgtcattatatcttatcacactttgttcacagtatggactatttctgctttgtggggcgtgtgtgtattttctgatttggaagatttgtaattttatgctaccagttactttataattatatctttatgtgactctctatttcctactattagcatagatgaacttggcaatttccattttcttccttctactcctactgcaaaattgacggtactatatttcttcatgtatgcctctttatatttcaatgtactgtaattctgttgcttgacttaccagttttaaatgatctcttttgattgctagtatatcaattagaatattttcattgataagtaactgaaaagccatctagtggttgcttaatcaattaagacaattgctaccttaataataatgttaataagtccagaagtaggatagttctagtatctcaacaatgtttttagaatccagtttttccatatttttcttgaccattctcagcatgtaggctcttaacctcattgttgtttcttcttggttacatttataggcatgaatttatcctatagcagcataagagacagagaaaaatgctgtttatcttctcaaatttcttcataagaactgagaaacaaatgtctgctcatgactcattggacagaattgaatcacatgttcatgctaaaaccagccaacgttaagagaaatagatttcccaagactagcttatgctaatcacaaatcattctgtggagctggggagaacctcctagttctacaatacagaagcagaaaaggataaatttgtgtaggtctccagtggtgtctgctacctctgtctctataaaatgaagaaatcagcagaaatatactgccaccaattttcttgcccccttgctgtgtcaagttttgttaattacacattgttacatgtcaaggcttctaacctattcattctatcctgtaaccataatgtatttgttttggtcttcgttatagagaattcagtacaactattagtcattttgccagagatttatcatgcatttcttgattgactgaagttaatgcactagcaatttcttccagaaatggaaaaagggaagaagggaaccaaattctgtggattattgcatgttaaaaaaagtttgtcagcagtcattgtacttcagcaacagttcgattggatataaaattttttcttatttccttgaggacttttctctagatgggaaaaattatgtattgaaacctgttccttccattgttttgattacactttttggggacactagttgtacatatgcttgatttccattttctctctcttcctggccttttggctaacatcaagtgtaattgatttccattttctgtatatatccttttttctataatcattaaaaaattttacttttgctataatcctttttaacttggttatttacattttattctgatcactttttaaatttgtgtccttcataattcttactttgttttcagcagcatttactctgtttggattgtctccaatatgaccttcatttctctgatggttttatttttctctcctgtttatgagctctgccagtccaatcatcatctccttgtattgccttgccttattttacttgggctcttgtatacttagtttgcatttttaatttatagaggtatgtgcttatttttttgtttatatcattatatttggtcacaatttttatctgttctgtggcaatattttttggatgccactttcctctgttccctattttctccttttgtggctcttatgcaagttattccttttaaaaaataatcatctctaactgaggcacattttttctggatcagctacctgtaaaaggtttgtgtgagaggggcaccccattgtgttctaggctaataacaattgtccttatgatttaatgagtattttttttaatttagcttttactctcttccccattgccttgccttcagacagatttctgaaaatatagcttatacatgtgatttgttattcagtctcagttacttgctttctttagtgccaagttgtgtccaggaaatctattgccaagttatgcaactactatcattattcctaacaagggattgttagtttttctgttaggatgtgatgcttactttggaagattgttttctgctgtagccatatgtagtttcttttgacatcttcttgcaactccgtttgagctgtgatacaaagtttacatgcccagtgcaggggaaatgatgtgtgtctgccacttttgagtgctatgattgttcacttctttagattctcatagtctgtcctgataattgcaggaattagaaaaggctggcctagagtcctttcctcacctatgactttagggccacattatggcttccttttcccatttcatgaaaatatgactacatctatggtcttttatgaaaaacaaagtaaaatgccctgctagcaactggcaacccaaatccaagaggtaaccagattttctttaggaatataagtttttccaaggcaatatccatgtgtgagacatctttggaagaataaatgtacagaaattggttgtattagtttcctagggctgctttaacaatttaccataaaaccagtggcttaaaagaacagatatttattctttcacagttctgaaaagctgaagttctaaatgaaggtaacagcagggatgctgttccttcagaggttctaggggaagaattcttccttgcctcttccaggttctagtggctccagatgtttcttggcttgttgctgcataactctaatctctgcctcagtctttatatggctttcttccttatgttctgtcttctcttctgtctcttataaggatacttatcattgaatttagggcccatccaggatgatctcatctcaagatctttaacttaattatatctgtaaagtccctttttttgaataaggttatactcatcaaaagtactaggggttaggacatggatgtatattttgggggaccattactcaacccactccactagtgtttctgtgtcatctctcttcatacatttaacagttatatatatagcaatgtctttgtgagtaacactgttctgggggtttcagagtattgactatcttttccttaaaatgtttataatttacttgaggactcaagatctacatttggacaataatataagttaaaacaaaaaataaagcggagtcattttggtaactggtgtgagaattccattgctgggaaatatgttcttgatatgatactttgataagcttgggtagaagttagcctccaaagcccagctagtcctcaggtttctttgatgctggtatgagaagtggcttttcggtagaggcaagcctaatggggatttccatgtaaaatgctgttctgtgcactctgacccttccttattactccaaaatatgtccaaaaccatataaataacagtgaaaataggttgagtgtatttcttttggaaatcactgaacaccctgggcattatcaaaacatacaattacatataattaaataagacaataatactattaataagtcatacagttctggaaaacagtaaggtctctctggttggagttgtctctggaaaatgaatcttgagttgaatgttaaaattgggtggaatatgattgagaaagggtattctagaaaggagaatgatattggtaagtgcaggagtgtacctaagacaagcttgagacaccaagtgagtggtctgatcctgctgaattacagtaggctttcagtagaagtgcaagattgtaccttgcttgtaggtgtgtaatagaactattgtgaataaagttgtggttcataataattattgaaccctagggcattaagcaaacataggcagtggtcaggtagttacagcaggccttgggtgagacccagtgctatgctggcttcaggtctgacccagcacagtcccagtgttggtgactgcagggttgcttgtgccacccctctcccagctccaggcagctcagcatagacagactctgtttgtttgagagaaagtaaggaaacagagcaagagtcttcctggtaatccagagaattcttccggatcttatccaagaccatgaaggcgataactctacaagtccacaggagccacagttttactaagctttaggtgtcccctaatgcagatacagctgcaatgaccaaaaacttagaccacaacacccaagtcctttcaaatatttgaaaagccttcctaagaaggacaggtacaaataagtccaggctgcaaagacaacaataaatattcaattcttcaacagccagagaccaatgaacattcacaaggatcaagaccgtccagaaaacataatctcaccaaatgaactcaataaggtgccagggaccaattctggagatacagagataggtgacctttcagaaaattcaaaatagctgtgttgaggaaactcaaagaaattcattgataaggaattcagaatcctatcagataaacttaacaaagagattgaaataattaaaaagaatcaagcagaaattctggagtccaaaaaggcaattgacactctgaagaatgcattagagtatcttaacagcaagaatagatcaagcagaagaaagaattagtgagcttgaagacaggcattttgaaaatacgcaaagtagacaaaagaagaaagaataaaaaagattgaagcatgcctacaggatctagaaaatggcctcagaagtgcaaatccaagagttattagccttagaaaggaggaagggtagggaggggggagagagggagagagagagagtagggtagaaagttcattgaaagagataataacagagaactttccaaacctagagaaagatatcaatattcaagtacaagaaggttatagaacaccaagatttaacccaaagaagactacctcaaggcatttaatagtcaatctcccaaaggtcaagtataaagaaaggatcctaaaagcaagaaaaaagaaacaaataacatacaatggatctccaatacatctggcagcagacttcagtgaaaactttacaggccaggagagagtggcatgacatattaaaagtgccaaaagaaaaaatcttttaccatggaatagtatatccagcaaaaatattctttgatcatgaaggagacataaagacttttccagaccaaaaaaaaggctgagggatttcatcaacatcagacctgtcctacaagaaatgttaaagggaattcttcaatcagaaagaaaaggatgttaatgaggaataagaaatcatctgaaggcaaaggactcagtggttatagtaagtacacagaaaaaaatggaatattataacactgtaattgtggtttgtaaattacccatatcttaagtagaaagatgaaaacatgaggtgatgaaaaataataaactgcaactcttcaagatgtaggcaatacaataagatataaatagaacaataaaaagttaagaagcagggagacgaagtaaaagtgtagagttctctttttgcttgcttgttagtttgttaatgcagtgttaagtcaccagtttaaaataatgggttataagatggtatttgcaagcctcatggtaacctcaaatcaagaaacataaacaaatacactaaaattaaaaagcaaaaaattaaaacatagcaccagataaaatgaccttcacaaaaaggaagacagaaaggaaagaagggaggaaggaagagaagaccacaaaacaaccagaaaacaaataataaaatggcaggcataagaccttacttatcagtaataacgtttaatgtaaatggacagaactctccaatcaaaggacatggagtaactgaatggtttaaaaaaaaaaaagacccaattatctgttacctgctggaaacacaataaagaaatatcagacttaatctgcacagtagatcaaatggacctaatagaaatttacagaacattttatccaatggctggataagacacattcttctcctcagcatatggctcattcataaggatagactatatgttaggccacaagacaagtcttaaaacctttgaaagaacagaaattatgtcaaatatcttctctgactacagtggaataaaactagaagtcaataacaagaggaactttggaaacaacaaacacacagaagttaaacaatgtgctcctgaatgaccagtgggtcattgaaaaaattaggaaattaaaaaaaaattgaagcaaataataatggaaacacaacataccaaaacctataggatacagtgaaagcagtactaagaggaaatttatgtgtataagcagctacataaaaaagaggaaaaacttcaaataaacaaactaatggtgtatcttaaagaactagaaaagcagttttttccaattctgtgaagaaagtcattggtagcttgatgaggatggcattgaatctgtaaattactactttacagtgcatatggaaccaaaaaagagcccgcattgccaagtcaatcctgagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaatatatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgagagaaaattttcgcaacctactcttctgacaaagggctaacatccagaatctacaatgaactcaaacaaatttacaagaaaaaaacaaacaaccccatcaaaaagtgggcaaaggacatgaacagacacttctcaaaggaagacatttatgcagccaaaaaacacatgaaaaaatgctcatcatcactggccatcagagaaatgcaaattaaaaccacaatgagataccatttcacaccagttagaatggcgatcattaaaaagtcagggaacaacaggtgctggagaggatgtggagaaataggaacacttttacactgttgatgggactgtaaactagttcaaccattgtggaagtcagtgtggcgattcctcagggatctagaactagaaatatcatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacatcatggaatactatgcagccataaaaaatgatgagtttatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggagtggggagggatagcattgggagatatacctaatggtagatgacgagttagtgggtgcagtgcaccagcatggcacatgtgtacgtatgtaactaacctgcacattgtgcacatgtaccctaaaacttgaagtataataataataaattaaaaaaaaagaactagaaaagcaagagcaaactgaacccaaaattagtagaagaaaataaataataaagatcagagcagaaataaataaaattaaaattaaaaaatagtacaaaagatcaatgaagtgaaaagttggttttgtgaaaagataaacaaaatttacaaactttagtcaggctaagaaaaaaagagagactacccaaataaataaaataagagatgaaaaggagacattacaaccaataccacagaaattcaaaggatcattagaggctgtgatgagcaaatatgtgccaataaacttgaaaacctaggagaaatggatctcattctagatacaaacaaccacaagattgaactatggaggaatccaaaacttaatcagatcaataacaagtaacgagatggaagccataatggaaagtctcccagcaaaccaaagcctgggacttgatggttccatggctgaattctaacaaatgtttaaggaaaaactaataccagtgctactcaaactagtccaaaaaatagaggaggaaagaatacttccaaactggccttctatgagaccaatattaccctgatacaaaaaccaaacaatgacacattgaaagacaaaaacaaaaaattacaggccaatctccctaatgaacactgatgccaaaattcttaacaaaacattagcaaactaaattcaatgatacactaaaaagattcatcatgaccaaggggaatttatcccagggatgcaagtatcctcaacatatgcaaaccaattcatgtgatacatcatataaacagattgaaaaacaaaaaatcatatggttatttcaactgatgctgaaaatgtatttgataaaattcagcatcccttcatgataaaaactctgaaaaactggatatagaatgaacatagttcaatgtaataaaagccatatatgacagatctatagctagtatcttactgatgaggaaaatctgaaagccttttctctaagatctagaacatgacaaggatgcccaccttcactactgttattcaacagtcctagcaagagcaattagacaagagaaagaaataaagggcatccagattggaatggaagaagtcaaattatctttgtttggaaatgatgtgatcttatatttggaaaaacctgaagactccaccaaaaaagtatgagaactgttcaacaaattcagtaaggtggcaggatacaaaatcaacatataaaaatgagtagtatttctatatgccaacaacaaacaatctaaaaagaaatttaaaaagtaatcccacttacagtagctacaaataaaattaaatacctaggaattaaccaaacaagtgaaagatctctacaatgaaaatgataaaatgctgatgaaggaaattgaagaggacacaaaaaatggaaagatattccatgtccatggattggaagaatcaatactgttaaaatttccatactgtccaaagcaatctgcagaattaatgcaatccctatcatgataccaatgactttcttcacagaaatagaaaaaacaatcctaaaattaatatggaaccactaaaggcccagaatagccaaagctatcctgaacaaaaggaaaaaaatgaggaatcacattatctgacttcaaattatactactgagccatagtaaccaaaacagtatggcactggcataaaaacagttagaccaatggaacaaaatagagaacctagaaataaatctatacatctatggtgaatttatttttagcagaggaaccaagaacatatattggggaaagaacagtctcttcaataagtggtgctgggaaaactggatgtccatatgcaaaagaatgaaactagacccccatctttcatgatatacaaaaatcaaatcaaaatggattaaagacttaaatctaagacctaaaaccatgaaactactataagaaaatattgggtgaaactctctaggacattggactgggcaaatatttcttcagtaataccccacaagcacaggcaaccaccgcaaaaattgacagatggaatcacagtaagtcaaaatgcttgtgcatagcaaaggatacaacaaagtgaagagacaatccacagaatgggagaaaatatttggaaactatccatctgacaagggattaatagccataatatgtaagcagctcaaacagctctataggaaaaaatataataatattatgaaaaatgggcaaaagatgaatagatatttctcaaaagaaggcaaacaagtgttgcaaaggtgctcaacatcactgatcatcacaatatgcaaataaaaactacagtgagatatcatctcaccccagttacaatggcttttatccaaatgacaggcaataacaaatgctggcaaggatgtggagaaaagggaacccttgtacactattggtgggaatgtaaattagtacaaccactatggacaacagtttggagttttctcaaaaacctaaaaatagagctaccataagatccagcaatcccactgccagctatatacccaaaaggaaggaactcagtatattgaagagatatctatgctcccatgtttgttgcagcagtttttcacaataagcaatatttgggagcaaactaagtgtccatcaacagatgaatggataaagaaaatgtggtacatgtacacaatggagtactattcaaccacaaaaagaatgagatcctctcatttgcaacatggatggaagtggaggtcatttatgttgagtgaaacaagccaggtacagaaagacaaacatcacatatttccacttatttgtgggagttaaaaagtaagacaattgaattcatggacatagagagtgggatgaaggttaccagaggctgagaaaggtagtagggggctggtgggaagtgagaatggttaattgctacaaaaatatgtttagaaagcatgaataagacctagcatttgatcgtacaacagggtgactatagtcaataataatttaattatacatttaaaaataactaaaagagtataattggattacttgttacacaaaggataaatgcttgaggtgatagatactccacttaccctgaagtgattatacacattgtatgcctttatcaaaatattttatgtaacgcatatatatatatacctactatgtacccacaaaaattaaaactaaaatcccaaaataatataaaccacagtgtcatatttgtgcttcactgcattcaaacaaattttgaaacatatggtactgagggcccaagctgaggacaaagagacatcaagcacacctattctaaagtgaactataaataactggggtcagacacctcccccagagatcagtgagaggtggccaaactgtccttatcactctaaactgtcacccaaggcctttcctatcatttcccaattgataaaagaagatgtggggtagagaggagaaagaagatgacattgttacatttgtgagtttcttgccaaatgttgtgtttccctccctttcccgtgggggcttcctgcctacttcaaagccctgtgaaaagtggactactagacaagagcctgggagtgtcaacaggagactggcttctcactcctggctagatgttgcatgaggtgaggcagcagaggcttagcttggtgaggttgttagcatgaagtgaagtatggtgaaggaagaaaaggacctaccatgggtccttgatgtgtgggggcatgtatgtacttggaaattgatgccttctgcttgcgtggctgcactactctgccaaggctgatagacaatggaccgcaggtaagatgtctaagaagaagacagagaaaatcccccagctcacttagaaggtctggaggaggattttcatggttcctatggcttgtcagaataagtctagcaggtagaatgcaaggcatgagtttgggaactgatcaagtggcatctagttatgagataccccatttggtgagagggttgagtgcgtggaccagtgactgagacacaaaatggagatgcagttgtctcttgttttgagggcattctcagtcatgtatagtgctggcttgaagcagaacatctctccaagtaaactgcatgcaccttctgggtagatagcaccacattggtaaagaccaccagcatcagaaagaaccagacctagctagaagggaactcgaaacagctgcccacttcttccagacagccagtctcatatgtcaacctctgccacatctgaaatttctctcccactgctctaatgcgtgggtggacttacagcctggaagctggaggagggaggaggtacagaggacacagagaacatctctttccttcctgaaggatggagggagaagaactttccccctgtctgctccaggcctgacctgaagcttggctggccccagggagagcaaagaagagctttatactagctatgaaactggaatttaaaatatatttgagtcttaaatactggaattagactcttctaataactgaaagtgattggaattttgtggaatattcccagatgttactaagggatagtgaaatatgattcaatgtaggacagctgtcagcagggattgggaaaatgaaaccattttaagtttattttacatcaaatacagactgtacaataacctggttatatacaatatagtggaaagaaaatagattaagtcagactgacttgggtttgaatccttgctcagcaacttactttccacatgatttttggcaaattactttcaatagttttcttaactgtgaaatggggataggcagtaacatcattcttccaaggatttgggagaagattaaatgaaataaattctaggaagcgtctagtgtgatgcctgagacatatagacctctgaaatggggattgattattacagctggagacaaatctggtaaatcaaggactaatggctgatgtagctatcaaatgtaatttgaagtagttagatgggtgggatctgatgagtatttgatgttttctaaatcccaaactatctttttcaatgaagtcaatgcattttcaaagcatttttctgcttaatttggaagattaaatgtatctaactggaagcgcatactagaaaagcatgagaaagggcttcttgtcctgatcagaaagatgaggaggctccgaagagatctgaggtaggacttctgccagcctcaaaatgtgccacacacatttaactgggaagatgctctgaataacatactcttggccatgtgaatgcgttccttggcagccctggccctgcaaagtttggcaggaggggattttcgggttgccagctaaagccctgacactcagagcaggcctcagtgtctctgttcccaaccctgtccccatccctaactgaaggaacttttgtttgtgcaatagctgttgtatctcactcatcccttctactaattggctctgaccctaactttccatattctccagcttggagatgcctgtgggaggtttgctttgagaaggccccagctttggcattgtcagtttttcatctggctcctaatctatttcactttgtctcaagcttcccttctttggtgacccactaaaaactgaagttgtgctggcaagatggtgctttgttgtcatggaaagaggctgtttgcagaactgcggggttaacaagaaggcttctttggcctgtggacggttggtttgtctttggcagtagccagttggagtacagcagggaggcatgttcattccagaagccgtctagtcttcagttgaaggaagtgccatcttaattttgaagtgagagcaacttacatctagagcaaactctttgaaggagggggatcttccaatatcccgtgtgggcctcccgaaggcccgaggcatagacaacaaggaagcaaggaagatgaggaagaaaaggggtgggtagagaaagggagaataagagagagaaaggtgaacgaaagctacagctgctgaatcctcttctgtatccatcacatgtttttactgaaagtttaagataatatcccattgccttatgtttatttgtttattttgatagctaacacttaaatagtgcttactacctaccaggtgctgcattaacactatatatattaagtcttttaagcttcaccacaaactcatgaggtaggcgatggtactatgtttatttcaagatggtaaactgagacatggagccattaagtaacttttctaagatcacacagctagtaagtggtagagccaggtttcaaatgcaggatttatattttctcttccctttccttcctgtccctccctcccctttctccttctgtaaacaagtgtcttctttgaggtgtatttagtgtcacatattttgcatttttgtgctttttttgggggggttgtgattttgctgtttaaaatggcccccaagtgtagtgctgaagtgttgtctagtgcttctacatgcaggaagattgtgatgtgccttatagaaaaaatgtgtgtgttagataaccttcattcaggctttagttgcagttctgttggttgtgagtacaatgttaatgaatcaatagatagatattaaatatgatatttaaaagaagcatacataaaacaaggttatgtcttcataagttgatgaaagtgttatgaccagaggctcacaagaacctaactctgtatttcccaagaagccatgattcaataatctctaattcagtgtttgtgacaactttatagaacataactccatgaataatgagactttgccatattttttttggcaaagattataataaatatgtcttgccacctaagtttagcttgatgcacagtcttctaagctatgtggccatttgctaagaaataccactatatatgttttgtttcttcagttcataaaatctcatgcacaatatcttatgtggtgcctgagaaatagtcagtgctccataaatgcttattgaatgaatgattaaatgaatgaaaaaagtaacactcaaaatttacaagataatctagtctagtactttacattttaagaaatacatgaatggacctggaactaatgtgtgtgtgtgtttttctttttaagtaagccatataacctatgaggcaagcaagttgttctaattgccttctggttgattacatactatttgttgagtactagctactgggattttcaaaatggaattttgcatagtttatttccctcaatcctacctaataagattaaggtccatctgttttgtataagagtccactgtttacttatcaagagtgctttgataaacgaagaggttatcagccacttgtatgggtatcctatactctgtttggctatagtgaggttaaaaggtcaagaatctgtaaggggattcttatccatgaggatattatgtatgcctagggaccatggaagtgaagttttgtttcatttattcatctattcaacaaatattttgaagacgtgctggtgatataatttggaatacaaaaatatgatgtccctgagattgttctttggcatcttggaaaatagtcctatgtagaaagcaacatccttcatactttcagttcttaagtattcatcaagcacctattatgtcccaggcactggggatatagcagtaagacaaagcccctaccctttgaaacttatattccttcaggaagaccaagcactgaacaacccatttgaggtaatactctcccctttggcccggattctgattcagctgctctttatttattatctccatattatgtgaaattatcttgcctttttgctcatttgcttattgtctgtctcccctcatgacaaatgtagctctaaaagagcagaaacttcgtctttcctattgctgaatgtccatcactgagaatagtgtttgatccaacagtagatgcttaataaatgttcgttcttatttaattatagttatggtaatgctaggaagtgtatttctggagattttgaattagtatggacaatcaggaatactcctttaaggaaatatggattgagttgaactttgaaggagtaagcagcaactaaatggagcaaagagtatatattctaggcagagggatcaggtcaaagaatggaacattagaatgtgtgatataaaattgatatatctggagttcaagagtaggagagtatattaggtgagtctagagaggtaggagagggcaggatagtcagggattaggaggctatatagggatttggagttttatcctaagagcattgggaagttattaaagaactacaaacaggaaatcaatctgttgttctgtggatgggagagagactactgagtggatagtgcaaccattcatggtcttgaagattaggtgttcagtctgggaaatctttgattcaaagtacctgtgaaacatccatttggaggtattaagtagacaattggctatacatatttttgggttcagagaaggaggtctgaaatgaatacactcatttgagtgacaacactgtgaatggtgtttgaagtcaagaggactgatgaaattgtctagggggagagtgtagagtaacaaaaacagagggcttcattcaggctaatctttgaggaacttcctcttttaaagatgataaagaagggtgaacaggaaagaatcttaaaagcagaaaagtttaaactaaactatctatgcttatttatatggcctttctgagtggttttattgtcaattgcccaagcatatctctctaataagactctatttaatttaccatattttaatcacttattttcttgtctttttcttctattgtccttgagagtagagattttgttctttaaaatcatgcttgaaaccctagtgcctagcatgcttccagcttaataggcatgaaatatatctgttattgagtgggaatacagagctttcttaggaaagatgagcaagagcggaaagcagatttttcctcacagcctcttctatgtgggacaccataaacattttattttaagccttttgtctataactgtgaaatggtgatttaggtatcaggaagcagatgggaaactttttgaggggtagaggcatttaaattctgcatctgtggtttctttgcatggatttgctcctacccctagacctgtggctgctaaaagttatttccagaagctgttgcagccaagagtctggtgtctacttcatcactttggaggttggcctgcctaggtctcccaatagtccctttccttctattccctctctcttgactatctgtttcccatttcctctaactttatcccaattcctctttgtccaaagaatcccagggcatgtttcataattataggcattattttactcaggatttattaacattttgtacagttatcacctttccccatttttccattatgaaatacatttttttatctcatataatttttacctttgataatgaagtgtgtatattctctttgataatggatctaatgataatgtgaccagtgtgtgaagatcagtgggccttcctctcctcccagttactccacattctggctaggtgcctctgctactaatagcttagcctgctgttcccatgtttgaggattgattctttttcctaggctgaggcaaacagttgtaatgttaaaggcttgctgacagcctgtctttgttgcctggaccgtgttttaatacgtgatctttgctgcctgaattttcttttttctagactacttgatttttcttgacctgtggaattttatgattacttgatttgtgaatttatctcaagcccctggttttgaaccaatgactctattattttaagccaggtgtattgtttttttagcctgtgtctattatactgtgtgttgcttcttatattccctatatctaagtaacttggctgactgggcattttgttaactttggggaggaaaagcatcaacatgacctgcatagggctggagaagagtgcagttagcccttgagggttgggggtgaatgtgttaagggtattaagggtggggagatactgctaagttggagaaaaactttcagcgaatttcactgatttcaaatcaagctgaatttgaagttcttgtctacatgagtgaacaatttttaaaacatttgaaggcatgcatttaaagtgacagcttaatgttaaaatgggaagttatgattcataagcagtagtaaaattttgaataacatgactttattcattgacagtaactgctttacattttccggtttcattatatcagtactgtgaataaaatccagaaaagttatagaggaggaaatgactttgagtttttattcaatagtcattacttacgtctttccacatttttttgcaaattttaagtttcagtaatgatcttgctattcaaattttctatttcttacaaccataatcttctagaatagccacaaaggtaggagtaagctgaagtaaaaagcctgtaggtcagtgtaaatgcctttcataaagcccacagcttgattcagtaaaacccagattgacgtctcttttcttatgataggcccagaatttatttgatttagttatatctatgacattttatttattttctcctggcaacatatagtttccacttttgatctaggggaaaaaaaggaggcttatagctgtaaaaatagccctgtacaaagtaatagaccctaaagtataactgtgcagagacaatgaagaaacagatcactgttgcttagtaggaatttctgcaatgacagaagtttttctatgcactgcccaatacagtggtcactagccacaaggagctgatgagcactggaaatgtggctattgaacctaagatactgaaatttaattttaatttcaatttaactaacttagtcacatgtggataggagctactacactggcctagtgcaagtatctacttcaagcttgtccaacctgtggcccaggacagctttgaatgcccacacaaattcgttaactttcttaaaacattatgagattttttttttcctaactcatcagctatccttagtgttagcatattttatgtgtggcccaagacaattcttcttccagtgtggcccagggaagccgaaagttgaggcacccctgatctagatcattgtattaactttctactggtattacaaaaaaattaccatggacttactggcttaaacaacacaatttcattttaatgaatgaatgaatgaatgaatgaatgatttttttttttggcttaggacaacacagatttattattttgtagttctgggagtcagaagtccaaaatgggttttacttggcaaaaaataaagtgccagtagagctgcattccttctggaggctctaggggagaatctgtgtccttgccccttccagcttctgaatgctgtctatgtttttggcttgtggctctttcctccatatttaaaggcagcaatgaccagtcaagtattgtcatattgtgtcactctgacactcaagttagaaatctagcactgttctcactgggctaaaatcaaggtgccctcagggctgctttattttctggaggatttaggagagagtccattttcttttcctttctagcatttaatggctgcccatattccttagttcatggcccccttcctccatcttccaagccatcaatgttgcatctctctgtccccttcttctatagttccatcttcctttgcctctcttcttctgcctctcccttacacttataaggattcttgtgattacactgagcacaccttgataatccaagatagtctccttattttaaagtcagctgactagcaatcttaaatcccttttgctatagaacctaatatatccgtaggttccaagaattaagactggatatttttgtgtgggccattattctgcctaccacagcttctaaatttggagccatttaatgaaaagacaaggtaagccatatgtgtgtgtgtgtgtgtgtatatatatatatatatatatacattgtttgttgggcctatacctatatttcatccaacacagtatagggtctcaaaataatttaagaacaatagaaacttaattttaaaagaggactgatatgatatctgctccaatcttctatcccttgtagttttattctcttctataatagaatctctagtttattaattttctgtcattagtttcctgtgaaggatactccctacttaacaacaaaatcagctgcattgttgtatagctatggttgttctagatcatcctatcacctagcctttacaatcaccacagagtagcacgttggtttctgacttttggaacaatgttaacctgctttttcgcagagttacgtatctcaataaatggaattactacctacatagttgtctcggcaaaatcttgggaattcttctttatcacccaccattcaccactgttgaatattcttaatatataactcctaaaatatctttcagatctgtctacttcttttaagtattttacttttcagttttagaatttaatttttttatagtttcaatttatttgctgagattctcatttgtttatgaatcaagaccatgttttctttttctgtcattgttctttatgtatgttcattttttagtttttaaatttatctatatttaactcatttccatagcttttgaggtacaagtggttttgtttacatgaataaattgtacagtagtaaagcctacgattctagtgtacctgtccctggacattgtacccaatatgtggtttttttaatccctcacccctctcccaccctctccgcttctgagtctccaaaatccattataccaagctgtatgcctttgcatacctacagcttagctcccacttataagtgagatcatacagtatttggttttctattcctgagttactttacttggaataatggcctccagctctgtccatgttgcttcaaagtacattagttcattcctttttatggctgagttgtattccatggtgtataaataccacattttctttatccgcttatctgttgatgaacacttaggttggttttatacctttacaattttgaaccgtgctgcgataaacatatgcatgcaagtgtctttttgatataatgacttcttttcctttgggtagatacctagtagtgggattgctgggtatctactttactgcatactcatttattctgagtacacataaatgtggttgtgtattaacttgtgaatgcaaaaccatctctgcatccttgggataaaacccacttgatcatggtgaattatctttttgatgtgctgttggattcgatttgctagtactttgttgaggatttttgcattaatgttcatcaggaatattggtctgtagttttctttttttgttctgttctttcccggtttgggtatcatggtgacactggcttcatagaatgagttagggaggattccttctttctcaatcttttggaatagtttcagtagaattggtaccaatttttcttagaatgtctgatggatttcccctatgaatctctctggccctgggctttttcttttgttgttggcaatttttaaaaattactgattcgatgttactgcttgttatttgtttattcagggtttctatttcttacttattcaagctaggagggttgtatatttctaagaacttatccatttcctctagattttctagtttatgtgcatagaagtgttcatagtagtctcgaaattttttttgtatttccgtgctattggttgtaatgtctccatttttatttctaattgagcttatttgaatcttctctcttctgttttgtttatatttttaaagaaccaactttttggtttattggttttttggtttcaatttcatttagttatgttctgatctttgttatttcttttcttctgctagctttgggtttggtttgttcttgtttctctagttccttcagatgtgacattaggttattaatttgtaatctttcaggctatttgatgcaagcatttagacctataattttcctcttagcactgctcttgctgtattctgaggttttgaaaccttgtgtcactattattattcattttgaatcatttttatatttccattttgatttcattgctaccgcaaaaatcattcaggagctgattgcttaatttccatgtatttgtgtagttttgagggttccatttgaagttgatttctagttttattccattgtggtctgagaagatacttgatttgatttcagttttaaaaaacttaatgagatttgttttgtggcatgtcatatggtctatcttggagaatgttccatgtgttaatgagaagaatgtatattctgcaattcttgggtagaatattctgtaaatattattaggtcaattttttttatagtgtagattaagtccggtgtttctttgttgactttctgcctctatgatctgtctagtgctgtcagtggagcattgaagttccccactattattgtgttgctatctatctgttttcttaggtctagtggtaactgttttatgaatgtgggagcgccagagttaggtgcacatatatttaggattataatgtcttcttgtgaccttttttgccccccctttttttcttactattattgctttagtctgttttatctgacatcagaatagctactcctgcttgcatttagcttccatttgcatggattaactttttccacccctttaccttgagtttattagaacccttacatttaaggtgatctcttgaagacagcagatatttggctgtgatttttttaaaatccattctgccaatctgtatcttttaagtggagcgtttagacaatttacattcaatgttaatactgagatgtgtgtactgttcagtcatcatgttgatgttgcccagatgctttgctttctccactgtgcggttgttttataggtctgtattagtctgttctcacactgctaataaagacatacctgtgactgggtagtttataaaggaaagaggtttaattgactcacagttcagcatggctggggaggcctcaggaagcttacagtcatgggagaaggaaaagaaaacatgtccttcctcacatggtggcaacaaggagaagtgctgaggataatagggaaaaacaccttataaaaccatcagatctggtaagaactgactcactatcataagaacagcagcatgggggtaactgcccccatgattcaattacttcccactgggtccctcccatgacacatagggattatgggaactataactcgggatttgtgtggagacacagccaaaccatatcattctgcctctagcccctcccaaatctcatgtccacatatttcaaaacacaatcatgccatcctaacagtcccccaaagtcttaactcattccaacattaacccaaaagtccaagtccaaagtctcatctgacaaggcaagtcccttctgcctattagcctgtaaaattgaaagcaagttaattacttactagatacaatggggatacagacattgggtaaatacaactattccagatgggagaaattgaccaaaacaaaggggatacaacccctttcaagtctgaaatctaatagggcagtcattaaaccttaaagttacaaaatgatctcctttgactccatgtctcacatccaggtcatgctgatgcagaaggtggacatccatggtcttgggcatctccacccctgtgactttgcagggtacagcccctctcccagctgctttcacagctggtgatgagtgtctgtggttttctaggcgcatggtgtaagctgttggtgaatctagcattctggtatctggaggacagtggccctcttctcacagctccactaggcagtgctccagtggggcctctgtgtgggggctatgacaccacatttcccttccacatcaccctagcagaggttctccatgagggctccattcaagcagcaaacgtctgcctggatatccaggtgtttccatacatcctctgaaatctaggcagagcttcccaaaccccagttcttgacttctgtgcacccgcaggcccaacaccacatgtaagccaccagggctttgtgcttgcactctctgaagcaacagcctgagctgtacttagcctccttttagccatagctggagctgaagcagctgggatgcagggcatcatgtcttgaggctgcatagagcatgggggccctgtacatggcccacagaatcatttttccctcctaggcctctgggcttgtaatagtaggggctgccatgaaggtctctgacatgccctggagacatttttcccgttgtcttgatggttgacatttggccccttgttacttttgcaagtttctgcagctggcttgaatttctcccacaaatttttttttctattgcatcattaggctgtaaattttccaaacttttatgctctgcttcctcttgatcgctttgccccttaggagttttttctgccaagtacgctagatcatctctctcaagttcaaagttacacagatctctggggcaggggcaaaatgccaccagtctctttgtgtaccaagagccaccattactccagttcccaacaagttcttcatctccatctgagaccacctcagcctgcacttcattgtttatatcagcattttggtcaaagccattcaacaagtcctaaaatattccaaacttctccacatcttcctgtcttctaagccctccaaatctctaggaagttttaaacttttccacattttcctgtcttcttctgagctctcaaaactgttccaacctctgcctgttacctagttccaaagtcgcttccacattttcaggtatctttacagcagcgccccattcccgttaccaatttactgtattagtccattcttgtgctgctaataaagacatacccaagactgggtaatttataaaggaaagagatttaattgagtcacagttcagtgtggctggggaggcctcaggaaactgacagtaagcaaacacatccttcttcacatggtgccagcaagaagtgcagagtgaagtggggaaaacctccctagaaaaccatcagatcttgtgagaactcactcactatcatgagaatagaagcatgggggtaactgcccccatgattcaaatacctcccactgggttccttccacagtgcatggggattatgggaactacaactcaagatgagatttggatggggacacagccaaaccataccaaggtccttgagttttatgctttcaagaggtctattatggagcatattgacctattgtttcaagatttagaactccttttatcatttgttgtagggctggtgtggtagtgacaaactccttcagaatttggttgtttgaaaaagactatttctccttaatttatgaaacttagttttgctggatacaaaattcttggttgatagttattctttttaagaggctaaagcggacaccaactccttctggcttgtaaggtttctgctgagaagtctcctattagtctgataggttttcctttataagttttctgatactgttgtctcactgctcttagaattctttccttcatgtctacttctgaagcctgttggccatatgccttggtcatgcccttttttcagtgactctcttaggagttctttgagattcttgtatttggatacctaaatctctagcaaggccaaggaacttttccgcaattattccatcaaataagttttccaaactttttgctttctcttctccctcaggaacaccagtgattcttaggtttggccattttacataatcccatatttcctagagactttgttcatttcttttaattcttttttatttctatttttgtctgattgggttaattcaaaagccttgtcttcaagctctaaaattcttctacttggtctattctactttttaaactttcctctgcattttgtaattccccaaatgtgtctttaatttccagaagttttgattggttttcctttaaaatatctatttctttagagaatttttcattcacatcctgattttttaaataaaaaaattatgttggtttttatctttctcttatatctcctcaagtagcttaataatcaaccttttgattttttttatctggtatttcaaagattacttcttggtttggattcattgctggagagctactgtgaccttttgggggttgttatagaaccctgtttcgtatttccagaatcattttctggtttcttctcttttggatagataattttttctaattattcttgaatttatttttgattctactgtgttttcttttttttccctcttgatgatgcgactttagtatttacagtttattctagcctaatgaagctcttggtgctttcaggggtgaagactctgtatgaaattcgttgattatagatagtctttgtattatggctttctcagatgttgattgtagtagcaatgtgttcagtgtgtgagcaggttcatagtctcttgtggggttgaaatggcagaggtctcttgaagcttatcttattccccagtgatgtgcacattttaatttatttttttccccagtattttacttactgggttgaagaattcaggcttcaggccagtaggggaggtgtctgtgggtaaaaaaccagtgtggccaaagcaggtgggtaaatgcaatacccagtggtgggcagaggtcctagccttgatagaggaggctgggggagctctcagtgaaacacagtgagttctctgcaggggaaatttaggcagccacattagcttcccagccaggccagcaggaaagcaatctacctcccagtcatactcctgacccagtgttctagctattcacatcagacaggtgcctctttccatctccaagaatgttgattctctaagtagatagggattgtgactctactccttgtgcaagcctgaacctggagggcactcctcctgtgaggaaggagttactctgaaccatttcagaaaggctgtctataggtgtacccacacgaagctcccatgaaagaatccccagctgtatctgcaatggtggatgagggggagaagaagtccccttctccaagacccttcatgagtaccagggctgcccaagtattggatagagctgcagactttccctgtggagtgcagcacttcacttttgcctctgctgaaagaaacttcccacaagcagaaagttctgggactcaagacctgccatctggattcttttgtcccatggggtgctcccttgatgtggtgcagtccccctttctgcaggaataggagtccctgagggccagattactgtgaatgatgctgctcctcttagtttagccacccagtggggctgtcacactccaagctggtgctagggaatgtctgcaagggttccagtgatgtgaactgtcctcaagtctctgagcagcaggtaccagcactagctctgatgcaggtggcaggggagtgacatagactctgtgagatcctttgggtatacatagccttagtgtgttggctttctcaaatgttggctgtagtagtaatgaactggtcatgtggacagaccaggaccttctcattagctagggtgatgcaggcaatggtgaaagctgaggtcatgcacaagttttctctggcctgggcgctgtgtcattttaactgcagatggtgtaatggactgtgttggttggcttctagtaggtggtggcacttgcaaaagagtgccagctgtggtggtagcagtggattttttgttgttgttgtttccatgagcaaatatacagatttattttttatttatttttaaattttaaatttttattttaatagattttaagggaacaggtggtgttttgttacatggatatgttctttagtggtgatatctgagattttggtgcatccatcacccaagcagtatacactactacactgaatgtgtattcttatttctcatcccacttccaccctttccttggagttcccaaagtccactatatcactcttaggcctttgcatcctcatagctttgctcccacttatgagtgagaacgtacgatgtttgcttttttattcctgagttacttaacttagaataatgatctccagctaggtgcagtggctcatgcttgtaatcctagcactttgggaggctgagatgggcagatcacctgaggtcaggagtttgagaccagcctggccaacatggtgaaaccccgtctctactaaaaatacaacattagctgggtgtgttggcgtgggcctgtaatcccagctacttgggaggctgagggaaaagaattgcttgaacctgggaggcagaagttgcagtgagctgagatcacaccattgtagtccagcctgggcaaaaaagagcaaaactccgtcacacacacacacatacacacacacacacgcaagaataataatcttcaattccatccatgttgctgtgaatgtcattattccgttcctttttatggctgagcagtattccatgatataaatatatatatatatatatatatatatatatatatatatatatatatatatatacgtatatatacacacacacacacaccacattttctttatccactcattgattaatgggcgttggggctgttacatatttttgcaattgtgagttgtgctgccataaacatgtgtgtgcatgtatctttttcatataatgacttctttttctttgggtagatagccagtaatgggattgctagatcaaatggtagatctacttttagttctttaaggaatctccacactgttttccatagtggttttactagtttacattcccaccagcagtgtaaaattgctcctttttcaccacatccatgccaacatctattattggcacatagccactggtctatgtgcctatttttataccagtaccgtgctgttttggtgactatggccttatagtatagtctgaagctgggtaatttgatgcctcaagaacaatatgatttattcttttcgcttagccttgctttggctatgtaggctcttttttggtcccatataaattttaggatttttttttctagttttgtgaagaatgatgatagtatttttctttgctttatgttacccaggggaggtactcagacaatggattgggacatagagctccccaaaagttccatcatttgtgttaagctactaggacacatggaggggcaaagccaagtcgtgggcgctgggtcaggcaagtatgtgttctggctctccacgtgtgggcacaagcagtggctccagaggggattgtagggcagttctctagctgctggggtaatgttccagggaggagcacaactgcctctgttgtacagaagagtcttcatggggagtggggagtagcaggtgacagtaagccctacttagctcctatgcacttggcaaggctgttttcacacttgcagtgttccactagcagcagctagctagtttccaggcagtctgcatcaggactcaaaacttccccaggccataagctttctccatggagacagaaaccactgtgcccaggccatgcccctcccagcctgccctagaagcaggggcacactgcttctgtgcttgtggcttcagcccacttcccactcacccctcagttctggccaagggagttcatccgtacttgagattatattgtgaatcttaactgggggcttctcccaacctgttgtgtccggaattggtgggttcttggtctcactgacttcaagaatgaagccgcggaccctcacagtgagtgttacagctcttaaggtggtgtgtctggagttttttccttctgatgttcggagtttcttccttctggtgggttcgtggtctcactggctcaggagtgaagctgcagaccttcgcggtgagtgttacagctcttaaggcagcgcgtctggagttgttcgttccccccagtgggcttgtggtctcgctggcttcaggagtgaagctgcagaccttcgtggtgagtgttacagctcataaaagcagtgtggacccaaagagtgagcagtggcaagatttattgcaaagagcgaaagaacaaagcttccacagcgtggaaggggacccaagtgggttgccactgctggctcgggcagcctgcttttattctcttatctggccccacccacatcctgctgattggtagagccgagtggtctgttttgacagggcgctgattggtgcgtttacaatccctgagctagacacaaaggttctccatgtccccactagattaactagatacagagtgtcaatacaaaggttctccaaggccccaccagagtagctagatacagagtgtcaattggtgcattcacaaaccctgagctagacacgggtgctgattggtgtgtttacaaaccttgagctagatacagagtgccgattgctgtatttacaatccctgagctagacataaaggttctccatgtccccaccagactcagaagcccagctggcttcacccagtagatcccgcaccggggctgcaggtggagctgcctgccagtcctgtgctgtgcgctcgcactcctcagcccttgggtggtcgataggactgggtgccgtggagcaaggggtggcactcattggggaggctcaggccacacaggagcccatggagggggtgggaggctcaggcatggcgggctgcaggtcccgagccctgccccgcaggaaggcagctaaggcttggtgagaaatcgagcgcagcgctggtgggctggcacttttgggggaccaagtacaccctccgcagccactggcctgggtgctaagttcctcattgcccagggctggcagggctggccggctgctccaagtgcgggcccgccaagcccacgcccacccggaactccagctgttccgcaagcaccgcacgcagtcccggttgccactcgcgcctctccctccacacctccctgcaagctgagggagtgggctctggccttggccagcccagaaaggggctcccacagtgcagcggtgggctgaagggctcctcaagtgccgccaaagtgggagcccaggcagaggaggcactgagagcgagtgagggctgtgaagactgccaacatgctgtcacctctcactgtgaccactgcctgtgtcagctggcagacttctgtgaggtccctcccctgtgaggtaggatcaggaatggcttccctctatctctcctggagactgggaatgcacacaaagcatgtctcaatgttactctttctcatatactccctactgctccctataacagctccagtgctgtatagggttaaggccttcccctgtgcttgggttgccaggttccccagtaggagtgtatatcctggaggtagtttatccctctctcacattcaggggacttacggttttctgcctggctcatggtgtaggctgaagcctgccacttcattcaaagggtctgtggtttcttttagttttcctgttaagttcctgtattgcttcttggagaaaagttcacagtgtgaatctctgtgcactattttgtctttccaaatggaagaagcatgccaccaataactccaatctgccatcttggaaaaaaatgtacatatatcaagacgatattttcatttcattctttgaacatattttctcttaattccttgaacatatttaaaatagctgtctgaaagtcttctgtaaatccaacacttgcggcatcttgggattggtttctattgattacttttttaaaaaaaactgtggatcacgtgttccttttttctttgtggatctagtcatttttttattgtatgagggacattgtagacaatatattgcagacactcaaatctgttatttttctctgaagagtttcatgtgtgtgtgttttgtttgtttagaaggcagtagaattattggctgatcacattgaacttagataggcatggttttatgctttgctggaatggttctgtggaaagctctaggtgctgcctaagcccctataaattactaggacttaacttacaaattacttcctctgaagatcttgtcaagacttagttctaggcttttcttggactagtttagtctgtattcatagggcagtgtttctctatcttttttttcattactataaaagagatttttaagacatttttttcccagttttgctcccccctcctccatgaagttttaataccacagatataactctatatctgtttatgtactgtggttctttgaagaggtacaaagcattgtaatatctaagattctttttgctccccgcctccctgccaagaactaattttcatccgttggggatgatattccccttgttgcgaatgcattttctatggtgtggtcctaaggtaaagcctttctgatatctctgctggatgctccaaagattaataaggtgttcatgggttttttttttttcttccctggctgtgccagaatgccagtatcttccaacaatgctcaaaatctcatacatcttttatgtttttaatcctatagcagccactctataagctttgggtagtgctgtcctgcccacgtacagcccatctctcagcaatgtacttgcagggggctcctacacggactttgaggaccccatgttgcatggtttcttcctctctggtgccctgccctgcatgttttaacttttagcactttgaattctgccttcttatctcagtaagactgctgtcctctgcttggactctagctcactttactgtggttgggagttgtcctggcacaaagagatgggaaattgggattactttgtgagtttttattctctcagagattgcagtcttacactgcccccttcccaatgcctgaaaatagttgcctgttttgcccagttttatggttctgtggtcatttatggagggacagtacacctataccaataactacagtttctctgacttcttttggaagcagaagtcctccttctactactttcaattctcatctgcacctagtacaggtgataagcattctatcagaattaggacaataattttctaacaggtcttctgatctccttactttcagcctccatactacctccagagtgaactttttgaaacacaaaaacacaaatctcctgtcattctcctgtttggaacccttattaggcactcctttatccttaggataaagttcagtcctttaaagtagctcacaggtccccctctatgatctttcttccagctctctctccagccttggctttcactctcgaccttgaacctttgtgcatgtcatactacttttttcagtttgtcatatgtgcagtggttttacttgcctccttgcctttgcacatttatttttctttttccggaattcctactctgtctccccactttacttggctaactcttgctaatcctttaggttgcagcacagatttaacttcttctggtagtcctataccaggatagaggccctgttttatgtttcatacactaccctggtgtcattattaacagttctttttttcttttccttacttccacaagaaataagctctataaaggcagggattttatttgtcttgtccagtgctatatccatagtgcttagtacaatgcatggttcacaagtaggtattccattaatatttatttattgaatgaataaatagagatagtgtttattccctttttcatatgattgctctttaaatatataggataactcttgtgggttccttatgtctttactttttgaggctacatattcagagatcataaaggaaaggtttaaatatctatagcaggagttggcaaactatggccctgggaccagatctggcctgctctctgcttttgtaaataaggttttattgaaatataaccataccagttttttttttcacatattatctatctatggctgcttttgaactaccatggcagaattgcgtagttaggatagagacatatgacctaaaatatttactttctagtcctttacagagaaagtttgctgaccactggtctacatgaagtttcctatgcatcctcaatttatttaaatgaagaagcataggaaagtatgctagagtatatgttgtaagtgatatactaggctagtctgaggtcagcaactaaccttaaaatcttagtggcttaacacaacacagatttatttctctctcatgcaaatttctttgatgcttggacaattttccagtgtactcctctccgtatagtgacttagagatccaggcagcttccattttgtgttccatcaaatcatctattttcttgatttccctggcgcaggaagaggaagctagagggcctgcaattcttgggactgaaagtgacacatagagcttcttctcatagctcattggccagaagtagtcatatggccctgcttagtgaaagttggttggaaagtaaggaaagacatataaatatttaatgagcgatgagcatctctgccatagaaagattgccttaaaatgattaaatgcttgttttttggggaaagttttcaacttaacattttcagcttcagttatcttgaacatgcaatccttccaagtaacacattataattatgtttttattttacagataccataccccgaatagtaaaatattatcaaaagtaaataggacaaggatttttttcttaaaaaattgggtctactggtttttaaaaattggattttatttaaaaaaattcactgacataattttctaagaatatatcaattaagcaaattaaataaaatacagtaatggttgaaatggcctgaaggatctccctgacacaaggggatccttttataaacacttacatggagactgaaaatttatcctgctaatggagtattgttatttagagtggtggtttttcactactccctccacccctttggtttgttttatgtgatagaaccctcttaggagagagcccaatttataaaacatacaaaaaggagctattgtgtctgaagaaggcttgcgttggattctgtctactcaatctctcttttattacccccatctctccctccctaaatgagtacctttttagtatccttgaggactgaaaaacactgctttaagcatctataggacataatttcgagctgtagaaccacagattttagaactcaaagggaatttagagaccatgtactctaattttactatgatttagtagatgttggttagcaactgtggagctgcaggacaacaaccaacttgtgtgcctgattttctaaaaaactaggggcatctcaaacaaaactaactctaaagtgattatttattcccaagagacctcttatattaggggaagactaccaatttacatcaaactagattccgaagggcattttcaggatctgtacttttcattttaatataatataatttttaatatataagtacccaagaacctaccctaaacaaaatctgggatcttgacagtaatctgtctttatacctcaccaacctatctctctgcctacccctatttgaactaatcatcattctggaccctatgtttctatttgcttgcttttctttttatatagttttattgcatctgtatgcattctctctctctctctccctgcccccttgctgtttttaactaaaaaataggggattgtgttgtttataatcttttgaagtacatttttaaaattcagtattatactgctcagaatcatccatattgttgcatattatagtcattcataccttttgactgctctgtaatattcaatgtgtgaatataacagcttgctatggcttgaatatttgttctttccaaaactcatattgaaatttaatccccaatgtggtggtatttagaggtggggcctttaggaggtgatttgcagtagtatttctgtgcataacattcaagctgagagccaagtcaagaatgcagtcccatttagagtagacacacacacacacacacacacacacacacacacacccctaggaatacatctaacaaaggaggtgaaagatctctataaggagaaccacaaaacactgctgaaagaaatcatagataacataagcatatgaaaaagcattccatgctcatgaattggaagaatcaatatctttaaaatgtccacactggccccaagaaacttatggattcaacattattcctatcaaactaccagtgtcatttctcacagaattagataaaaacaattctaaaattcatatggaaccagaaaggagcctgaataaacaaagcaatcttaagtaaaaagaatgaagctagaggcatcacattatccaacttgtttatactataaggtagtggtacaaaaacagacacatacaccaatgaaacagaatagagatcccagaaataaagctgcacaactacaaccatctgatctttgagaaagtcaacagaaataaacaacggggaaagaacttcctattcgataagtggtgctgagataactggttagccatatgcagagaatgaaactggatccctgcctttcaccacatacaaaaattaaccaaaaatggattaaagacttaaatataaggcctcaaactgtaaaagtcttagaagaaaacctaggatgtaccattctggacattggctttggcaaataatttttggctaagtcctcaaaaacaattgcaacaaaaacaaaaattgacaagtggtacctagttaaactaaagagcttctgcatagccaaagaaactatcaacagattaaatagacaacctacagaaagggagaaagtattcataaactatgtatccaacaaaagtctaatatccagactctataaggaacttaagcaattcaacaaaccaaaaactaataacctcattaaaacgtgggcaaaggacgtgaacagacacttatcaaaagaagacagacaagtagccaataaacatatgaaagaaatgctcaacatcattaatcatcagagaaatgcaaatcaaaagcacgatgaaataccatctcacactagtcagaattgccattattaaaagacaaaaaataacagatgctggtgaggctgaggagaaaagggaatgcttatatgctggtggtggaaatgtaaattggttcagccactgtggaaagcagtttggaaatttcccaagaaacttaaaacagaactgccattcaacccagcaatcccattatttggtatatacccaaaagaaaataaatcattttaccaaaaaagacacatgcactcatatgtttaccatagcactattcacaatagcaaagacatggaatcaacctaggtgcccatcattggtggattgtataaagaaaatgtggtacataaacatcatggaatactacacagccataaaaaataaataatgaaattgtgttatttggagcaacatggatgcagctggaggccattatcctaagtgaattgacacaggaacagaaaaccaaataccacatgttctcacttataagtaggaactaaccatttggtacacatggacataaagatgggaaaaatagacactggggactagtaaagtgggtagagaggcagggggtcaaggggtgaaaaattacctgttgggtactctgctcactacctggataatgggatcattcgtaccccaaacccatgtaacaaacccacacatatgccctctgaatctaaaataaaagaagaaattatagaaaaagaagtgattgggtcatgagggttctgtgctcattatggattaattcattcatgaattaatggattaatggtataacagattgattgcttatcatgcatattagtctattcttgcattgctataaagaaataactgaaactgggtaatttataaagaaaagaggtttaatttgctcatggttctgaaggctctacaggaggcatgatgctaatatctgcttggcttctgaggaggcctcaggaaacatacaatcatagtggaaggcaaacagcgagcaggcatcttacatggcaggaacaggagcaagagggcgaggggtaggtgctacacactcttaaatgacccatgagaactcactcactatcttaaggacagtgccaagagggatagtgctaaaccattcacgagaaatccacctccataatccaatcacctcccaccaggccccacctccaacaatagcgattacaactgaacatgagattgggtgtggacatagatccaaaccacatcatcatgggagtgggactggtggctttttgagaagagaaagggagacctgagcaaacacttttgacctccttaccaagtgatgccctttgctgccttgggactatgcagagagtccacaccagatgtgacctcttgactttggacttctcagcctccagaactataagaaatacatttattttctttataaattacccagtttcaggttttctgttataagcatcagcaaatggactagtacatagtttattcatcctcttttctgttgatgggaaattgggttatttctaggttattgctgttgagtacagtgatggctatgaacattcttgtgcatatctctttttgtacatgtgcaagaggttcttttgggtatacacttagtgactaaattactgggtcatagagtatgtgagttttccactttagggagtaataccaaatcattttctagccctttagccaatatataatggaagcaacagcattttttttcttttcttatgaaagagcaagcagctatttagtcctgtccctacagttcccatttcgttttcactgggacctgcattaaaacacatctgagggtgtctcactttgaaaacaggtgtgttcaatcatctactttcaccttaggtcatcctcagtctagttagcagtccttgctcctgacataaggtataaaaacactctcaggaccacttcaggttttatctcatctcactgctatgttctgtggcagtaccaccttgattttcctagctgctttagtccttatggttcttttacatctcacctagctttctggctttaaaatccctagcttgcacctacatgttgaggaaagataactcttaggcctccctgacttccagattccggattttttttctcacctttgacagctgagagctccttaaacgatgggtgacacattcaaatgcttatataggccagggtgggagcactaatgagtgactcaggattccaggattaatataacactatcaggagcagtgggactgtggtggcctgatgatgggggtagcttctccttatggggttgctcccaggacttctgatttttccagagaaaaatagttatctagatttttaactgaaatctcttgacctttgagtgtcaacaatagatttaatatttagaaacactatgcaggccaaatgaaatatttctgacctggattcaacccataggtcgcccgttggtgaactttgcctcaaactttggcttatctgccttttgctttggccattgcctcacctgcctgttcctgccaaggtgtgcccctctctctggaggagacctcattgtgacatctctcaggtttaccttgacttccaagtgacctgatactgacagcaggcagggcaatgtctgattacttaccctttcctttctctcactgcttgccttaaatgcttctatcaaattctggttcttggaggcctgacttgttttgataatttttagaagagaaatgttatatggaatgatatttttttaacttgaaaaaagtatgacaagaggccaggattttattatttaatggctctcaaacttatttgcagttttagggcttctctgcttgatcttgctctggtgttgatcaggtggccctgacttcactggatgctggatttgtccctactcttgtcctaatggattggtgaactaaaacagcagttttttgatttaggaaaataaggtctttgactttcccccgtcttagaaacggtcacaatattttgatttgagattctaggcttttgagcatttgagaatatccttctcaaaacagaaaacctttgctttctttgcaattatttggcacattctaagggtggatatggtcagtatccagttgggaaataaagaaagtgcttcataaatcacacaactttttctgttgctgagtcagtatcagacacagatattttctgagtcaagcctgctgttctgtcaggtgggagattatgggtaaggtctgagattgagtggagttcgttagagcaagatgctaatgagcacagggtcatgggtttgatccccatacaagtcgattagcttaaaccataaagggactcctggctcatccatcctggcaaatatgtggtcacaggcctaaggaagactaggttagagagtgagaaaaatccttcatcatcaagaggaaaaaaaacaaacaaacctcaaagcccatgtcctattggatgtagtaagtgatatcatctgtggttgtagtcagtgcctatattacttatatgtagggagaagatttgcatcccattaaatctcccaaaatatgtaatatagcatgcatgaggttaaataaccaatgggaactatagtgacatccaaaaactctcgcaagagaagtcttatagctaactgagatggggtggaacctccatggccatggtggaactctgtgactgtgctgaagacctcttgtgcaattaattccttgttgggcatgaagccatgcacatataccctaagacaatgctgtcttctcctggaggatggataaaagggcagagaggattgtgtgagggcctaggattgtagccacttgtcctatggctgtcttattcactctgtatatttgcacaccctggtttcacattatctgagtgttttcctatggaaagaggttttcctatcttcattataagaaggacagtattttctagccatacccatttttcaaggatgatctatttaaaaattatttttcccaatgaaaaatttcaaatgaagtaatcagaatagaataatgaatgtccatatacacatcatctggatttaacaattgtcaacattttgccatatttgcttcattattttgtgtttttttgctagtgttatctcacctttacatatttttcttaaaaatgacaattttctgcataactgtaatactattatcactcccattaaaattaactatataatttcttaatgtcctgtagtactgcaaattcaaattgctcaattgtccccaaattgtcttttgcagccagtttgttcagtcaggatctaatcaaggatagtgaatttcttatgtgtgtgtgtttgtgtgtgtgtgtatgggcatgtgacatggagctgtggaagagacaagccagttggtctgtacaatgtctcatcttttggatttgtctgagttttcaggatgagttttgaagatttgtatttagtgttgaaaatgggcttgggtctggagattggcagtggccaggacaccctgtacagggaggaccttcgaaaatgagggaggtaaacacaaaggcagtaggaatgttccatatttttgtgtcttgcttcccagcagggctgacagacacaaactcatgtgaacacacagggacatagacctttataaaagaactgggtaatgtttttctctttgccaggccatagatagcacagaacttgaggatatgataatcctattggctgtatattttgaatagtgtatcctgaataaacaagataaaaccaagaggcagaaaaatgaatagaaattaaagctatgagaaagtcatagaaaattcttagtggtctgacattttgagtttgttcttctttggttaagttcactcatctctcttgggagtagagagaacccatatttgggataaacaactgcagaggaccaagagtcttgggagaagctgatgacaggcattcagaggtaagacttgggaagaaaatagccacagaaggaaagtacagggaggcaaacagtgggaggggccagctcatctcttttctccttccccccaaagactgctggttgtcagtgggcctataaaatcttttatgatcttaaaggtattttggaagactaagtcaatctttagcattcttaacctggagcaggggttctgaaacttgaactggcacattggcatcacctgggaactctaaaacacactgatgtctgggtaccaccctcagaaattctgatagaatttgtctcaggtgtggccagggcaacgggctttttaaaagactttccaagtaattctaatgagtatctaagtttgaggaccactgatctagatcaattaaccatacatacatatatatatatatatatatatatatgcatttttttttaaaaagatacatttaacacctccccccacccaataaaccttatggaaacccaatgcataaaaaagattaaagtggaggtgctttacataaggtgctcttgaaacctggctgagtaggcaccatttgctacacccactccccgtttctttcaaaccctctcatcttcctacagcagtgtcttcaaagaattagggtctgaagagtaggactatttgaaaaataactggtccagagtttaaagggttttaaccatctacatctagaactctggctctttcaattaacttattaactgtatgactttggacaactataaactctctgaacctcagttctcttatatcttaattagagatgatacctatctcacaggttgtaatgaagactaaagttggatatatgctagtgtactgtcagtagagattagttccttcagtagttcaggctttcctccaggctactgcaagctttcaggtctgtcctgggatgggactgatggtttggtttaatctgggaacttcagttaccttcatattatactcatatggtagggtgtacacagattccctttactcatgaggggtctaaaattcctgattgacttgcagcatcataggaataaatggaggtgggatgggggtggagtttgttcactgctgaatgctaagggagaagccaggagcttccatgaaatgactcaggaaatgctctataattcagataaactgttaatcaatggggagggaaccaggcaaagtccattttaaaatgaaaaaggtattaagatccataataggcatagtggaagggctgggggtgttgaggtgggaaggagttctctatggaccagaggagcaggttcatgactgagggaggagttattgattttttttgtaaacaatagatttttaagcaggaatgaagaaacatgaacatattcttccctatttttttgttccaatatggttaaacaaaactcccagataatatagaaaccttgcttattccccttatgaatattttaccagtattgctaagaagtgaaattgattgatattaatttaacttcctcctcttcccacccagacattagtaaatagtgaaatggttgtaagtgttcagggagatgacaaaagagaagtctgaggcttgaggaattacgaagtcagatgatctgtaattgaataatattgagtagaatacacaaatcaaaagtggtgtaaaatctattacaggaaaaactcatttgagtctggccctgtcacagtcattgaactagtgattcaagtctgaacatggccagcagtggtatttcctgtttatctttcacaaagctggcaacaatttccacattatgttctctgcacatctccaacctctacggaatgaaaaatgcattttagtttcctcagcattcacaatgtagaaccttccagagaagctttcttttctttctggcatctggataaatggaggaatagcacgaagcggtaggtgcttaggccaattaagatgtttggtgggctcagtggggatgacccttagtctttaaaacatttttttgtaattatcttattcacatattattatccaaaataccatgactgtggttttggttgctactgcactttaatatagtagatgtatttttactttctatttttctttttttttctttaaagatttccattcttaatagatgagaaaaaaaattcctaagaagtaaaatgttaaagatgcttatttgggatcataggatctcttttagcaatttgcaatctgaagcggagaccacacaatttctggccacattgggatactgtctatactgctgcctctttctcacattatcttcctgctatctgacatacctatgctcacatccaggtactgaacaggggccctacatggctctgaggtaatcagagttcacttgtccacaacttgccattgaaaggctatgccctttagaatttcgtattctgaagaaaatttctattttttttaaatgtttcaatgttagtgagttgcctgaggaaagaatgtgataaaggtagttctaatcaaggtatatgtgagagactaattaatggtaggactcaatgttttatcctgatatgagtatactcatttcaaaaggagtctcctgtaaactccagctaaacaaacacaaaggcattttcaggatttcaggtatacatttgatggctggggcagagtggtgtatagagtttttcatgtagaccctcctcaaatctcaacacatgacttctatttcaaatctattttaaagaccagaactatttaaattttaccctaacatgactaaatttactttcctttatacctccacattgccaggacatttaaaagcctcttccaatcctaccaaagataagacactgatgacatctcatctcctgcctaacttgtgactattctcagtattggtgaagaggtgaaatttgtagatgagggattttaatccttcactttgtatttgatacatgactttatgtattatggtgctgatttttcagcacatctttattttcccttttccagttttaacaatgaacttttccaatctatcgttacttagtgaagacggttaatagtgaatacatggttcaggtatttcttttaacagccctgcaaatagaaatacagtgtaagtcccatatatgattatatattttcctataatcacattaagaaaagaaacaggtaaagtaaaattttaataatacatttaatccaatatgtcagaaacattatcattttaacatgtaatcgtgtaaataatgaggtatctcatttttttcctgaaaaaaaatctttgaaatctgggatttctttgaaatctaggaggtattttacaattacagcctatctcaatttgcaggccatattgaagtgctcaatagctgagtgtggctaccatattcacagccttagaaaattttgagtaagatgaatataagctgtgaacccgtacttagtttcagttagactatcttctttatgaaaatgtttaaatctaaactaatttttctccccacatatgcttctctgctagtgttctccaattcagtagttggccctgacatgcctgtcatatgtggttttaaaggcagaacatggtagacctctaagaggcattaattacagtgcgcacagctgtatgtagcagtatgggctcaataacactacttagttgtccatgccagaaaaagagttatttgagacacatcatcttcctcatttctacactccatcttccaaaattgtctttcactaagtcctttcagttccacctccagagtacatctgggaccggatcacattactccatctctacaatcttctctttaagtaggctgctacctcctagatggctgcaatagcctctaacaggcttcccacatcctctttggatattctccagtccattctccatgttgcaacctgttttgtgaaaggcaaatctgagcatgccacactcccacttaaaatcctctgacaggctgggcgcggtgggtcacgcctgtaatcccagcactttgggaggcccaggcggacggatcacaaggtcaggagatcgagaccatcctggctaaaacggtgaaactccatctctactaaaaatacaaaaaattagctgggcgtggtggcaggcgcatggagtcccagctactcgggaggctgaggcaggggaatggcatgaagctgggaggcggaggttgcagtgagccgagatcgccccactgcactccagcctggatgacagagcgagactccatctcaaaaataaaataaaataaaataaaataaataaaataaaataaaataaaataaaaaaataaaatatcctctgacaacttcccaggcttttatacttgagtccaaaatcctatggtgacctacaaggtctttgtgatctggctctatttatctactactccttccttctttattttgctatgctactcgctcttcctgtgtgaggattttcacatactctcttacttttatctgcagtgcttgtttgcatgctctctctctttctctctctttctgtttctctctctctgcctggctaacctctttttgctgttctgcttaaatgtgactttttcaggaacaccttctctaacttccttgacttttgggccccatcctgtatgtttttatatcaaacaggaccactatgtttttttcaggacacttatcacaattttatctatatgattatttgtgtaattttagtatattatctgtctccactgatgtaagcttcatacaaatagagaaccaaatctcccttgtttattccttttatgtctgtagtactagcctagggcctggcatatattaagccttcaataacttccagctgaatctgcgaatgcatgtgctcagcccattgtctgtagcagcttggtagttttaagaggcttctcaagcttgcagaaacccttgtgggtatgactaagtgttccagcttctgtttcattgtgaagattttagaagtgtagcctttaagaggcatactacaatccttccaaaaacaaagaaagtctgaaaataaatttgggagaggatgtggaacaaagtaatttctacactaataggaaaaatgcaaattggtgtaacttctttggactgtgtccccaaacaaaagctgggtcatgtcaactggctgttattctgtcttcttggttattgggtgtttctttgtgggggtattccttctagtgggtcataacatatgccataaaaatccacattgtggccacttccatagacccatctgcagacaggcctttactcagatcttcttgtcccagatctttcaatctttcttctttcaggtgcctgcccaattagccagggtattcttcactgtttattaatccttatatcttctaacagcaagtcacttcttgtccacacaaagaggatgatttagtatactgccttcgtccattgggaagattttcccctcttcgctgtctttcgaggccatccctaagggagggttgttatgcaacagcagtccatttttgggtcacaccgagatactgagctgattcatttatgagctagttttccctctttcagctggccattagggactcaacacagggctacaggtatcgtttgaagagaaatggatgatatgggtttgacagtcatgcaatttgcttgtgccccctggccctgcctttgtccaatcctggaagtatcatttccatcttatgatggagtactaccagacctgcctaatcatatgaattattgcatttgttagaactcagcttaatgtggttatttcttattgtagggtaacttgaggttctatggtcagatgctcagtctctactagggctcagtagtattccaagagctgctgtttgaatgttatatagttcctggctgaagatggcatgctttgttttagaatcctggggaactgcttatgttatgattctactatttctttctataaaatccacatggtgtcttttcaaaccacagaaaccccaagaaccaaaagttttgccgtatcatattgcataagtcatagggtcacttttatgacaacctgaacctgctggagagccctttggtgttttgagctccactcacagctggtaaatgtgtattgttgcctaacctatgtaaatgggtactgcttctgatcttcttactgatagggatggaaaagaatgcatttgccagataaatggctgcatactacatgtcatatattgtgttaatctgctgtaatgaagctatcatatctggcccagcaattgcaactgtggctactacttggttattatagaatgttgtagattttatttctttaataattaatggacattagagattttctaaatctttaatttctaaattagagattttctgaatctctctgagcccatattggtagttcatactttcctaggaatatgtctatttcacctaaggaatttagtaaatttctcttattacctttttaatatctgctacatctgtagttgtgtccctttttgattcataatattatttgtgccctctttctgtatttctcattcacttttgccagaggtatgccaattttattagtttttgcaaagaaccaatatttggctctgttgtttccttctagtctatctttgctttctgttttattaatttcttcctcttgtctttatcttctcaatttttatattattcctatttgctcttttcttaacttttctaagttgaaggttgtattagtcagggttctcttagagggacagaactaataagatacacacacacacacacacacacacaaaaaaaaactaataggatatatatatgtatatatacacatacaaaactaataggatatatatatatatatatacacacactcacacagaactaataggagatatatatatatatgagtttattaagtattaacttacatgattacaaggtcccacaataggctgtctgcaaggggaggagaaaggagaccctgtccaagtcccaaaactgaagaacttgtagtccattgtttgagggcaggaagcatccagctcgagaaaaagatgtaggctgggagactaggcatgtctcacctttttcacgtttttctgcctgctttatatttgctggaagctcattagatagtgcccaccagattaagggtggatctgccttccccagcccactgactcaaatgttaatcacttttggcaacacccacacagacacactcaggattaatactttgtatccctcagtccaatcaagttgacactcattattaaccatcacagaggtttagcacattaatttttcaccctttcttgtttcttattataagtatttaaggctataaatcttcttttactttggatttaaaaattatgtatatttaagttgtaaatggctctaaatctgtctctatctgcatctcacaattcttgatttgtagttcttttgttatctttcagttgtatgtattttctattttttagtattttctaatttttattcttctatagcccatgagtaatttagaagtatgtttttgaattttctaatgtgtaattttgtttgatagttcgttttgctgctgattgttaatttaacttttttgtcagatattgcaatgtatgagatatagattctctgaaatttgtcaatatctattttatggcctgaaatgtggttaatttttataaaccgtgtgtgcttgaaaagaatgtgtattctcaagttgttggatgcattgtttcatagacacacattaaattaaccttgtgctgttcaaatttttatatcattattgatttgttgctgtttgacatatcagttagtgaggaggtatgttaaaatcttccatttatgtggatttgtccatttctctgtagtccagatattttttgccttatactttgaaatgtgttattaagtgcatatatatgtaaattgtttttttttccaggtagttattcatttttattttttatttttttattttttatttatttatttttattatactttaagttttagggtacatgtgcacaatgtgcaggttagttacatatgtatacatgtgccatgctggtgcactgcacccacaaacttgtcatctagcattaggtatatctcccaatgctatccctccccactccccccaacccacaacagtccccagagtgtgatgttccccttcctgtgtccatgtgttcttattgttcaattcccacctatgagtgagaatatgcagtgtttggttttttgttcttgtgatagtttactgagaatgatgatttccaatttcatccgtgtccctacaaaggacatgaactcaccattttttatggctgcatagtattccatggtgtatatgtgccacattttcttaatccagtctatcattgttggacatttgggttggttccaagtctttgctattgtgaataatgccgcaataaacataggtgtgcatgtgtctttatagcagcatgatttatagtcctttgggtatatacccagtaatgggatggctgggtcaaatggtatttctagttctagatccctgaggaatcgccacactgacttccacaatggttgaactagtctacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcctttgagaagtgtctgttcatgtcctttgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatgtattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagcctagtagtatagtttgaagtcaggtagtgtgatgcctccagctttgttcttttggctcaggattgacttgatgatgcgggctcttttttggttccatatgaactttaaagtagttttttccaattctgtgaagaaagtcattggtagcttcatggggatggcattgaatctataaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctttttaaagcaattgtgaatgggagttcactcatgatttggctctctgtttgtctgttgttggtgtataagaatgcttgtgatttttgtaccttgattttttatcctgagactttgctgaagttgcttatcagcttaaggaggttttgggctgagaagatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttatgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttatgcatctattgagataatcatgtggtttttgtctttggttctgtttatatgctggattacatttatagatttatgtatattgaaccagtcttgcatcccagggatgaagcccacttgatcatggtggataagctttttgaggtgctgctggattcggtttgctagtattttattgaggatttttgcatcaatgttcatcaaggatattggtctaaaattctcttttttggttgtgtctctgcccatctttggtatcaggatgatgtcaggatgatgctggcctcataaaatgagttaggaaggattccctctttttctattgattggaatagtttcagaaggaatggtaccagttcctccttgtacctctggtagaattcggctgtgaatccatctggtcctggactctttttcgttggtaagctattgattattgccacaatttcagctcctgttattggtctattcagagattcagcttcttcctggtttagtcttgggaaggtgtatgtgtcaaggaatttatacatttcttctagattttctagtttatttgcatagaggtgtttgtagtattctctgatggtagtttgcatttctgtgggatgggtggtgatatcccctttaacattttttattgcgtctgtttgattcttctctctttttttctttattagtcttgctagcggtctatcaattttgttgatcctttcaaaaaactagctcccggattcgttaattttttgaagggttttttgtgtctctatttccttcagttctgctctgattttagttatttcttgccttctgctagcttttgaatgtgtttgttgttgcttttctaattcttttaattgtgatgttagggtgtcaattttggatctttcctgctttctcttgtgggcgtttagtgctataaatttccctctacacactgctttggatgcgtcccagagattctggtatgttgtgtctttgttctcgttggtttcaaacaacatctttatttctgccttcatttcgttatgtacccagtagtcattcaggagcaggttgttcagttttcatgtagttgagcggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattaagtaatgtccttctttgtctcttttgatctttgttggtttaaagtctgttttattagagactaggattgcaacccctgcctttttttgttttccatttgcttggtagatctttctccatccttttattttgagcctatgtgtgtctctgtccatgagatgggtttcctgaatacagcacactgatgggtcttgactctttatccaatttgccagtctgtgtcttttaattggagcatttagtgcatttacatttaaagttaatattgttatgtgtgagtttgatcctgtcattatgatgttagctggttattttgctccttagttgatgcagtttcttcctagtctcgatggtctttacattttggcatgattttgcagtggctggtaccggttgttcctttccatatttagcacttccttcaggagctcttttagggcaggcctggtggtgacaaaatctctcagcatttgcttgtctgtaaagtattttatttctccttaacttatgaagcttagtttggctggatatgaaattctgggttgaaaattcttttctttaagaatgttgaatattggccctcactctcttctggcttgtagagtttctgccgagagatctgctgttagtctgatgggcttccctttgagggtaacccgacctttctctctggctgcccttaacattttttccttcatttcaactttggtgaatttgacaattatgtgtcttggtgttgctcttctcgaggagtatctttgtggtgttctctgtatttcctgattctgaatgttggcctgccttgctagattggggaagttctcctggataatatcctgcagagtgttttccaacttggttccattctcccggtcactttcaggcacaccaatcagacgtagatttggtcttttcacgtagtcccatatttcttggaggctttgctcgtttctttttattcttttttctctaaacttcccttctcgcttcatttcattcatttcatcttccatcgttgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagcttggagtaatttgatcatctgaagccttcttctctcagctcgtcaaagtcattctccatccagctttgttccgttgctggtgaggaactgcattcctttggaggaggagaggcactctgctttttagagtttccagtttttctgttctgttttttccccatctttgtggttttatctacttttggtctttgatgatggtgatgtacagatgggtttttggtgtggatgtcctttctgtttcttagttttctttctaacggacaggaccctcagctgcaggtctgttggaataccctgccatgtgaggtgtcagtgtgcccctgctggggggtgcctcccagttaggctgctcaggggtcaggggtcagggacccacttgcggaggcagtctgcccattctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctcctttgtttacccaagcaagcctgggcaatggcgggcgcccctcccccagcctcactgccaccttgcagtttgatctcagactgctgtgctagcaatcagcaagactctgtgggtgtaggaccctctgagccaggtgcgggatataatctcctggttcgccgttttttaagccagtcggaaaagcgcagtattagggtgggagtgacccgattttccagatgccgtctgtcaccactttctttgactaggaaagggaactccctgaccccttgtgcttcccgagtgaggcaatgcctcgccctgcttctgctctcgcacagtgcgcgcacccactgacctgtgcccactgtctggcactccctaatgagatgaacccggtacctgagatggaaatgcagaaatcacctgtcttctgcgtcggtcatgctgggagctgtagaccggaggtgttcctattcggccatcttggctcctcctcctagttattccatatgtaaattgttatatcttcttgatgaattgagatttttatgtagtcatctttttttatcaataatccttttgccttgaagtctattttgtctcatactaataaaactgtaccagtttttaaattagtgttttcttgatttttctataaatttgacattaaatttttgttttattttaaatttttgtatgttaagctttagatggtgtctcttgcaataacttagagttgtattttctttttaatccagtctgacaatatttgtcttttaaccaggtaatctaggcagtttacattgatcatgattaatattatatttggattcatttctatcatcttataatggtttggactgaagtgttgatctggattgttgcacatcccttggttgaaagatgttacagccactgaatcacccaatcactgatccacatcctattattttgaactatccctatggcccccaatagcatagtgacttagggttaaatggcagtgtaaaaggatacaggaggctgggtgcagtggctcacgcctgtaatcccagcactttgggaagccaacgtgggtagatcacaaggtcaggagttcgagactagcctgaccaacatggtgaaatcccgtctctactaaaaatacaaaaattagctgggcatggtggctcatgcctgtaatcccagctactcaggaggctgagacaggagaatcacttgaacccaggaggtggaggttgccgtgagctgagatcacaccattgcactccagcctgggcgacagagcaagactccatctcaaaaaaaaaaatgtatacgggaactggagatggtaagtgggctgaagagcagtttcaggaaagaagttcatcatcatcctatatttaaaggactatgatatgtgtataaaagagggattaaaacatgagcagcaaatgacagaactagagcaaatgagtggaataataccttattccttgagcagctgttatgtgccaggaaaattgctaaatacttttcacatatagcttaattcatacaacaaaccactgagggaagggctcatcatccttatttcataggtgagaaaaatgaggctcagagagattaaagaagatacttgaagtcaaacaactagtaactggcagaattgggaatcatactcaattttgtatgactctaaaacccttgttctttttactgaattacatcacagagaggtgaactggtaaataccaaatgaaggaagaatactttttataattaaaattcataaaaaagtaatgaactatcatttgaaatggtaagcatcccatcactgggcatttctaaacagaggtaatgtggtcatgtgtcaggactgttatagtgagagttttactttgagtgggaagttgtactttagaacagacgcttggattagatggtcattaattatggtctatttcagtttccatgaggttattgaaactgtgccagagcttaacaaatgcatgattttcaaaactctccctaccttctgaaactagccgcaatgtgaacttgtcctttcttcacttagcctccttaactcactgcagtgttatgtgatgtgtacaggtggggactttaataaaaccctatttgatgatgacttgatgaaagtctatttggcctgtttagataggagaaaaacaagtcatgtgtataagtgcagtgtaaggttctttaatttgaaatactggagccaagcaatgcaaaagctgagagactccatttaatagcatgttaatatattaaaacccttaataataaattcatagcacttaaaatacaaatatttctacaatgtaatattattttacagatggtatttagtaaatagccagtatttactgggaagtggggaattcattgtcctttgtgccttgctttgttgacacattctaccatgtgaaggccaagagcccgtaagaatagaaaaacctttctgtcagcagcagcctcatcaagctggtccctctgtagactctgctctgtccacttattttctttatccttactgctaatccatcaagtaaccatttcgccttcttttaaagcccagccacaagcattatttcttcccggagctttcattgacctgtgcctctccctgcactgtacctctcgaggtatccagtagtggcagttgaagtatatgaagaaggattttatacattatttacttttgttctgagtagttcttttaaaccttgtgaaagcaatttcacaagtgtttcctatagtattgctctgatgtggataggaaagacctcattatagcctttggacatgaagaaactgagacatcaggaggctgagaattgccaaatagtggtagagttttagcatctttcagctccacagctctactagccaaatgtgcgttccaaaatatttcccacaggtttctgactcttggattttaagtagtatgttatggctggtacctgggatttggtgtatttaaaatttgtttgggccagtcgcagtggctcacgcctgtaatcccagcactttgggaggctgaggcgggtggatcacctgaggttgggagttcgagaccagcctggccaacatgttgaaacgctgtctctactaaaaatacaaaaattagccaggcatggtggtgcacacctgtaattccagctactctggaggccaaggcaggagaatcgcttgaacccaggaggtggaggttgcagtgagcagagatcctctcactgcactccagcctgggtgacagagcgaatctttgtctcaaaaaaaaaaaaaaaaaacactgtttgactcattatttgaatgggccaagcaagggctgaccaatgcatagagagaagtatggttattgaatccctactagaatgtgaacaaattttgagaaaggcctaccattgaggtgagtgtgctgtaacctgagcacgtgagaccaaaaaaacacctgagaaaaatttttgctttcaaaattcatccatgtgactctatagattggatattctggtttcatccatttagccccaaactgacagagggttgtcttgggcagtcagagatgtgtagtgtaaagattattgggcactacttaggagccaaaggttctaattatggagcgtcttaagattagattcatcttttttactttcctggcctcagctctctcttatggcaagtgaggggtttgcaatgaggtcagtggttctcagaccatagcctttggagtacatggaccagaatcgccaggttatttgttaaaagttgagatgctggactccatctaggcctactgaattggaatctctggagtggcacttgtttatctgccttttgacaagctgaccaaatatgcacactaaagtttgagtacctctggatgatgtagattctaaggttccttccagctctatgatactttgaatgagaaagacaaagacagacagcaattacggatttcatttcaggtttctttactattctttaatgtcagagcctttagtgattttaaatttgccagaaatcacctaattagcatgtgatgacaatatactattttcattttttatgtctgcctcccccagcttattatcagcattgtttctatttcttttgtgcattactacagtaatcatcaatctcttcttattcacttccatcctttgtatcatcatcagagatttttggtgttgtttttgtccataaaacaacaaacacaaaaaatgtccctcacatgattaataagttgcttttttttctggcaataaaaacccttaatttctcagcatggcttactagacctttccaagtattatttatctttgtagttttatctcccaaatttttacccacatccagccaggaatcctttaattctcaaactagtttaggtagctgattacctagagtcatcttgtttctttctttcttattaaatatgaaatagctttatagttaacttcattgtacgatctggtacaattttattcatagaaaatattactatatgataacattttagaccgtaagcatttattaataataaaaaaaaaccaagcactggatttagtttggctctctctgagttttttacctaatatattttctatcttttttaactgtttgctacctctttctgttagaaaagtgaagaaaaataccaaagaaatatttttgtaagaataacttaaaattaagagtattccacatatcaatttaaaaacaaaatttcaacagattgctacagattgcttttatatggtttaaataataaattactttgattccatttatggagcactggtgttttttgtgaacgctgttaggtaacaggacctgtgtccctgtggttctctttctggaatgcctttctgaagcttctcctcttaaagaattcctgctcatttttcaagacccagtagatttgtcaccaattgcaaagccttttctgaccctcatagaaataactatcaactctctcctctatattttccagatttcttggtatgttcatctctacttaaaaaactaatatctaacatcattataataataatgattattctgtttatctcctctcttcctctcttgcctctatgggtcctggcacaaagtttatgttccataattgatgttaaatgaatgtcttgttttgactaagatatttgttccttaagaaccttatccgtcttacctttattctgtaggaccaagaacacaagatcttatgtgtacccatttagcgatgacagactgaccaagtgatctggcttttctccacgctctgggaaatagtttaactctgtcaaagagcagtcaagaaaagttcatatattgagagtgatgtgatgatggctgtttgaaaagcttggaactacctttttagatcaaataggcttggttctgtctcaaatctggattagggccaatactttgataacccagtcagcaaagatcagaagtcaagaattcacaatctttcatcgtgctctgaaatcatttgtcaataaacaacaaagaccttctagggctggatattagagagggaagtagccgagagcttggaaggggagcttttctatcagctgaggactctggatgggaaaaaggcttagttcaggtctggtaaagaatttgagaataagcgaaattcaaggacacagtagtcaagaaagtgtttagtactgggtgttggctcggatgtgaggaaaaaggcactttacactgttagtgaggacagaagtagaaattggtacagcctttctggagtgcagttctgcaaggtgtattaaaaatgttaaaggtgtttatactttttttcccaccaattctacttctaagaatttttcctaatgacatactctaataagtataccaggatttttgtataaagaaatttatttagaacaactataaaggtcccaaaatagggaactgattaaacaaattgattaatctatacaaggtaatatcacacaggcattcaaataatgatgtagagatatatttatagaaaaggaaaggggtatatgatgtattatcagatttaagaatctatttatgaaataataggtagattatgattattttttgtaaaacagatatatacatgtatatatatattttatatatacacacacatatgctacacaatttatggaagttgtcaatgagagattttttttagtttaccttgatgttacaaattttctacagataatatataatactcaaattataaagaaataattttttcaaactatatttttcaaaatatttcaaaaatttcaaaaataattatttttcaaaataattttgaaaaagttatttcttatagaagggataattctttcagattggtattctccaggttgactgaatagtgcttggaacagagtacatgtgtgatatgtattagcaaatttaatgactgagtgaataggcaaatgactttactccaaacttggtagtgtaggttttattggtgagaattttctaaattttatccattcatcttccactggaactgcatctgtaggatagctgatttttgattcctgagatcttttctttttttttttttcctggttttcacttttttttttctctcttcaacttttattttaagttctgggttactagtgcaggatgtacagatttgttacgtaggtaaacatgtgccatggtggtttgctgcacagatcaacccatcacctaggtataaagctcagcatccattagcttttcttcctgatgctcttcctcccctgaaccgctctcccaataggccccaatatgtgttgtttcccccagtgtgtccatgtgctctcatcattcagctcccacttataagtgagaacatgtggtgtttggttttctgttcctggattagtttgctgaggataatggcttccagctccatccatgtccctgcacaggacatgatcttattcctttttatggttgcatagtattccattatgtatatgtaccacattttctttatccagtctatcctggatggtcatttgggttgattccatgtctttgctgttgtgaatagtgctgcaatgaacatatatgtgcatgtatctttataatggaatgatttatattcctttggttatatacccagtaatgggattgccggatcaaatggcatttctgcttctagatctttgaggaatttccacactgtcttccacaattgttgaactaatttacactcccaccaacagtgtaacagcattcctttttcttcacaaacttgccagcatcagttgtttcttgacttttcaatgaaccaccattctgattgcataagatggtatttcactgtggttttgatttgcatttctctaatgaccagtgatgaaaagctttttttaatatacttgttggttgcatgaatgtcttcttttgagaagtgtctgttcatgtcccttgcccactttttaatggggttgtttaattttttcttgtaaatttgtttaagttctttgtagattctagatattagacctctctcagattattagattgcaaacattttctcccattctgtaggttgtctgttcactctgatgatagtttcttttgctgtgcagaagctctttagtttaattagatcccatttgtcaagttttgcttttgttgcaattgcttttggtgttttcataattaaatctttgcccatgcctctgtcctgaatggtattgcctagattttgttctaggttttttatagttttgggttttacatttacatctttaatccatcttgagttaatttttgtataaggtataagtaaggggtccagtttcaattttctgcatatggctagccagttctcccagcaccatttattataaagagaatcctttccacattgtttgtttttgtcaggtttgttgaagatgagatgtttgtaggtgtgtggtcttatttttgagttctctattctgttccattctatgtgtctgttttttgtaccactaccatgctgttttggttactttagacttgtagtatagttttaaggtgggtagcatgatggctccaactttgttctttttgcttaggattgtcttgactattcagcctctttgttccatacaagctttaaaattttttgttctaattctgtgaagaatgtcggtagtttaatggaaatagcattgaatctttaaattagtttgggcagtatgaccattttgatgatattgattcctcctatccatgagcatggaatgtttctccatttgtttgtgtcctctctgatttatttgatcagtggtttgtaattctccttggaggggtccttcacttcccttgttagctgtattcctaggcattttattctttttgtaggaattgtgaatgggagttcattcatgatttggctctgcttgcctgttgttggtgtatagtaatgctagtgatttttgcatattgattttgtatcctgagcctttgctgaagtttcttatcagcttaagatgcttttgggctgagacgatggggttttctagatataagatcatgtcatctgcaaacaaagataatttgacttcctctcctcctatttcagtaatctttatttctttctcttgcctgattgccctggccagaacttccaacactatgttgaacaggagtggtgagagagggcatccttgtcttgtaccagttttcaaggggaatgctttcagcttttgcccactcagtgtgatattgcctgtgggtttgtcatatatggctctgattatatcatgatatgaggttacatcccttccttggtatgagtttgtgccccttcctgtgtctgagtgttgacgatatatttctgactggtcattagttgtttttgttcatttcattaagggttttgagagtcaggttccattaaccagtgtcattccaccattttattctgtgacttcttttggtgctattacatttagaaaattcttcctctctaaaatgtggtaaatatttacctacttagcttttaaaatatattttcatttaattctaaaatgtatttgaaattaatttttatatgatgtgaagtgagaccacaagttgatatttttcttttgaaatacataaccagttttacacaaaccgtttatagagtagtccattttttccatattggtttatgatgtatgttctgtcacatattaagttataatgtgtacaaggctctatttcaggcctgtttgttttgttgtgttaattcgtctgttgattcttataccaccattacactattttgtatgtgttataaaaggcagtttaatattgagtttgggtacatttccactgattttacttttttaaacagttgaactattttcacacacaatatttgccaaatgcaatgcttgacattatatcaaaaatataaattaattttggaataattaacatgttttattatgtagtctacctctccgggagcatattttatctttccatttgtttaagttttcttctatcttgcatccctcaaggttttacttaagaaatttatagtttgtaagtattatgtattgacctttccctcattacattttctaattattgttagtatatagaaaattgaatcttgaatatgtattttataattagtgattttcttgagtattattattgattttggttctttttgtatcttttagaaaagcaatcataccttctgcaaataattataacttctattctcttttgaaatagttgtatcttgtttcttttcttgcatgttagtatgatcttggacatccttaccttcctcctgattttaatgagagcagctttaataatttgcagctaagaggtaactggcctaaaagaaattaggaaatacacttagcttcctagtgaggcttaaaaatcagaaaaaaaaacagtgttgaattttatcaaatgatcttttgttctttttttaaaataattatgtcctcttatttgacctagtgatgcaatgtgttatattaatatatttctaatattaaacaatccttgcatttctgaggtaatccctacttgattatgctgggttattgttttaatatactttgacttaattttccagatttgttatttagaattttcacaactgtattcataaataaaacttgtttggaagaacatttcttgaaatgcattctaagaaggaatgttatgaggaagaaatggttccgtggtcaaatacacttgagaaaggcagattaaaacattttaacaaatttctttgctttaggtttctcagagactttaatatgctaatacatgctgtaatctctgagggagtgcttttcaagcacactcacaatagattccattcccccctcagaaagtgacactaatttccacagaaccctctttggaatattaatcattgtcatattttgttatgagggttatgtcaacgtcataaagtgagttaggatagcttttcctactttaacctaccctggaatggattatataatgcgggtctcataagtttcttgaaaacgtgaaaggcctagaaccagttttgcaaattatcccttaataacatttgctaaattttccatggctattcagctttcttataatattgaatcaatgttattaattcatatttctagaaaatggttcactttattgaaatttttaaatttgttaaaacgtgattgtgagtggaattctcttttaattcttaaaatatgtttcatttacctgttggtaaatacaatgaaatgaaatgatctgtgccaaatacttgaaacagtgcatggcacatggtaaatggtaaatgttttatttcctccccctttttcttattctgtatctttctttttcaaaaaatttagatttgtcagaactttgttgatttaaaaactttgtttcccagataataacctcttctgcttatcttttaatctacttatctcttccatctatttatttgattgtttaaaaattcatcactgttcaccctagatttatattttattcttcctgcttttttatagtttttttctttcttttctagctagcttcttgaattgattgaataattcttttaaaacaaaattcttgattagtaatgaaaatattcaagtctatcaatttgatttaaaaatagttctgtattttgtggtcctttatgcacattgtacaaaactcaaagcatacaaaagggcttacagataatagtgaattttcttcattctcctgccttagtcttcttgttcctcaccaggaggtaaccacaattatgatgttcttgtgtttccttccagaggtattctaagtggatttggctattgagtacagctttgtcagaactatatatatttttatttaattattactttcattattttaaaatagaatttgctattaatttaaatttctcacttgatacaataattaggagggtcaaattaaaatacttattcataggacattttttgttattaatttctagttttgctgcattgtgattaaagaatgtagtctataatttctgctactttgaaagtcctgaggttaatcatgtgaacaattacaaggtcaaatcttataaatattttatgaaatattttaaaatttataatcttcaaagggcacaaagtatataattaattcaaaataatttttatttattgtggtttacttgatctattacagacagcaataaatttatttccttctcaaatcgaaattttgttgttttatttatccttataataacttaaaaatttgtatgccataatattttgcataaattatgattatgataaattatgatgctatgagaataaacacaagcataaaagcaaactctggcttgtaaattttattaaataaataagtcctgaaagtaacacctatgccaggatataaacattcaattagtgcagcaggatatcaaattagaagtaaaatttttgttcagactccccatttctaatctcacatttcagtcataattacttttgaatgctttgtatttcttctaatagttacctccataactctaaataatgtgtttagatctttcattcttaattagtaactatagactttatctattgattcttcgatatgaaagagtaaggctcaagttatttatactaccctaagctttccttttcaaattcttcccaattgtaatttttttcttagatgaataacttttgtaatttttaaaaatacttaagcttcaacttcttgattcatcaactttaaacattttttggactcttggttattttttgactcttggggaatgaatttcccaatttagcattctctatgtcttcctttctctactgtctgactcctgttagctatgttatcactttatgtggggaatgtttagagcattctgttctctaattctaattaaattttctatactttgtaggttaattctgaaagtcaaatactggtggaattttaatataatagttatataaatattcatttcatgtttgaggaatattgggtatgtagagaaagcaatgcaactcaacacctacgcccctttaaggagaattttctaaaggtcaagattaaatggattttctctttctattttaatatttcatccattattcagactattgtcatgatttaacttgtttcatatttggaccattcttgggaaatgttttgggtttaattgccttttttcttgagaaaagaaacacatatctttttaccatattgccaatatcttgcaattgtttaatgctttagtaagtatcactctatttctaggtctgtttcaaagctgtcaccctgatatttctctttattccacttctagattagtttcactatttcttagatcctgtgtactcccttttaagaacatttctttttcctccccttcaggacatttattcaagtgattttttttccataaagggtgcatgggaggtaaacttcctgggtccttgtttttctgaaaatgtatttatttttccctaatccttgactgatagttttggtaggtacagaattctagatttaaaatgatttccagctgagcgtggtgactcatggcgtaataccagcactttgggaggctgaggtggtagatcacttgagatcaggagtttgagaccagactggccaccatggtgaaaccccgtctgtgctagaaatacaaaaatacttagctgggcgtcgtggcgcatgcctctaatccaagctacttgggaggctgaggcacaagaatcacttgaacctgggaggcagaggttgcagtgagccgagatcacgccactgtactccagcatgggcaacagagcaagactccatctcaatgataataataataataataataataataataataataataataataatttcttattagtaatttgaaggcattgcttctttgtctttcagcattgactgttcctaataaaaagcctgaggccaagtttattctctttactttctaggtaacctgaagtgctctatcacaaattatattttcttcagtttcattctgttcttcattattgtcaatatgcttttaaactcttgattttgttttgggtttccttatattttcatattttagccaattatttttttcagcttgttctctatttattgtgttctgaccttgtttcatagagatgatgaccttttacatatttatgaagacagcaaaactggtttaaattttcactgagaaaactctttttagaagtttctctttctttgaggttttagagagttatctattttttctgttgttgaagtatctttttttccataatcccattgttggctctttttctactttttcattcttgaattgtgtgagatttatccaggctttgtctttattaacaaaaataataggtgaattattttttgcttcacttgccgttcacacattttgcccagatttaaactaaaattttaatttgatggttttttcaaatgtctaacgggctttcatctgtcatggatttaggtgaattaatacaactcttgcattttttaaactgtaaggttacatgtaatttgaagttgtttgaatagtgtaaaacattaattagttttttctaaataactgtgcttccactcatgctgattattttgctaagttaagagatctgaggtcttttagcaaaagtaaaataagtagagctcatagaatgggaagactggtttgtgtaggagcccatgactgcagtaaagaaagttcccataagactgattgctgctcactatatttctcaccactgtagcccctgtcttctgaaacatggtgtaaactctatgggtaatcaacatcttttcttatatttttttgagaccagaatggaaggaagcacccattttatgtggttgtaaaaataaaatatgtgatgtatggtctaaaactacacctgccaacctattactgatgatacattaaatggaatttttatactcatagtaattctgatctttggctttctgtactttgccagtcaatgaaggtgtgtgcatgtgtgcatgtacatatgcgtgcatgattttttcataatgggagatgggggaggccctatcatacataatagcctgctgcctgctgccatgttaagaagtccaaccattagtctgttttgataagctaggcatctcaagtagccctattgatttttctttagttcttcttcttttttgttttctgttcatttttgtgtttttaatttatcctaggcagttgaattaaattgtcttccacttaattcatctcagcttccctcccagtctttttatgtccaaagtccttcaccagtcttcctattgcctccagattgtgagccaatttcttgaaggtggagccaagtctcactctttatatctccgtataatacatgtttcatacatacctactgataagctgatcagcttaatgatggggatagaagtgagctcctactcctgttttttccgtcaaaggtaaaccctggaaaaggacaaagttcgagtaatattttctacggagagcttggaactcagacgtcttctatggagttctcatcttcttgctcccttgccttttggtgagggaaagaatatgccacctgtcttgtctcctgggaccatgccaataagtgtgctgccccaggggctctgcaggatgggtttgttctcctgctcaccttgctccatccctgccctacctttcatctgctttcaggaggctcaaattgttttcttgtttccttctttccctttcccccaaacctccagtaaagaagagattttggtattaagaaaatgggctgttgaattccaaaatcagaaatagaccacataaatatgtatgaagcattaaaacccttcttcgaagtgtgatttcctggctaatggatgcttctgggatgattattatatatatttttgtactcaattaagccctattcagaccaacttattttttggtgaacttaaggaccttatgattagcatccattagcatttccattacatctatattgtaataataccatctaaaatttctatgctgtatctctcacagagtgcttttatgccattattttatttgatactcccaacaacaccatgaagaatgttgagattctcttaacatttttgttttatagatgaggagactgaggtgcagaacatttaagcgacttgtccaaagtcatgcagtgagtaagggagtggaatgctgactaggagccatgtcctcagctagtatggcaagggcatgctccctatcactgctagtaatagcaaatgatcactaccactgagtatttgcatcatgccagctactatattaggctctctgtatatattttctcatttaatactcctcataaccctgcaaagtaggaattgttattattccccccgttacatagaggggaactgcaatttagagaggttacgtaacttggtccaagtcacacagctagtcctagtatacctaggactatactgcagttggaacccaggtttccctgatttcaggcctcagccctagccacgtgggtccctcatggttttactggactgagctatgaagatattcaacatagcatagctcataaaggctgttccagttctcatgattccctgagctgtgattacgagctctccttgtgactcctatggctctggggcatattgccagaggtaaaattgggagctgtatggatcagaaaggcagagaaagtgaagggactaatatttactgaatgcttactatatgcccagtggccattaaaacccatatcacaggaaccttgtaagtctggtattatcatttccactttatggaggaggaaacacaggttcagagaggtaaagaaacgtatgcaagattgtaagtggaagagtcaggatttttagtcaggtctgtcagaccttatagcccatgttttctcctctatgcctaagtaggagtgggctcagtggtgatgttttaagggctaatgttgatgttttaagggctaatgagaaggagcagtatttctaaagggcttaaggaggattataaggaacagagatgaatttagaccctggtggttataatgcattataatcagtactctggagccctataaaggaactcataagagaacccaaagagaagaaaaactgtggcaagttttaggctacattgcctagcttatatcacaatgccagcagccttcaactgcaatacgtaggaactgggacttaaaaaccagcagaaacacattggtaaacatcataatgacacgcatatttaggaaaatgatgtttttaatttcaaaatctatgcagccttgccttatatagtcagtgctaggaagttgtggtgtaccaggaaatgatttacattttagccttaggcaaaaatatggaacttgtaattatgtcagagagaggcaaaaccttccagattttacagctttaaagctgtaaaagtctcagttaggatgtgtgttgattaaactgtggtgtggctgagcattttgcctgaaacttcatagggaataagcatctgttaatgactttcaggtaaaaaccttccttctaaacctttaatgcagtattgtcaaaatgtggaagtggtgggtgacaagcattttcttgttccttctaaggccttcctgatccaaggtagttttgagcacaaacggctgtgctggttaagcttttggcttgtgggaagaaagccgcacatcaactcctgatacgcacgagctagcctgaactctgtgatgaccatcagatgcagataaactgccagacagagaagctgtcttgtagatgtgactttgctgccttcaagagcagggctttctgcacctatgctctaagcgcccttagtgttcctctcccagtggtcctggattgatttctctaatggggagcctcctctgtagggtctacaaggtgactggtggattgattgccctactccacgtaatgtgagtaggcgattgtaaaggggaggctgaagagcttgcctgttttctttgttattcttcttactgagagaggtggactagagtggtagttcaaagatctggctctgcagtcacagatctgggtaccaatcaaggttctgtccctgattttctgtgtgaccttgagcacatcatttatcatctctaagcctctttctcatcttttaatgctttattcacaatacctggttcacaggattgttgtgggaattaaatgagataatgtgatattaagtccttaggacttttaaagttgacatagtattataactgttacctccgctaatagcgtcaaaccttgggtctaatcagggctcagtctctttactatttgtgtgaccttcctaaccattttgccattctgtctcccttctgaacatagcaaatataactagcttgctttggccttcaaattaatagaattcatcagccacagatctctgtgagccacttgctctgtaacagggaaggagtatgtgtgtctggcatgggagcttgccaagaatatttgctcaatagctatgctattataccatcacgtgctgctgtggctttataggaagtatatcctggatggttattacatatttagctggaatttagtttcctagggaaataaaagtttcatattttaagaatagacaattattttgaacaagtggtttatgtccacagaaagttcatgttcttatcttttatgtttgaatgaaggcactgtgtatgaggtgtccctgaacattggaagtctaaagagcatggatttggatgtcaaaactgggtccagattgaagttatgacatggaccacctgtgagagccttaatttcttcctgtgtgaatgtaaataatacctacctcatgggattaaaagagaaaataatataagaaagcatatatcatattatgtaacacatagtagcctctcaataaaagttactggttactattttgggcagatccaaacattatgttaataaatttcaatggctcccacattttattctttggggtggcacattctgtagagatatcttaggggctacagagggacagtgatggagggactaaggaaatagtatccaggctctctgccccacttcccaagaagctctgcttatgtctgttttatatctagggcatctgagattgttttacgggggagaaagaaggctttataagtgctttcagttcaatttattaatttttccctcaatgaaccgtagttttagtgttgtatctaagaaatctttgtatatcccaaggtcacaaaggttttcttctagaagtttttatgatttagagttttaaatttaggcgtatgatcaattttttagtccatttttgtttatggtaagaggtgtggtgtattagtttgctaggactgccataaagcatcacagattaagtggcttaaaaaatagaaatatattttttcacaattcttgaggctggaagtctgagatctaggtgtaagcagggttggtttcttctgaggcctctcttcttgccttatagatggccatcttctccttatgtcttcatgtggtctcttctctctgcctgtccctgtccaactttcctcttcttataaagacatcagccatattgggttaggacctacccaaatgaactcattttaacttaattacttctttaaagactatttccaaatgcagtcatattctgaggtactggaagtcaggactttaacatatgaatttggggggtacataactgagcttataattcatggatgaaagtgtttttttcccatatggatattcaattgtactagtgtggtttgctgcaaagaacctcctttttcactgaattgcctttgtacctttctcaagaaacagctgtccatataaatatgggttgatttctgcactccctgtttcgttccactgaactatttgtctatctttgctctaatatcatactgtctggattacttccattttataatatgttttagaattgacaaactggacttcctcaaaatgaaacatttctgctcttcaaaagacactgttaagggaatgaaaggacaagtcacagacagggagaatatatatatatacacatacacatctgcaaaaagtagagctgatatgggactactcatatccagaatatataaaaaactctaagatataaataataagaaggtaacctaataaaaaaggacaaaagatttgaacagatacttcaccaaaaaagatatgtgactagcaaataagcacatgaaaatatactcaacattattagtcattagagaaatgtaaaataaaaccacaatgagacaccaatacacacatattaggaatataaaaagactgaccatatcaagtgttggtgaacatacagaggaactagaactctcatatacttttggtgggaatgtaaactggtacaaccactttgaaaaacaacttggcagtttaaaaaagttaaacatacacttacatggtccagccattctattactagaaatgaaagcatatgcccatataaagagtacaaataaatgttttacttgttatagccctccttgttataggagttttacttgttatagccccaaactggaagcaacccaaatctccatcaataagtgattggataaatgaactgtgttatatctatattattcagcaataaaaaagaatgaactattagtgaatgctaccacatgagtgattgcaaaataaatatgctggatgatagaagccaggtataagacgcaaacatgctaaatgattccatttgtatcaaactctaaaacatgcaaactaatgtacaataacagaaaacagatcagtgccagtggtagaagggtaggaggaaaggaacaccaaggagcctgaagaaccttctgggagtgttccttataatacgttcattatcttaacatatattcattcagttaaggaacacatgttcattattttaactgtgataatggtcttatggatgtaaacatatgtcaaaacttattaaattatatatgttaaatatgtgcagtctattatatgttaattatatttcagtacagctgctaaaaaagtgataaaaaacatttgggccaaatatgaaaaacccaagactaaagtgaaaaattacaagactgttactgatcaatgttcaggcctattaaaatttcccctatcccaatggcacttgggcaactacttttcttgtatactttaggaagtatctaattcagacaggggactaagaagagactcttcacagtgcttgctgatagccccaaaatgcagcatgaaaccacccaaatgccaagacaaattgagaaaggttgacctttaaaatatgtagagttcagtacctttgaattaaattgcatgttcagctttggttctagttgctagaggctacttttttcaagtccacaattggctcccccaactgcgtttgaaattcagtaaaaccagcctttgcacctgcctttgttaaaatctgtacctaaattgtttggaacaagaaagaatagtaactagaagcagatttactgcagtctggacttagttgtttgggtgacctctttttgctggttttctgggttgattagactttgctaattgacagagtgtttggcgcaatagcccaggcagagccattctgctctggacttggatttggtacaagtattcctggtggtcaagtcatgtattttctagtttggaaacagacgttggaacaggactgctggagcaggtttgcaggattctatggtggagaaactataatgactttcaaaaacatgggccaaggtaatttggctgtcttttcattcccatctctaaaagaaagaacccaccaaagttcagagcatcttaaacattttgaagttgtgacagtgaatgtgaataattggtgtctgtgggactctaagggtagaaagcagggcttactagtgcttcttcttatttaacagagaagagcctggaaaaaaaaaaacctatagtcagacataaacatttcagccttatttattttcaaccagggaatagctaataccacgatgctgtaaagttcttgcatttaaatgtcctatttcacaggtccaaacccatgttccacatagtagtattataatagcaccatggagactatccagtaggatcctgaaagtcttcttacccactcttttccattttgctaagcacctggttaaattaaaattccaaacagtattattcagagacagcatggaacagcggattcttaattctggcccccccattcatcaagcacacataggccaggcaatgcatttagcactggagatactgaagtaagggattgcctctgccttcaatgaacctttggtctagagatggagactgagaaataaacaggaaattctaagcagagtgctgtgtacgatggagaaagtcctaaacagagtaatattgggacctgtaggaggccctcccactccaaaccatgagggtcaggcaaggcttcccaaaaggtaagagttacctcctcaaagaagcgggggaaattgtctcttactactctatgacaatgagcaaatcactcaaattctctgactctctcttttggaagaaataacatttactggttgcttttgaggattgaatcagatgagatatagaaaagcccttagcccagtgcttgctaggggaaagatcaatattggttttcatctttcctttcttttttcctcccctcctacctccatcaggtggggagtgtgacttccggagcacactacacagaggagacttttggagggtttttagttgtcatctctgtcacttggtgtttatcttcctgcttctagttcattagggcctttttcttctgatgctggcttgggctgtgtttatgtctttcatgtgcttctgtgacacttcatcaggggaagtggctggccctctgagcaactgctggaggcgttgggaagatgggaatcaaatgcagcctctgtaggtgggtgtggaacagaacagcagtgtggccctgtgcatgtgtcaggggcaggcagcagccatcatctgtcctcatgtcctgcctgtggggtctgatgagaaaagaatgagttagtaatgaagtagagaggagagagagctgagtgctaagtggagaataaaatcatcttcaagtataactcaggtttactctggagctgtgtatcctgcaaatagtacagtattcccactcttggccaggcactaacagctgtggaagcaaatggtgtaactgcctttagggggcgttctgactggccagcaggcattactgatgcagggaagcaatgcagaaaactccacggcaagctgggcacactttgctctctgttgctctgtgtgtcctttggtttatttttctgtgtactctcccctcctaagaagactgtgctctttccaaacccaaatcaccttcttatgttgcaaatccacctaaccgtcagaattttttcctgcacagctgtcacaacaaacttcccctcatctgctactaaatgtatcagacactgttgtgcagtctgtgagctgccgactcattatccgagggctttccaatagaatctgatgttatccaaagcttctcatctgtttcaaagggaacaatttcctgcgttctctggagggaaatcaaacgcactacgtttaggaagtaggacggtccttcacagatttagtagatcgcaaggcaattatgggctgattattcccaacttagtgtttcctcacctcatttcccataacagcgactagagtgacctgaagatgggctttttgtctttccagtgagacatcgggaaataaatcacaaaaatcaagataagttgtggtacctttgatttccctctgtcctcttcccaagccgtttttggcactccctagaggaaaccagttctcctctcctcttttacttctgcagtgggcacttgggctccaagtatcttttttttttttaagttcatcttcatcatcctttaaattaaacacctactcccctgataaatatgatgctctttttaacaattagtctttggatatagaagttgctgatgaggaaaaatccctttcagctggttacctatgcttttttttttttttttttttttttttgagacggactctcactccgttgcccaggctggagtgcaatggtgcgatatcagctcactgctgccgatgcttcccagattcaagcgattctcctgcctcagcttcccaagtagctgggattacaggcatgcgccaccatgctcggctaatttatggtatttttagtagagacagggtttcacatgttggccaggctggtctcgaacccctaacctcagatgatccacccacctcggccttccaaagtcctgggatttcaggtgtgagccaccgtgcccggccccatgcttctttatactagttctttcctcccttctcacctccagcctgggatgtggtctccactatggtctttattccatactccaaatttgtctctttccaagtatcttcctaattcctttttttaaagttacctttttaatttcctgccgtgaaacatctgctgtatcatcttgcttccgccacttcctagaaaacttgttttatgaatgttctttctcctcagtataattttcctggctgtgccctgatgtagtgctacaatagttttattttacattgactgattaagcactttgaataattgttttagctccattatggcaaatctatttggcttaacacttttttttttttttgcaacctttgattaatgcctgaccattgggacagaaaggaattggcgcattaatttccccttgacgccacggagagctgctctttttcctgtgcaagagcctgaagcaacagatgctctgtgttcgtattgcaggggagagcacacactgttgcaaataagtatgtgtgtgttcccggtcagtgtttgctaatggtgctgtgtggcagccatttcatagcagagagcaaatgttaggatttagggaaaattgtaccagcatatcagattttaaaacggaatggtgaatttttgttgagttaacagtgtgtagctagacgatgttttctttctaagctcatgaaacttaacagctgtttagtgaagcagtattttcatatatgcctgtttgacaggtttaatagcaaattttgcagtaagtgacttgctgaacaggacttctggcttgggctgtaacaagaactgtatttgcagcaagattcattgagggtctttgtgctttagtgtttacgggaaggggaagcctggctaaagtgaggaaaactgaaaggcataatccaaaggaaattactaatatctctaccagagtattcctcagaacttgttattaactagtttagaggaagataacatggggaaaacatgctgtttagcaataaaaacacatgagtacaatcagcttactgtaacccattattgctgcatagtaattaaatctatatatctccaactttatagttttctgcagcagaatctctgaaagacttctgcacttcatctgattcaaggaagcctatattctctcccctgtctctggaaaggctactgtgccttgtaatagctttttaatattgccagatcgaagacaaatgcttcactggttttactgggagaaataaagcacttcctattacacttataggggggatccaagtcttgggaaactagcactttatgaggttagaatcccttttcctttcttcccatttttgagttctctcagatcgtaggacctcagaatcactcattcctagggctacccactttgtatttggctcctaagtgcatttttcaggatttatctgtgcttttattgattgcatgtgcttagttatacctgctgattgtgggtgtgtgcatgtatgacagaatcacagatcatagacccctgttctccagggcagccaccctcatggtcagcccagcatcctcagctaacaaaaggaccaagagctgtcttacatcctctttggatttccgcatagattttgcaagccgtaaatacaaaatttgtctagagttcatagttggttctgtttactggatttttttttttttttttttttttgagacagggtctggctctgttgcccatggtggaatgcagtggtgcaatattgactctgtgcagccttcgcctcctgggctcaaacaattctcacacctcagcctccagagtagtggggactacagacacgtgccaccatgcctgcctaatttttgcatttttgtggggggtgggtagagatggggtttcaccactgtttcttaagcagcatgtaagggagcttcatatttgtttgtctcagtcccatcatgatgtaggtcaaaagcaagttacattcagctagctgtatgacaaagatgcctccttttgaacagtaagaatttaggctttgttgttttatacactcaggcaacttgaaaaggataaaagaaaggtggagaaaagaatagtaaagtgagctcaattaattttctaagaaggcaaactaaaaacttctcacatgtaaacagtaagatgtcagggacacaaaatgagttagcccgtgttgctgggatgaggagggatagcagagaaatggccatatgatgtctgagagtgtggccagtgggaggagaggggtctactggtggacttctctcagcaggttgtcacctccacactttctcatccagagctcctgggattccctctaggaaggaatcattataccatttgccctgctcccatcatctcactaacctgctatcactgtagtaactccaagaaccagtgagacaagaaagagggatgtcatgagctgcctctgcacaactgttgaattcaattttctttcttcaagactccttcccccatgtttctctaatgcccacactttattcaggatgttgtgttcagtagcagagacatttgaaatgaagcttccttatcatggcttttaggaaaaataatggcaaaactattggatacaggtgaattctagtccaatatggtaggagaggtgagcctggaattgccctttttacatatcctgcagtctgattctaataaaagtagacacagttctggtacactactatgtggttatttccagaaatataaatgagtgttattttatatatatatattatatatatataaaatatataatatgtacatatatagtattgaaccgacagtaggtacttatgccttctaaaaatgtagtagtaagtgaacataggcaggcaatataggaggtgatacctgaattagttttgaaaggctctagcacagccaccaggcatacaattagggaggagaagtggatgtacattctataccgaagaatagttccctccttataacccaaagaacagtgctgaatacatcttacatgctttgtaaataggtactgtcttgagctgttgtaacaaagagaacatattggagaagaggaggctggaggcagggagatcagttaggagattattgtggtagttcaggttgaagcaatatatatatattatatatatataaatatatatatttatatattttaatgtttataaatatataaatatataaaacattatattttaatgtttaaacttttaaaaaatcagataggtaggacttcctttttcttttttaaataataactatggaagtgcagaaataatagagattctattgtgctctttacctggcttccccattggaacatctctacaactctagtagaatgtcaaaaccaggaaattgccattggtacaatctatagactttatttaggtttcaggagctgtttctaggtgggactttctaaggattgcaaaccccatggctttttctttttaagcaggtagaattgagggtgcagtggaagcaaaggctcatgtctggtctcttcctttctttctgtattgccctcctatcccccatcatgtgaaaaatagatactagaaaactcatatcaaaaagtacagtctggatgcttactttgcagggtagtatgttaggtgcccaggaggacatgaatgactataagaagaaatggttctgtaatttggaatcgtttgtttatacagaaagattcagctcaagacagtacctatttacaaagcatgtaagatgtattcagcactgttctttgggttataaagagggaactattattcggtgtagaatgtacatccacttctcctccctaattttatgcctggtggctgtgctagagcctttcaaaactaattcaggtatcacctcctatattgcctgcctatgttcacttactactacatttttagcaggcatgagtacctactaactgtcggttcaatactagatcccaggggttcaaacatggattctacacattctctacccacaatgagttcacagtttagtggaagagagagacatttaaggaggaaaatgcagtagagtgttatcagaggtataagtagaggtatgagtagggtatatcttgaatgctgtggggtttgaacaaaggaggaaaaaatgaatttctttagaagagagataactgttgtaacaaagagaacatattggagaagaggaggctggaggcagggagatcagttaggagattattgtggtagttcaggttgaagaaagataactgaaaccaaggtggagaggaagacctaggggaagggatgggtttgggggctacttaggagctaaatttaagagcacttactgattaactgactatagagttgaaaagagtgaggtgtccaaaatggtcccagatgatggggtggtggaagtgccatgcaccaagagggagagtctgggagaagatcagactctggaagaaaactcttgacggggtatggatgtattgagtttggggtgtctgtgggatgtccaaactgagagagctcactcagttatagatgagctcaaatgatatatggtgccttgatgtgaatgactttgccagttaaagtatgtagtaggacaagaagatcaaggagaagccttaggaatcactaaaatttaaaggacagatgggggaagggaccctgcaggagagattaagaaggagagcagagtgagaggaagaagagtgtttggaaaacgagaggcagtcaacaatataaaatgttttagatgtcagatatgatagaaattgaaatgttttcattggagttagggacaaaggacattcttattgacctgtgtgagttcaatttcagctggctggttgcaggagacagcaaaacagtagatcaagtagtgatttttaactatgaaacaattaagagtttggtataaggcaatttagttaagtgctaacatggagtgtaaagaaaagtgtaattgatattaattatttaagaaaatccataatagaatgttagagcagaaatgccaccccatttttaaatataaagagagatttcaagtaaattgttcaaggtcatgcatctaaagaggaacagccaggaccaggtcccaggtctgtttactccctttataaaagaaaattctggatagactagtttaaaggagcaaatgaatgtctgttgcaggaaaagtgattgttaaaatgatgaatcagagctgtatacttctattgtgaaatataactacttgtttgatgaatttattcatgtattctataaatattaatagatattgtgctatttgtttaatatgcaaagacaaataaacaattagttgtagagaacatgcttggtgaattttataaaagtaaaatattatcgccattaagtgatatagtctagcagggtgacagacacaaaaatggtatcatacaatgtgcaattgaaaaggcaggaaatagttttgcctaggagttggagactagtgagctgaatcttgcatcatgattgtgatttctccaaatggagaaaggattaaagggaactttcaacaaagggaacagtatgaacaaaatcagaccagtataaagaaagtctataacttcacagactgttaaacagcctggtggggatacgatataaaggtagggaaataacaaagaattattttgaagactagaaaagtattagtttgtttgtgctgctataacaaaatacctgagactgagtaatttacaaagaacagaaatttgttttctcacagttctgcagtctgggaagtttaagatcaaggcaccagcattcggtgtctgatgagggctgctttcagcctctaggatggcaccctgtggctgcatcctttggaggggatgaatcctacatcctcacacatggaagggacagaagagcaagagagtgcttccttcaacttctagcctttttataaggctgttaatcccaggcatgaggacaaagccctcatgacttaattatctcccaaaggccacacctcttaatactgttgcaggggattacatttcaacatgggccaggtatgatggctcagacctctaatcacagcactttgggaggccgaggtgggcagatcacctgaggtcaggagttcaagaccagccttgccaacatggtaaaatcccatctctactaaaaatagaaaaattagccgggcacagtggtgcatgcctgtaatcccagctactcaggagactgagacaggggaattgcttgaacccaggaggcagagattgcagtgacccaagactgtgccattgcactccagcctgggtgacagagcgagactcagtctcaaaaaaaaaaaaaaagtttcaacatgaattttggaggggacaccatctcaaaccatagcaaaattcataaccataatactgaacagtaaatagtggggaaacagatgttttaagccaaggtgtcctttgatctgggcttaagataaatctggtggcaatgtggaagatgagttggaaagggacctctgtttaaggcagtgagatgtgtgcagaaatgtgtcacatgagtgataatgaggttgtgagctagggaagtgatggtaagagtgaagaggagggaagttagtcaagaaagaatttgaaggcagaattacaggcagggtttggcaagtgttcacctgttcttcctgagggaaaaagaagaatccgaaaaaaccccacagtcatttctaacttattgactagggtggggaataaagggagagcaagtttggaaaggaagattctgagtttggtgttggatatttagaatttcaagtactttgggaaatctaggttaaccatacatgagatcctaaacacagcatagtcataggtcttgcttatggtgttaagtagtgtaaacaatatatttaattatggatccccaagaagcacttaaaagtagtttataagttggaaatgtattcagatacacggcacagaaaatctgactaagtggctaaaagaaatagagtttatttttctcatatacaggaaagttggtgatgctggtattggttcaactgctcagtgatggcaagaccagttctctgggacttgccatcatggttataaatagctgatgcagctctagaaacataaccactttcttgtcaggtgcttctgtttgggtctgtttgggtagaactgggtcacgaggcctcctctggctggaaggttggctggaagagcgggaagaaaattgttgaattcacttaaatacatactttcccatcctattagacacaattcctcttttttaaaaacaaataatttgtaatgccttctttattatcctgaaataaacatcatagacaatctgcttgtgtacatttttaaataaatatattatcctaactgtaatataaaggaacaattaaaggaaaataatttataattatttcaaaatgtgaattctaaggcatgactgcactagaagacataatgaagaagtcagattcttgcacggtgaatgtgacagcaacatatgcaagtgatacaagggtatggtaatggtgtttccagtaccacaggcagcatattcatttgtgttttacttaaaagatgaccaattttgggtcaagttctgcacaaaacacagcatagtcttctcttgatatacaagatagttgtttcttgaaagagtcaacttgcatgaaaactgtgcaacaacaattttgtattcgtatacacaatagagttacattcaaggccaaggtaataggtttttcacatttggaaagctatttggaatgtaggagagttcttagtacacagattgtcccccacatagctgtctgtctagtgtccccggcctctgccaactagttaccagtagaatctccataccatggtgacaagtaaaagtgctccccccacatattcaaaatggcccctaggggcagcatcatccatattaaaaacaactggcttagattaatgggactggacactttgtactccaaacaaaatggaggttggttagcaaggaaaagggggaatggatattgaatagggaattaagtgtctaccaatagtaggaactgggttttccttatgtttgtatcttttcccaaattcttgcagaattccttgcatatagtgagttctcaataagctttcttgaatgactgaataaataactggaatgtaagctatgggaaatggaaacccagtattatatgagctttgaataaaggcaaaaatcttccttaagatacttaaagggctaactaccgtaaatccaggaatattgtcagaagttgggaagtgaactttggtgtgccagtgtctgtgctaggatttagcacttctggactttctgtctgttacacattctagactgaagactgagggttaaatttatatcagtgaatcctgttcaggaatggagggtttaggggaaatatttaagttttcatgtaagtagtatagaagaaaaagtaactgtcacaataaaagatcaataaatctcaggctttaaatcttagtctctctatcttttagcacattctctttccactgtgttcttttccacttctgtttgtctattcgctctggcatttttatcatagcctgagacattttcgaatgataatttttaggagaaatatttagaaacagaatcaaagggctttgttttgtttcctcgaaatataaacctattattagaatataattcacagtatgagaaatgtaggttttgcttgagtttgcttccagatttaagtagaaaagaaagaaaatgacattataaagaattttatctctttttttgtgaaaaagataatctgtaactatggattgtgaagacaatatatgaaaagcaaatctttttcaaacagtgctccaaagttgcctttgaatatataacttctgaattcaaaagcatgatacagcatgggtttttaaaaaaatagttgtttaacattttgaagggtataacatttgataactccatactttgaattcaagtgaaggaacaataacttcaaccttttgtttataagaataaggaacactaaaaaatgttgtgtagtttaagtttagacatttcaaatagtcctataattgcttgagagagcagtagagtttttttttcaattagtttattagtatttcagggattttaaatggaagaaaatcttgagtgtctttgtaaatgaattgcatcttttataggcacagatgtttttcgcagcattattttcatccccatggctgctttacaatatgtggcctatggagaaaatgacaagtaggtagatgatgagtaggggaaaatggtggaaggtacagcagcaataggaaggaagtattccccaaggtttgcctgaaaacatctactttgtgaagctccaacatttatggagcaaaatgccctagagtgctgcaacaggagacacaacttaccacccctcatacggaaggatgggagggagaaatggaaggggaaagggaaggagggagaattcctgtgatcttcactacccgctgtctccttagcacagagaattcatccattgccacatcagcacaaggacaacatatgaagttcctcaaaatttccaaataagccattacttattacctatacggttattccctaaaagtttcacactgaagtaaacaagtgtttttggtcatttcatgccaacaaactgatggcccttgatcatcatcctttgaactgactccaggtctagaatgaattttcctatgtatggtgaccctaagtctgtgtcttagaaaatatatatatatatatatatatatatatatatatatattttttttttttttttttttttttttttttttttctggactcactgcaaactctgcctccctggttcacaccattctcctgcctcagccttccgagtagctgggactacaggcgccctccaccacgcccagctaattttttgtatttttagtagagacagggtttcaccgtgttagccaggatggtctcgatatcctgactttgtgatccgcatgccttggactcccaaagtgctgggattacaggagtgagccaccgtgcccggccaggaaagaactttttaaggttgcccttgaataccggtcttgattaagttttattctgtctatatatttcattattttaattttataatacatttctatttcttgcttagaatttataaattatatatcagattatgatttctgtgttttaaaaatacctattatatcttatgctggttttcttaagtggaatgtgatatattaatatcttgttccatttttgttacttctccaaatatagacgattagtaatattctactatttattaatgaaaaactaccttagttggcctaatgtaactatctaaaaacaataataataaaattctgtagtgctgttagagagatatatgattatgcattccagccaggaattacatcagtaatttttagattatattccagggaaaaccaggttttgggtcaactaacacctatttattgttcacttatgttgaaggttctaggtgatttctcatatagctcattgttttgtgccttcaatcttagtaaatcttctaaagtgctaccgatatactcagggaaaactaactttgttaaaagaatatcttttaaattaacctacttttaaaaataagcattattatgtttgtggaatttgaaaatacagtctagttaaggtatttagaataacactcagtttctgtttcaaagtgattatatcattttagtatcaaaattaatttaattgaccatataaggagacattaagtattattataaaaatggcatgttatggcaaagtgtggtggctcacgcctgtaatcccagcactttgggaggctgatgggggtggatcacaaggtcaggagatcgagatcagcctggccaatatggtgaaaagctgtctctactgaaaatacaaaaattagctgagcatggtgacaggcacctgtaatctcagcttctcgggaggcataggcaggagaattgcttgaaaccagaaggtggagattgcagtgagctgagattgtgccattgcactccagcctgaacaagagtaaaactccatctccaaaaaaaaaaaaaaaaaggcatgttatttattaatacgagtgacatacatgcaaaaggatgtctgacttaggcaatgttattttctggacatattttttaaatagactgtgacctaagttctggtggtccctctagaaagggtaccattccctcttctctgcctgctgagccatttcctaagactgtcttcagatgttatgtcttctctagagcttttcagcattccttttattcttttttttgttctcatggtactctatgcatgagaatgtttgagtatatatatattattacagttatttgcctcttagactgcatttgggtattcctctttgagtttctatttcgtgtaaatgcatatagtttcctataaaaaacacaatttataatcctccaggaagtctgtgtaagtcagtcagtcaaattacctggttgattatagtttcaggtttatctgctgcctgggaatcaaaacacaggtcttgattaactttctataaagcaaggatatggactagggatcactaagctctcttttatctctacaatggtgtcattatatgattctaatccatcactagaaatgtattgtgaaatagttaattaatgtttgcagaatgcttagagaacttttaatgagaagtagatatttgtggttagtgctaatgaatagatgtcttatgaaccttttttttgcaccaacaacacattggaaaaatgtactttcaagaataaattgcaatctggtgaaatttttttattagttaacaaaatttagcttttaaaaacaagtatcagtatagtggctttagtggctttagaaaccaggaccctatgcatataaatagttgtaataaaaagggaagcagcaacagtgtatagttttcataatttttcaaaatagtttaaatatgatagcaactttttactcttacagcttagttgtgaaggaggcaaggccagtactcttatactctgggaagctaagacctagagagattaaatgctcatttatttcttaaataaaaatgtattgagtgcctgtatttgagtataacaattgaaggtgcagtggtgaataatttaccctacttgactttgatagtaagggagacaggtttataaacaaacatattagctgatagcatagttaattatggtagaaacacagaagatggtgcaaataactctggggtgttgtttagtgagcctttacagaaaaggtagtttttaaagcattttcattaaactgtaagtggaggcatttgccagatgaaggggaggaggtgaggagaagggtctttcaataaaagagaatgaacatatgtaaagacccagagttatgaaagagcctgtgcgtttgaagaacagcgtgaagttcaatgcagctagagcaatattgtccaatataaatatgaacacaaatgtgcaatttaaatttttctaatagccatagtacagagtaaaaagagacaggtaaaatcaataataacacattttatttaacccaatttatctgaaatatttatttatttttcaacttaagtcattaaaatcaaatcaggtgaatattttacacttacaaaacatttcaatttgtcttccttccttcctttcttttcttttctttctttctttttctttacttttttttttttttttagggactggatcttgctatattgcccaggctggtcttcctgcctcagtctcccaaagtgctgggattacaggcatgagccactgccctcagcctaagacatctcagtttggactcaacacatttcaagggctcaatatatagaagcttagcaatgcatgtatatgtatgtgtgtgtcggagagagaaagagagtgagaatgaaaatctgtgtgctctagagggggaggaggttagataaggttgaagtagttgttggagtcatatttttaaaggctctgcatgctggcttattttagaattttttcttataatttagtagtttatgattgtgcttctcatattatctgtggtgaaggaacaattttgaaaattttgcatttgttatagactaatgctttcgcaaaataataataaattagaaaggtgaaagtaaaaagacatacaaagagaagcaccattttttaatcattaaagttgacaagatgttgtcttagtctattttgtgctgctataacggaataccatggactggatagtttataactaacagaaattaattggtttacaattctagagcctagaaagtccaagattgaggggccacatctggtgagggccttttagctgcatcaaaactttgcaaaaggcatcacatagtggaagggcaagagagggagagagaaaaagcaagagggggtaaactcactcccatgataaataacccattccctcaataaaggcatttgtccattcacgagggcaaatccatcatgatctaaacatctcttaaaggtcctaccttccaagaccattacaaaggcaattaaatttcaacatgaatttggagggacaaaagttaaacccatagtattcctcctgtcatgtttttcttacatacaaaacacatttatttcatcccaatagctccaaagtcttaattccttccagcaccaactcaaaagtccgaagtcttgtctaaatcagatatgggtgagacataacacaattcattctgaggcaaattcccctctagctgtgagcctgtgaaattatacaagttatctatttccacaatacaatggtgggacaggtataggatagacattcccattccaaaatggataaataggcaaggaaggggtaactggttccaagtaagtccaaaacccaatggggacaacaacagtaaatcttaagcctcagaaataattttctttgactccatgctgccctgcttcctggacacactggggaaggggttgagcccccaaggacttggagagccctgcacctatggctttgctggaacgttggagtcttatgcttacagctctcctgggctggctttgtgtgctggtatctacagttcaggagtctcaggtgtggttctgcccctgcagcttcactagacattgctttagtggggactgtttgtggcagctctgctcctgcagcagatttctacctggatccccaggctgtctgatacattctttaaaatctaggtgaaggtagccatgcctccacagcttgtgaactctgtgtgcctgcagaattggcaccgtgtggataccaccaggacttactgcttgtgcactcaggagcagaggccttagctgcacatgtgcctgctcaagctatggctggagcagcttaagggcactgcaccagaatgtggggaacagacatttgggtaggtgaggtgcagggcagttaattctgaggtcccctgggtgcctctttggaaactttgccctcaagattctagcttgcctcagagatccctgaagtgcctttgcggtcattttcttattgtcttgatgaatagcacctggctctttactagccatacaaacctttctagcaaatggttgtgtggccacatcttttgtttgcactcctaagcacacatttttattctttacatggccaggctgtgaattttcataatttttatgttctatttccccttaaattatgaatactgtctttaaattatttctttcccctcacattctattatatacatttaaaagaagccacacagctccttcagtattttgcttagaaatttcttccatcagatattctagtttatcactcttaaattctgccttctgttaaagccctcaggcatggacacactttagccaagttttttgccacttaataacaaggatagcctttactacagtttccaatacgttgttcttcatttccatctgagacctcatcagaattgcctgtactgtccatatttctgtcagcattctggtcatgaatctctaagaagaatcactcaagtaatctctaagaagttcccgactttctctctggctcatctgctcttctgagccctttccagaacttcccttaatactgcattcattgtaatctaggcttttcctaggctgctcttccaaattcttccggcctctccccgttacccaatttcaaagctgcgttcacatttttcgggtatttgttataacaacccacctctctggtaccaatttttgtcttagttgtgtgagtgtgtgtgtgtgtgtgtgtgtgtgctgctttaacagaataccacagacggagtaatttataaagaatgaaaatttattagctcgtggttctgcaggctaaacagtccaagaatgaggggccacatctggtgagggtcttcttgccacatcataacatggcagaaggcatcgcacagaagaagggcaaagaggggatgagagagatcaaaggagacacaaaccccttcctgcaataaacattagtttattcataaaggtggagccctcatgtcctgaatacattttgaaagtccaaccttataataccgtcacaagcgcaattacatttcaacatgagttttgaaggggacaaacattcaaacaatagcagacatatagtttataaaaaagtgtctaaaccagtgctatccaatagaactttctgtcatgataggaatgttctgtctgtgctgcttaatataatagccactagccacacgtatctattgagtacttgaaatgtggctagtgtgactgagaaaataaatctttagtttaatttaattttagttaatttaaattgaagtgaccatatgagacaattgattactatattggacagcattgaatacatttactcataatctctgtatttacctattgtgcattagtaaaaaacagtttgtggactggtatggcccacaaacccatgctttgagtagcactgtttaaagcatggactctagagctagaaagcctttgtgtatctttggcaaactgcttaatcgcttggtgcctcagtttcctcatttgtaaaataaaggtaataataaactaccttatagagttgttgtgaggattaaatgcattaatgagtgtagcatacttagtacaaggtctgacacacagcatgcactatataaatgcttcctgttattgttattattatttattatgtaggtggtggatatcaaacagttaattggtaacaaagcccagtctttttattaattctctgctttttgcagtagcttagactttttccttttaaaaacataccacagtttgtggcatctagtggcttccaataaataccttttgaacataagcataaagtacttttcaagcacagatgaagaagcaattattgttctgaggtggggggggggttggtaaaattatcaaaaacagatgacagctgagaaggcctcaatggaggagtctgacaggcaaagaggagagaacacacctggtggagggagcaaggacacccatttggattatactctatttaggagactatacagcaggtaacactgacttagccctatcactgctaccaccacttctttctctccttcccagctcttttcttgatttatccttttagcatattttaaacaggattaataggtaacacgtgattctacagttttaagggaggtcaatcgttgcctctttacttgttcattcctcagagtaacagtgcctgaatttgatggtggatgttgggcagtggttgggaagggaaggggaatgctgcttgaaaagcaatccctgggttatgggcagatagctgtgagattcttttcccctaaaacataatgtttcttatttatgtagattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcagcattgggactcctccagaaggtattgtttgtcttttcagtttgatttgtattttataaaactaatgtcccttggtgtaattgagtacaatatgcatgattcatattataatttggataatttcctattccattggcttaatgagttctctacccttttttgtcctcccattttttacttctgtttcttttgtgaaagggaactgatcatgttggatcgctttttaaatgtagaatctgtagctactggtccatgatacttaccagccctatcactttgtaattgctatctagttaaacattagcatggttctatagataattgaaatatacataaacaggatacaaaaacgatgacttcttccaagtggcctcagtgtgaataattttttagaattaatgaaatagagaatagaactttgcactctgaattgatttaattatttttatagaactgaggcttctcctgcaaggaattatccaaggttgagttctacctttacttataagcaccctggatcagctttatcagataatatacagtaaatgcccagatcagggatgtatagccagtcatcagggagctatcagttagccttgaatatatccatgggctaatttccggtggcagaagaacgagtttctattcttttgacttttttgaatgccaagagaaaggcctagtgaagtacattgtcagtttaaaacattatttattgagatataattcacatactatgatgttcatgcatttagaatgtacaagcgatttttaatatattcacagagttgtgcagccaccacaatctaattatagaacatcttcatcaccacaaaaagaaactctgtgactattagctgtcattctccagtctacctatatcccagccctaggaaaccactaatctgctttctgtctttatggatttgcttattctgggcattttacatgaatggaataataaattatgtgatctttcatgaattctttttttcatgtagcatactgttttccaggttcatctatgttgtcacatgtttcagtatttcattctttttattgctcaataatattccattttatggatgtaccacatttttatttatccatgcatcagttgatggacattgagattgttttcaccttttagatattatgaatagtgctgctatgaacattcatgcacaagtttttcatgtgaacatttgttttcatttctcttgggcatataccaagaagtagaattgctgggtcatataccagctctatgtttaactttatgaggtattgccaaactgttttctgaagtggctgcacagttttatgtacccactgacaatgtattataatttttccatatgcttgccaacacttgttattatctgtcttcttggttatagctattctagtgggtgtggagtggtatctcattgtggttttgatttgcatttccctaatgacaagtgatgttgagcatccttccatgttcttactcgccatttgtttatcttctttggagaaatgtgtatccaaattcattgcccagtttttaatcggactatgagatttttattatagagttttaaaagcttttttaatgtattgtatatacaagtcccttttcatatatttgatttactaatgttctctcccattctgaggactgtcttttctttttttttgatggcaatatttgctacagaaatatttaatttttgattagtccaactaatttattttatttcttttgttgcctgtgcttttggtatcatatcaaaccattgcctacaccatggtcacaaacatttactactactactgtaatgtatctaggtatgtatatctttactctcatctcatattttcttctaagaattttatggctgccattcttacatttatatctgtgaattaattgtgttaatttttgtatatggtataagataaggcttcagctttcttcttttgaatgtggtcattcagttgtctcagcttcatttgttgaaaagactattctttctcctttaattcggtgcattacattaattgattttcaaatgttaaacaaaccttgcattactgggataaaccccacttgattacaatacataatcttttttatatggtgctgaattcagtttggtggtattttgcttaatattttgcatttacatccatagggatattggcttgtagtttcattttcttataatgtcttttttttttttttttttttttttttttttgtatcagagtaagactggcctcatgaaatcagtggcaaagtgtcacctcaccttccattctttggaagagattacaactgactgctattaattctttaaatttctggtagaattcaccagtgaagcaatctcattcacgcttttctttgtgggaagatttttaattattaattcagtttctttacttgtctaatcagattttcagtttcttcttgagtcagttttagtagtttgtgtcttttgagaaatgtatctgttttatctaagtcatgtaatttgttggtatacagttatttatagtatcttattataatttttttatgtttgtaaggatggggtctaaatcactgctgtcacttgcttttgggcagaacaactgtttagatttttctagcaacaaattctctgagcctttattcatctttatctctttgcttaaccttcagttttgaaagatagttttactagacatgagattcttagttgaggggtttgtttttcttttctttttttcttttctttctttcttttttttttattttcagcactttgaatacattatcgatcccattgccttctggactccattgtttctttttctttcttccttttttttttttgagatggagtttcactcttgttgcctaggctggagtgcaatggcacaatctcagctcactgcaacctccatttccccagttcaagtgattctcctgcctcagcctcccaagtagctgggattacaggtgcacaccaccatgcccagctaattttttgtatttttagtagagatgcagtttcaccattttggacaggcttgtctcaaactcctggattcaggtgatccacctgcctaggcttcccaaagtgatgggattacaggcttgagccaccatgcccggcctggactccattgttttgatgagatgtcagctgttacagttttggaggtttccttgtatgtgctgagtcatgtcttctttattgctttcaaggttttctttttcttttgatttttattattttgactctaatgtatctaggtatatatatctttattctcatcttacttggaggttgttgattttcttgcatgtgtagattgaagtttttcatcaaatttgagaagttttcagctatcattttcacaaattctttttcttcctttttttctttttcctctccttctggtacttccatttacagtgtgttggtgatttaatgatgtcccatatttctcttatgctctgctcatttttctttattctttattttctttgttcttcagattgtatgacctctatcaatctgtcatcaagcttactgattctttcttctattagcttaaagctactattgagcctctatactgaatttgtctttttagttactatacatttaaactccagaacttctctttggtctttttaaaaaataatttctgtgtctttattgatattttttatttgatgagatgttgtcatcatatctgcctttagttctttaagtatggtttcttttagttccttgaatatttcaataatagcttctttgaagtgtttgctatatcctacatctgggccccctaaaagacagtttctactgcctacttcttttttttcatgtgtatgggttgtactttattgtatctttttatgccatagttttaaaaacagaaaacctgaatatttaaaataataatttaaaataatattttatggcaactctggatgctgacttgtcttcctccctttcccccatccatttacctggtcattcatttgtttaatcgcttgactgtactaactctgtgatgtctatttctcctacactgttcagcttctgatgttcctgtttagattgtttttctgttttattttttgtttttcttttggctgggttccctatgagtcacccgtaggtctgcataagccacttattggtcaaaggttatgcttaggttcctttagacagttatatttttactctttgccatttgatgtttttatggcttggagtctgttattacaacttaagaagtttgttttttcccccaactttggccaaggccaaatgccttggaagttccttttctaatcacttctgagagggtgcggccttgagcatgcacacagccttccagattaccagaatgcaaataattttatttttaagcgtggcttaatagtattttctccagggtcagaatagcttattttttagccagtgtttgctcagaggttgtccttaaacaccttgagtgagtgagatttctgccctttgttgacggatctgtgtgcagcttgggaaatgttttcaagtctgacccatgtgttgttttgattgttcctgagtaggtatgacctaggacatgtgtgtagcttttcaacccccagggtttactgggatcccaggaaggcccttcttggttgtttctttccttggttctttctgttaaagctatggttgttctgccattttgcttgttgctagcagtatcgtgaagctaccagcacccccttaattgttcttcaccaagctctccattattttcagcaacacccttaagtagggaattctccgttctctgcactaaatgaagtcactaacatcaataagaactatggagctcttcatccttatggcttctctcttcccccaggagaacattcgtgctactgcaagggagctagatgcagtgatagtggcacctcccagtgtcacccagaatgatatccctagtggatgataagaagggaggaggtagttctcagccttgttggcttgcagcttccagtatgggaccacctcctatgagtgagctgagaaaggggtgatcagagtcttagtattcttgatggctacttagggtagagtttccaccctatgagtaggacttgggtagaggaatggcacctcagttctcttggcattgcttgactagaacagaggttctaccacaaggtaatggggttggggaatgagaaacactggtagtctgtccttccaaaggtgaaactgtagccctaaactgagaattgggtggagagaaagctcttacgttcttgtctgcacttggtcagaatacggtacctgtagtagagtttctgtaacatggggctgggggtgggagaggaaagcagatcatgacccagatgccacagactcttactgttctcatcaagacttggtaaattttcttggatgaatgttgtcctttgctgtatgcccttaggggagttttgagagacattaaattattttttaaataatttttcccactaaatattttgtggggtgaagatctgctgagttactcatgctgccatgctggaagaatcactgggatagccagttttgatctctctaaggctgcatgaataggtggtagaattctccaaggtattagggagctccttagcttgggttctatagtgttagtcagttttcttcagttgccttctgttaaatgctaatctatgttagacaccaacttaaatcctcctttttaagctctctcaattgtccagttatctgaaaaggattagcactttttttcccagatgagagaaccagactccaagaggttatgtaatttaccaagggttgcacaactggtaagaggccttgtttgggcatgaacaactgtcaaactccagagtttgtgcttttagtcattagactatattgcctcacatacaaatattttaatgttgtttcatttataagattactatttttagccatctagctgaagcagatctgtttcaaaagccgttgatacctgtactgtgacagcagaatatattggtttttgtgtgtttttttaaagaaagttttcttattcccatttctttctcattgtcatttctgattctacaactgggcctcctctttcctggctacctgcctggtattgaaaactaagccaagttactgattgctcctgagaccttcaaaacccagaggatatgaattttactcaccggaatctattctgttttccaagactcactttcaccccactcctcgttccatggggctcaaagtagataaacagttgtctggcaactggactattttaagctctgaagagactggagagttaggctggaccaggtgtggaaaagtcccacaggagacagtgtaaagttggcgtaacaggatctctaatccaggcagagtggtgcagagcttatcttctagcctctctctcaggaaacctgtcttctcactttggcttaccactaactagttgtgtgaccttggttgccatttaatcatcatggccttgatttcgtgacctgtgaaatgagagatggttggaatgttgaatctgtaaggtctcctctagattggaaagggtaatttttatgagactccataagggatcactgaagctagaatttacaggagctggattctgccaactatatgtgatggagtagattctttgtttaaccagattttttaactttttaattctagacttgaatattacagtatgtatgttagtttatgcactcttctcaacttcagtattacagtaggtatgttagtttattcacatggcaggattgagagctctgcaagttatctgtggagagtttgaagaaggcagatatacaagcaggccaagtccgaagagatgaaggacaaacttacaagacaggagaaagcacaatctccaatcagtcctgagataacatagcatacatcagatttgaatggaccaagtaaaagaatgagaatcaacagtcacatctgggacaggctgacatatgttcaagaaagaggaacttgggcagactatgcggttctttcccagcagacataactctgggtcttcatggtttatggtctctgagcccaacacagcaggtcattgagtatttattaatcctcattggagactgacatctctaccgaaatacagggctttcttaaaattttaggattgtatgtttttattatgtttggtgtatgttttattatgtttgtatgccatattatgttatgttttattgtatgttttatattagttagggggctcctggcggcctggactgagtcttatccatttctatattctcaacatctagcatcatactcagtaaatagttactcatttagtttactcatttatttgagaaacagtggatttttaaggtagttctttccttggggtattattcacttgtactaaaataaggccttcttctacattgtattagtctgttctcatgctgctatgaagtaatactaagacaggataatttatagacgaaagaggtttaattgaatcacagttccacatggctggggaggcctcaggaaagttacaatcatggcggaagacactccttcacagggcggaaggagagaatgagtggcaagcgaaggggaaagatggttatacaaccatcagatcttgtgagaattcactcactatcacaagaacagcatgggggttactgccccccatgattcagttacatcccactgagtccctcaataagatttgggtgggacacagccaagccatatacataatgaatgatgatactgttgagccatcatcatttactcagaatttccctgattataaaattaatacttgcttattatagaaagcatgtacataaatataaaaataataaaaatcacctgtattggtccattttcacgctgcttataaagacatacccaagactgggcaatttacaaaagaaagaggtttattagacttacagttccacgtggcttgagaggcctcacaatcgtggcagaaagtgaaaggcatatctcacatggtggcagacaagagaagagagcttgtgcagggaactcccctttttaaaaccatgagatcttgtgagacttattcactatcatgagaacagcatgggaaggacctgcccccatgattcaattacctcccactgggtccttcccacaacatgtggaaattcaagatcagagttgggttgggacatagtcaaactatatcattctgacttggcccctccaaaatctatgtcctcacatttcaaaaccaatcatgctttcccaacagtttgccaaaatcttaactcatttcagcattaactcaaaagtccacagtccaaagtctcatccgagacaaggcaagtcctgtccacttataagcctgcaaaatcaaaagcaagctagttacttcctagatacaatgggggtacaggcattgggtaaatacagccattccttgtgggagaaattggccaaaacaaaggggctacaggtcccatgcaagtccaaaatccagcagggcagccaaatcttaaagcttcaaaatgatctcctttaactccatgtctcacatctaggtcatgccaatgcaaaatgtgggttgccacggtcttgggcagctccatccttccaggctgctttcatgggctggtcttgagtgtctgcagtttttccaggtgcacggtgcaagctgttggtggatctatcattctggggtcttgaggacagtggccctcttctcacagctccactacgtggtgccacagtagggactctgtgtgggggctctgatcctacttttcccttctgcactgccctaggggaggttctccatgagagcaatgcccctacagcaaacttctacctggacatccagatgtttccatacatcctctgaaatctaggtggaggttcccaaaccccaattcttgactcctgtgcactggcaggctcaacatcatgtggaagatgccaaggcgtgaggcttgtgccctctgaagccgtggttcagattctacattggcccctttcagccacaactagagcgactggaacgcaggtcaccaattccctagatggcacacagtatgaggatcctgggcccagcccatgaaaccactttttcctcctaggccttcaggcctgtaatgggaggagctgcctgaagacctctgacatgccctggagacattttccccattgtcttggggattaacattcagctcctcattatttatgcaaatttcttcagccagcttggatttctcctcagaaaatgggattctctttactatcacattgtcaggctgcaaattttccgaacttttatgctctgcttcccttataaaactgaatgcctttaacagcacccaagtcacatcttgaatgctttgctgcttagaaatttcttctgccagataccctaaatcatctctctcaagttcaaagttccacaaattgctagggtgggggtaaaatgccaccactctctttgctaaaacacagcaagaatcacctttgctccatttcccaacaagttcctcatctccatctgagaacacctcagcctgcacttcattgtccatattattatgagcattttggtcaaagccatttcaacaagtctccagggagttccacactttcccacattttcctgtcttcttctgagcccttcatactattccaacctctgcctgttacccagttccaaagttgcttccacatttttgggtatcttttcagcagcgccccagtctactggtaccaatttactgtattagtccatttttgtgcttctgatgaagacatacccaaaactgggcaatttacaaaagaaagagatttactagacttacagttccacatggctggggaagtctcacaatcatggtggaaggtgaaaggcatttctcacacggtggcagacaagagaagagaacttgtgcaggaaattcccccttttaaaacgatgagatcttgtgagactttttcactaccaccagaagagcacaggaagccctgcccccatgattcaattacctctcaccagatccctcccacaacacatggaaattcaagatgaaatttgggtggggacacagccaaaccatataatcacctatgatattttcctctagagagtcattgctatcatttctatttttccttttgatatttctatatgcatatgtattttattttataaacttgtgttcacactgcatatagtttgtgtccttttatcttatatatcatgaacatttaccacatactagtaaatatctttttaaataagttttaatggctaccaaatttaaatatgcaataattaatataatgccttgttattggaaactagattattttcttatttttttctcttcttttaaatagcatgggtataaaatcttttaatgtagaaagaagtatagacttttaaaggaaattttatgtttttaataaatgacatataaaggaggaatcattggtatattctaggaagttgtaggagagtagaaacaattagttttgaaactgcttgtatagatgtaaaaaatgccaataaagttcttagaagctgttttattttttagtggttttagttgtttaaaaatgttaacacaatagatatgtaaacattatatataatgtacattttaatgatacaacgtaaatatatattttaattactttaaattattaatgtacatattgatacatttatattcttgatatattttgttaaattgttttccagattgtacacacctattctcttattagcagtgtatcttcaaaaccctgcaccttcacctgcatgggtattttttcctaatctttgccaatttgatgaaccaaaagtgatatttccctattattttactttgcatacctttgcttattgttcaagttaatattttcatatgtttactggaagcatatttttcttctttaaattatttgagcatatctcttgcctatttttctactggtgctttaatgatattctaattgatgaataataattcattattaatgaattattttaataaatcaattgtaattgattgtcctattttattcaaattgagtgttttaaaagatattaagatggtttgcattgatatatcaccttctttttcattttttcttaaaagcatatttctttctgtattttgaggatgacttagaatgtagttaatagactgcaaaatagcaaagttgactaatttccactccctctcccctatcaaagtgctctaaggaacagttctttaggttagcttacacatactttggaacatcagtgtcattattcgaagattggtgaatgccatgcttttgaatatgtaccagcaaacttaaggtctcagtgtagctagacttggatttttgagctgtgtatatggattggtacttctgctggtttatgtcaaactgtgtgtaccttatgacttttccttttgggaataatataggagtgagaggaaggacaggtaaagagcactagattgagctcaatgtgcagagttgactggatagttaatgttgagctgtggagattagcatctcctctaactggtttaaccagctatgaatatcttacaggattttaaatggtttacagaatcactgggtaagctaatgatgcagattttaaattgagcttctcaggaatgaatttgagaataattctgtagaaccaggctaccatgattcctgttgcctttcctagattaagcaatggcctttgtcagaaaactgccacagaaaatctagagattttcacaatggtgcttgtctctgaaacagcagaaaacagtctctgtctaattcctgctttccagatcttgttcaagtgcaaaaaattggtgacacttaaattacttctagaaccctaactgtagaaaatcccaggaatgtagttcttaggtgttcagtctttgtgactcagaaaagcacatttgaaggaccttgaatggatgttgaatgccaactctccatatctaacacaatactcctttcattatgtcccttaatcaacaatatgatatggacttttttgcataaataaacaagaacagattgccattggttatatagtacaagtaacactaccaatagcattgtggtcctctgtggttataggattagaatgaatttaataggacaaaaaggaatatagagcataatcatgaaaggaggtatctccaagggcattctgatggattgaagggaaattgctttaggctgtttgtcacatttgccatataagttaaagtaggtttggctgggtgcggtggctcacgcttttaatctcagtgctttgggaggccgaggcagatggatcacctgaggttaggagtttgagaccagcccgagcaacgtagtgaaactccctcactactaaaaactacaaaaattgccaggtgcggtggctcacacctgtaatcccagcactttgggaggccgaggcaggtggatcacgaggtcaggagatcaagaccatcctggctagtgtggtgaaacccagtctctactaaaaatacaaaaaattagccaggcgttgtggcaggtgcctgtagtcccagctactcaggaggctaaggcaggagaattgcttgaacctgggaggtggagtttgcagtgagcctagattgtgccactgcactccagcctgggcggcagagcaagactccatctcaaaaaaaaaaaaagttaaagtaggttctccttcattttttataccctttccctttatctgttttgtatgcttctctttcctaggccatatatatatatatttctggtcttactctgttgcccaggctggagtgcagcagcacaatcatggttcactgcagcctgagcctcccaggctcaagcagtcctcccatctccatctctcaagtacctgggcccacaggtgcatgccaccacacctggctaatttttcgattttttttaataaagatgaggtcttactatgttgcccaggctggtcttgaactcgaactcccagctcaagtgatcttcctgacttggcctctcaaagtgctgggattacaagcataagccaccatgcccagcccctagacctcatcttaaagactggcatttcaaaggtttctatcttttgtttataaacattctccttaagtgatatgatgcagttccatggccgtaagtaccaccttgtgcttcagccacatggggtctatttgcctttccctcaacatgtgagtaccccttgccttaaaagctgcttcttggacctctgtctaacctaaccctaaccctgaccttaacccaactcaacccctctctgcttggagaatttatactagtttttaaagactcatttttttctttgaagtctttctggaaccccaacctaaataaatttaattgttctttcatctctacttttgtagcactgtctgttttatacaatggtcagattttattgtagttgagtgttcacatggttatctcctctgaaaaactgaccttctccatggtaaaagccacaccttatttatctttccatctcctgtagcactaggcccagggcctggtatgtcatagatacatattagatatctgcatgttaaatcatgagtggattgtgaaaggtcacaaatttaaaaaggatatttgaaaactcattcatactaaaacaagcttcattttagcactgtgtgattctcataggtcttttgtgtccatgtcatatccaaataacaagaaattttggttggcatctcagtgaaagcagatgagaaagagaaggataaataaacatcaatcaaatggtgattaggttgttcaccatggcctattctttctggaaacttaagcagcacagataaagtctgggaagctacagcctaaacttatttccaaactcttgtctcataggaacctaaaatagccttcctgcatacttcaagcacatctagcaaaagaaggctttctatagccaataagttcagtccatttgttagtgagatgctaatttacctgcaaagtcccatcatcagataagtaattatttgcacatgacctcatctcctcttttgatctcatcaaggaaacagcattttcagtattttttttttagggcttaatctttgtctgatatctaattgcagaatgagcagaagtgctctagacagcctgtatccacagatgatactttaaaattggcggtatgggatcagttgacggatctgactacaaagtgtcagaggttgcaaattccttctctctgtatcaaattagggatggaaatgaggaagtagggggccaaggaatttacattgatcaagtgtttatcatattctagtctagtcattgtgcagattcttttatgtattttgtctgtgactataggggttgttcccactttacaaatgataagctctgggaggttcatcatcttgtccaaggtcacacagctaatacatggcagggtcttgccccaacatcatgccttcccagtagccttccctcttcaccttgcctcatggtagatctttttgcccatatcttttaagtatttccacttccctcttgactgtttctgtaagaataagcacacctatctcctatgcacacaaacatgacctaagaagcataaattaaaagacaaaaatattgctgaatttgattgcgtcagaacttagaatttctgttccgtgaaggataccatgaacaaagccattagaaggcaaaatgagagaagatattagcactgtctaaaatgttaaggaataaatatgtgggcctagagaatactggaaatcaacatgaagaaggcagtagtcctaatagaaaaatgggtaaaagttctgaattggcaacttaaagaagaggaagcctaaaagctagcaagtatgtaaagaaatgttcaactcattagtaataagtacaatgcaaattttaaaaacaatgagatcactttgtagcagggatgtattaataaaatgtgttggcagggctgtgaagacgtaggcaccctcatgcactgattggtgggtgtgaagcatggtgctgccattctggagaacaatctctagccaaattaaatatattttcatattctatgacccagtaattcacttttctggtatatttcccagagaaattattgtacagacccctaaaggtacatattcaaggatgattattatagcagtatttatgggggcaagatctatgtgggagagtggacatataaaatatgatggatggccccagggactatgacaaaacagttggaagcaatagactaatgtatgtattgcaacatgaatggctcttataaacataaagctgggctttaaaaaagtaaaaaatagaatgatatataatacaattgcatatgtatacatacaattttacatgcacacagaataatattttatattttgcaagaagatatacaatcaaaaaacatcttagaagagttttctacttaggacattgtgggagggagtgagaaatggggataaaagagaacaaatagttttttaaaagcaaataggacaaagagacttgcgatgaataggctaatgattttgtaccatgaattgaggcacataattaactgaacactctgaatttgatttttttttttttttttgagacagggtctcactctgtcaccctggctggagtgcagtggcatgatcttggctcactgcaacctctgactcatgggttaaaccaattctcatgcctcagcctcccgagtagctgggattacaggcgtacaccacaacgcccagctattttttgtattttttggtagagatggggttttgccatgttggccaggctggtctcgaactcccgacatcaggtgatccacccaccttgacctcccaaagtgctgggattaaatgtgtgagccaccatgctggcctgaatctgatcttaaaaacaaaaatccactcacctgtgaggcatgaggttaagatagatatatggataatttattacttacttcaagcataaaggaggccacttctcttttactctttcaatgcttatccagttcccttttcactcactattttatgacattcaattagatttttgcttttgattttatataatgtaaatacaatgtaaattattcactttttaaaaatatgtttttggtttttatgtcatacatctttgccattgttttcttcttcatttctaagcttttaagggcagggatgatatttcttttcacttgttattatatagtccctagcatggtgataatcccagtgttcaattttatgaaaaatcttctaggaggaggttttcctttttaaattctaaaagtgtggataatgttcctaggagagtagatgactaaataatgtaggctgatagcatcaggtatcctttttaataaacaccccattccatcttaacacctcctctctgcctcctctctgccttctctttagcaaatctgtctgccttttttcctgatagaaagtatcattggttaataactgtagattcttgataattgttattgtgaatgaattgcaaaatcgtggtcaataattaataggttataataagtattgagcttaatcaagtagaagtagtaaatttagatatttcttcttgatagttatgattccatctctttgtctttgtgtttattttttcagcttctctctgtgtgtctttttctatatctctctactaatcacctctttctttctctttatctccctctccctttctttctctttgtctctttctttatttttgactgtgtctctttgtttttatctctttttttcccctctcctagtttctggttcatggcctcaccaacagtgtagtccaaggctgatgcatttgcagctatgtcaggttagtgctctagaattaattagagcttctatcttttttttgagtctgtaaaagctttctttgacaggctcattgtagtcttggaattatagtcacttgaatcaagctggtgagtacatattttgtagcttcataacagtaaagaaacattttgtgatgcatttcacattgaaagtggctccaaaagagtcagtgccattttgatggcacttgggaaaatgcatcagtaatatcatttagctgaaggcactttgatttctccaggagagctgaatagaccaaggccttgtgagactctttacagtcctgattttcttttccttgaaaaatttcatggcaatttccaggaagtttcagaactttatgtcatcaaactgaaactttttttcttagaaaaacattaagatttttcttctttagtagtagatggcttaaaggttttaggtctgctattggtaaatgcattggatgttcaaagcttgattgactaagtgggtaataaataaaccactgggaccagatgacatcaacccagtatttttgaagaaagtagaaggtaatattgtcaaaacttggttcaattatttttaacccttgttagttggcactgaacacaagaactatcagatttttttgagcttacccttcataagaattatcctacgaagacttaagcagtacattttgttggtgattattatctctttatttcatccttgtattaatcaaggttctcaaaagaaacagaagcatacacacacacacacacacacacacacacacatggcctctttggaggccaagaagtctcatgatttaccatctaccagatggagacccaggaaagccagtggtgtagtttgaaggactgagagctggagaaccaatagtatacattccagtctgggtgtgaggacctgagaaccaaaaaatgctgagggcaggacaagattgatgtcccagttcaaatgatcaggcagagttattccagccttcttttgcctttctgctctattcagcctcttaatggttggatgatgttaacccacattggggagggccatttgctttattcagtccaccaattcaaatgctggatggaataagagaaagactgaagacagagtccagatttgagggatgaatggtttgatttaatggcttcagaagtggagaagcaaaaatgttaaagatctattaataccttttgtatatgagagatgaaggaattggaggaatcaaagattataaagctttcaagtttggattggtgagaaaaccataatggtattagagagaaaaagaagagggttgtggaggtaagttagctgaagccagtaatgagtttggttttcaatacactgaaccttttgaggttgattccataaaaggtagtcatgtcctcatatgcaatgctcccaagtgtcacagagtgataacaatggaccagtgtagtcactgatcccacccatgtagcatttcttattttcttcagttaaattctacaaactcatcagtatctcctactaatactgccacaacagtgatctctgcttagttatctgtcaggtcaacatactgtgagcctgattatggcaagggctgcctgtaatctgtctcccaagtcctgaagatagcacctgccacttggtaggtgatcagtaattggttgttgcattggcatccacagtgtgcccaggtcaaggtgatgatgatacacagatgagtcaaatgaggagatagcactggtgtaatgtgggaacatggagaagaggaggagtgataattctgtttgggggttgaacaagccttcaaagagatgtgacattgaaggataaaggatttactggggctaaggagggaaaaaagatatttttaggacaggaaactagaagagcaaaggcatgcaggtgtgagagtataagatgtgtttgctcaatgactggaggagcaagttcacagagaggagaaataagtggatggtgctagaactggaaacgtatgcaggtggactatagaaaaccttgctaaggctcttatgtgctctcacacttcttaggacagaaattatttttagagtgaggaaagaaggggagggaggttgttagatggtaatttaatctggtatcttttagtagaagcacagagaactgggaatgaagagttttgagttttaatttttgttgctaactaatgtgattaggacaaagttataaaaattctctgaactatctagggttagtttctgttatttataaatactattattagtagtataatttttatttgatacaagaattcctaaaagttttttttttcaggaaaatatctagtttttttaattttaaaaaatctaataaaccaaacaacagttcatactcttttggtcacataggcatcaatgaaataatttctattctgactgtcatggagaatcattagcctgttacctgctaatgttccctttgtcttttacactgtggttttttgtaaactatgtcagtcttactatgattcaaaggacattaaagcaaatggggtgtttagtgacaaaagtatttacaaaaagcttttttttttttaagttcacactgccgtattgtactctcctcaaccttacttttaagtacattttctatacttaatttgggagaaattaccataaaacatttagtgctttgttttctgatatggtttggttttgtcccttagttcatggaattgaacatttgccttcagactgtatttatgtattactttcatctgaagaacatttattaagcacctgtttgtgggcattgccagtgatataactggtctgaacaaaaatatagctaatgatgtgcaagcagaaagtgtaagtttcctgcagccttttaaaataatattttactgatcataaaagcaatgtgcttagaatgtaatatatgtagaactttgaaaaataaagaaaagcacaattaggaaaataaaattccatgaaattctactgcctgaagataagagctgtgaatattttggtctgtttgcatgctctggtttttttccctatgcatttaaatatttatgtacatttacaatatcttgtgaatgcttcccctcttttaaatgagagtatagtgtgattgttcaggacttggctttcctcatccaattaataatgacagtgtgacctttatcaacttatttcgcctttcaaaggctctgttttattttctgcaaaaagggaataatactagtgtctacttcacaggtttggagtcagggcaaaatgagataatgcatttaccgcactcagagcctggctcattacaggagttctttattattggatattgcagttatttcatttttttcatgtatgtaatgtttgctaagctatgcacagtcagtgccatcagtttccttaccattcagttgttaatcacagagtttgattccattacaataataatcgctgagtcagactttcaccccactgtaacttgtccctagtggaaatttttccattagtttctgaaacttgggacctctctgttgtttccctcatgcagatttggtcacactagatgacctcatttggttgtcgtggggtttatttctgtagtgatgatagcctcttacattccctccaccatagaacttggtagggatgagaactagctggacggggccagtaacggggttgcatatgaccttctgggtggttctagagtctggatctgagtcacttctggcaatggatcagccataggatttcataagagtggccattagagcccttttaagcagaatactgaagtctggggatggaaccaacctaggattaagagttggggaatcagctatcaccagcatgaggtgggatggagaaggggatgaggctagcacaacattagggaattttgctgctgttttggtgggcaatataggtttggctgtgtgtttgtcttcttgtgtcttggtgacatcttagagcctcacactactcccttcctcaacttatttatttattggaaaatataataaaattgagataatttttacctttaacataaaagttcggctctaaaaaatgtttggcaaagcagaaactctaagtactaatgaggatatgagttgctcctacagccactttagagagctactaaatgcaaataagcatgacctgattctaggctcacaccctaaaaaatctctcccacagtactaagacagacttgtacaagcatatttatagcagtgttgtttgtaaaaatatgaaattattattaaggaagagtagtaaaccaggtcagatttatacaaggaaatactagaaagcagttaaaatggatgaactgtagttacatatgtcagcctgaattaaacaacgttgaatttaataggtgtgttgagaattacaggtacagtatcatacaatttaaatgatattaaagaacatgcaaatgatactgtatttatgcatttatgtatagtgaaagtataaatgcattcattcacatgttgaatactgtatttagataacaagtgctatgtctagagaaggaagagaatgagatgggggagataaagcatcagagatttgtattctatggatatgtatttaagttaaaaaatgacagcaaaaacaaatatttgagggggtggataccacgttttccatgatgtgattattatacattgcatgcctatatcaaatatctcatgtaccctataaatgtatatacctattatgtacccacaaaaattaaaagtaaaaaatttaaaaggacaaaatattaagttttaaggagactgaagtatgttttatattctctatttgttatctgattaacgtatttcaccattttcttaaatggggaaataaggacagaggaaattaacatataaccacaacaaattctagcagtgcaagggaaagtaagcctttatcacactgctgatccctgatcccttgttcctgtggccagagaaaactgctgttttttttttaatttttattttttattttttgagacggagtctcgctctgtctcccaggctggagtgcagtggtgcaatctcctcactgcaagctctgcctcccaggttcacgccattctcctgcctcagcctcctgaatagctgggactacaggcacccaccaccatgcccggctgattttttgtatttttagtagagacggggtttcaccgtgttagccaggatggtctcgatctcctgacctcgtgatccacccgcctggacctcccaaagtgctgggattacaggcttgagccaccgcgcccggctgaaaactactcttaatagttacccatgaatcctcatgacagccggtgatatagaagcatattgtatgcacattccttttacacctgcatggtaaatgctctttgctcctttcactacactatgtataccttggaggtcatttatcctgcaatatctgaccttttcttctaaagaaacttttgcttcatgaaggtaagtacaactacagtttctctaaagctcagttttgaaatcagtgatataaaatacatagggtcagttttacatagtaagttgtcaagacagattgcactcagactcaaaccaaccttgaaaacaaagtactgtatatctgtatttacatttgaaaggctcttttcccacttcagtttgtcaaacagttgaatatgttaagcttgagactagagacaatgtcagggtgaacatatgtgagggattcacacttctcaaagaaaagcacgctttttgtggccttggacaaagctgggattccgtgctgttgttattttcacaagtccctctactgagatcatgactgcatcttagagttgctgttgaatacagatgatgttaattttgttctcattcatattctatttagtttttaccaaactaaatgtttattagttggtgatatttaggaagtttgataggattgtgactatatagctatattttatgaaaaatggaggaaaagttccctttaaaatacctaaattttttttgagttaaagaaagaaaaataaaattcatgaaatagtgacgtgaagcttggtagtttagctgcagctgccaggtgtctaggctggctcttgggagagattattatgggatcacagtgagcctggctacacagagcatggaaagtcccctcgtccttgtcatcacagagtttggcttacagacctctcctctcaaagatggaggcttctggtctttctgatattgttttctcttcctgtccctccttatagagagaaatccaaaatatttttgctaaaattctctagagttgaatttgggaacaccaggggataaaacccctcatgttaaggcatgtaggaggaaaggtatcctcttatcaatcgaattgtagttcaaatatgctgtaaacccacctgtttactccttcgtggtggccgtaagatgtgaaaaggcaggggctccagaagttctaggtaggagtcctttgttcttatgtttttcaagggtctcatggtgaccaacattgttaacttcttttagcctctgtttcctcaccctcaaatgaggtcaatagtatctactttcagaagtgatattcaaaatatctgatatgggagtgggacttggctgttatcagacagatggcatatgcatcccgtaatgttgtgcctggtgctgtaaggttgtgcctggtgaatgtcaactaggactgttttacagggttgctataagggtaagataagatcatgcacatgaatgtgctttgaaaactgcaaggggatacataaatttgtactattaatgcaaaatacatgcaatgggcaggaagtttgagaagtgctttgagctgtttgaccagaagattctttaatgagaataaggaattattgccctgtgatgtcaatgtatttaaatatatgcttattatacatatattgaactatatatataatatacatatattacacatatattgaactcagcaattgaatgcttaggtatttacctaagaaaaatgaaaacacaattctactcaaaggcttataggtgaatattcaccgtagttttattcatcatagctaaaaactggcaacaatttcttatgttgatcacctgctgaatgagtaaacatgctgtgatgcctccatacaatggaacactacccagcaataaaatggaacacatgcctgatggacacagtaatgtagacaagtctcaagtgcattatgctaactgaaagaagacagacacaaaacattacgcaccatatgattctatttctatgaaattctatcaaaggcaaaactttagcaacagaaatcagatagtggttttcaggggccggggtcaggggagagattggctgtaagaggtatgaggaaactttctgaagtaatggaaatattctatctcttgattgtggtggtggttacatgattctatatgtatttgtcaaaatctatggaattgtatactgaaaaattgatcaatttcattatacataaattatacttcaaaaaaatggaactgggtaaaaatagttccctcatgaaaaaaatagaaaatgcaatgttgaaagagaaaggaggaacattctttacaaaacaaaatgtttcttctttataggctatatatttcagtttcagcttcgagtaatgaattttatggcttcgtctcttgcattgagcattacactctagtgaacacccaacttgctaagtcgtcccccatacacaccttactgtttctctctttgttatcatttccttatgctgagcacttgcctggagtagctccctcccccagccttccctggggctctcatttcctccctcactcatttggttaactcttatttaccattgaagattcagtttggaattcaccttctccaagagccttcccctggtttctccccatccctttcacattggggctcatttgggtatccctggccattagctttgtcagtatactcaccagatttcactataagtagctctttatgggtttgtcttccccaaaagaggttaaggactatatcttacacacttttataccctggtgcccagcatgttgctgatggtcaatagatgtttgtagaattagtgattgggagtgccaaagggagtggtgaggacatgtgagattgtggaaagaatgcaagggaaggaagattatttgaatcccagtctctcacttagtggttagagtaactttggacaagttggttaatgtgtctcagatagaagatggagatctagacccatctactggataggattaccataagatctacataaaactatgatgtgaaagcactctgtacctagtaaagcagttcacacacataagttattattatgtcattggaagagtgttgtttctcagctcttggatatagcaatgtaaaccaaaccaaacggataaaatatattcaccttcaactttaagggtagtgtctgcattgcattgatatgttcacctgactccttatagcatctagttagaacttcctctgctcataagagacagctatagtcttgtcagtcctttcactctgttatttctcattgaagcaattgctaaccagtgtatataatttttgaaaacatggatcttgttttatttagctttgggtcctctatagcacttactagagttcattgcatctagaaatgttaaaatggcaagccaagtagaggttaacatagacatctagagaaatgttatccagttttccagagaaggctaaatatcaaaatagtgttgtaattaaatcttatttttagaatctgataaagtaattttgggttaccacagaaatctttcaagtttaagctaataaaatattaatgtcctggatctttggaaatctactaatgtcttcatttggaacttcataagaatcaagaatttcactgcatctaagatccgttttccacaagtcttaaaatctgaactacagcacgttatctatgtgatattctttctagcatttcataaacgtattcttttaaaaaaataattattttatcttgattatagaagaatggagtctataccttatttgtaggtgatagagcaagcaccaggcccttgacccactcttactgcctccgttcatcattatttttagtttctactaacctttattgtattatttggaacaaaatggaagaaaacctaactgggtgtataaattttgatgtacattaacaattcatcaaagtgatattatagataatgtgactgttttcataaacaaaacaggactaaaataaatgaatatgcagaagaaagtgtgagagatactgaaatattttgctggtatagtatattatgcagatgtttgcatttatgaggtagaactagaaaacaaaaaaactctatgttataatcatttttaataaatgaatttttatttccaggtaatttatacctatattcaagtcttggtaagcaatttaaaataatttgctgacttgttgatctcacctttcaaataatatgccaagggccaataacttcttgcaacatgtatagatatttatccaaatgtgtttttgataaggatatgaaaatatttggggaataaatccaatacttatgcttatttatggtacataaatcggagtttcccatgagtgaccgtaaaaattggaggaagtggaaagaaagaggaactgaaatataaaccaaatgtttgtttatgggctttatttagaaatccacattagtgattctgacattgggatattaatccaaaatttcctttctttgtggattattttcacacaaaattgtacattctcatgaggcaattctctttggagtacccatagagaattattacatttttaccagataggttctttttaatattctaatctagcaaatttgcatttaagaaaactactttattccaggatagcttttttgcacaagttattgttctgcccacctcccctcaaataaaaccagcatcataacttctcagagctttgtctgctttcaagattctttggcacctgcactgggttatatgccataccaaaaatgtttcccagccattcatgtttaaatacatttaagtttacattaatttttaaaaggattaaaagcaccttcaaaaatgaagcatgtattctctaagcagcaagtattaatttataggggctgttcatggaaaaaaatgctgttattgtatgtctcttgccccatgcataataaagaacttttctttttgaaagtaattgctgtaaaatattccttgagggatcaaaatattagtatgactgggaagtaggatctctgttcttaggcagattgttttgttacttagttccaaatataaaactggacaaaagtaggtgaggtaagggaatgatagagtggttagaagagatctttagataagaacatctttggcaacagggatagggccttcacgatctttcttaaaatcctggagcggcaggcttcacgtgggaggaaaccaggggttgccactagatcagctaagagacaagcaaataagaggctgggtgcagaaaatgctgagtctctccgaaggtttttccctcaagctgagctggtgtctggttttctgaccacatgttgtttcttctctttataagagtgaaacaacattcctgtttaaaaaaaaaaagccaaaatgtttgtcatcaagcctgacagtgatatgggtcctcactcaaatacagtgagacttcttcctacgatattggtcctgtggagttaggtcagaaggatgtggttataaaataaagtgatttcattttgtttatctcctactcagaaactttcagtgttccccctttcccgcagtgacaacaggaaaaggcccaaaagcttcagcatggcaggtggaggccttctagaacctggttccaatcttagcataacttttaccacttcctaactcaagcctcaactctagctcaaccattcttctatgtaatcaagagatattctaggcacttctggtgggaagtagagaataagccaaggctgggaggggtgaggcctggggaactttaacagagattagtacccagatcactaaatttggggttggagggtgaggcaaagaactctggtactgtctacactgacagtctttctaaggtacctttccaagaagagaagacagtgcttgcctagtgactgtgatggttcagggataatgtgacaattcttgacaccctgctgttactttacttatagatcagaacatattctgtgagctgatatattagattttagaaggagaagccaatcccaaaagacaggtaggaattaaatggggaactcaggatacccaactatcagtttggtggccagagctggacttgctttcttgaggaaattatgatgaaaaccagggcctgagtcttgcagtcaaactggcctctgaaagagagggctggaggtgggaatgggtgggaaaatggcagctcactctgctgcctaggactcataacgcctggtatatcagataccagaaaacaagtattatactattccagagattatctgtcttactaatagggccctgggtagggcagagcctataggcttttaattttgacacctgggcaggacaagttctttcagtgacggacacttatcttccagcactataataggcctcattatggtacatatgataaattatcttgtccaattaatttatgccactttagactaaggactgtcatatatatacatatatatacacacatatatatacacacatacatatatatgcacatatatatatatagtttctttaggtcttaccaaagtattaaatactttttgaacaaataacgtattttggggggcattattctgtccacttacctaaatcaaggatgatataaacaataaatacaatttcaataaattagattttaatttttttttaatgaacagaaagccaattgattggtttcctgaagctctattgtttcctcctgtcaatggaatacaaaatcacaggaactctttatcacttagattggagattacgaatgccgtgaaggcaagtaactgcctttcttcttctaattattttggaaagaacatatttttcactagaaagaccagaagctggaaagccaaaggctttggccacaaaactgtgaagggactctggatggatggaggctccacaagagcttcattccaaattaagatgttcaggctacattgaagaaagcaatctatttgccttggaaaaatttattagtgctaagagctaatatatgaaatatacaatctgtatctggatgtttgcatttctctaaatcttgccctcaacatatatatcattttcaataaatggttttgagccataattttttcattcattctatatgccagttggtgtgcaggtggtgttgatatagaaatgagtaaggcacaggtgctaacatcaggggctcacagtcctcactggcatcaggtgaagcactgcatgcaatacaaggacaagtcctcaagcaactgatgcatagatttttaaaaagtggtatagccatacaacagaatagtctttggcaataaaaatgaatgaagtactggtgcatgctaaaaacctcagaaacattaggataaatgaaaaatgccaatcacaaaagaccacattttatatgattccatttatataaaatgtatagaataggcaaagacatggaaatagaaagtacattggtagttgccaggggtttggcaaccccactttgccagcggagggtgcagatggggagtgattattaatggtactgtgtttgtcgtagaggtgattaaaacctttcaaaattgattgtggtgatggctgcataactctgtgaaatactaagaacctttaaatgaacgcttcaaatgagtgaattgtatgacatgtgaatttaacctgaacaaaggtattataaaaagagagagagagaaatggtaggaggagatagatctttcaaaaaattgtgaattaggggaagtagagaaaagggaaggtgttaaaagaagatgttttaatctacattggttatcaaatgtacacaacagttttaagtacacattctcatttcatccaaacaacattgctgtgattttgctgttatttagataaggaaatggaagcttggagagcttaagcgatttgccaaaatacatacaacttaacaagcagaatgggctattaaggtcagacctgaggaaagcagatcacagttgagggggttggaggaaaaaaagaaagaaagaaagagaaagaaagacaagatgaagatacagggattttgaattctctgatcccagaagctctcattggctaaatcacagttttagcactgttcacttttattcttttgtaggctaatgtactaagctaattatgtatttacattttaaattccttgaggactaggcaatgtctctatcatttagattcttctaggtacaggcatccctcggagatattgtgggttttgattctggaccaccacagtaaagtaaatatcacaataaaattttttggtttcccagtacatataaaagttatgtagtctattaagtgtgtaatagcattatggctaaaagaatgtacatactttaatttataaatactattaatatattgctaaaaatgctaactgtcatctgtgccttcagcaagttgtaatctttttgctggtggtggtcttgccttgatgttgacggctgccgactgatgagggtggtggttgctgaaggctagggtggctgtggcaatttcttaaaataagacaacaatgaagtttgctgcaatgaatgatatttctttcatgaaagattcttctggagtatgtgatggtgtttggtagcatttttcccacagtaggacttccaaaattggagccagttctctcaaatcctgccattgccttatcagctaagtttatggaacattctaaatcctttgttgtcatttcaacaatgttcacacaccttcaccaggagtagattccatctcaggaaactcgtttatttgctcatccataaaaagcaactcctcatctgttaaagctttattgtgagattgcagtaatttagtcatatcttcaggctccacttctaattctagttcttttgttatttctcctacatctgcaggtacttcctcctctgaagtcttgaacccctcaaagtcatccatgagggttggaatcaacttcttccaaactcctgttaatgttgatatttttacctccttccataaatcatgaatattcttaatggaatctagaatggtgaatcttttccagaaggttgttgatttactttgcttagatacatcagaggaatcacaatctatggcagccatagccttatgaaatgtatttgttaaataataagacttgaaggttgaaattgctatttgatccatgggcttcagattggatgttgtattagcaggcaagaaaacaacattaattttcttgtatatcttcatcagaactcctgagtgaacaggtgccatgccaattagcagtaatattttgaaaggattttttttctgagcagtacatctcaagagtgggcttaaaatatttactaaaccatactgtttaataaaccatatctgttctataaacagatacgctgtcatccaggctttgttgtttcatttatagagcactgttagagtagatttagcataacttttaaaagccctatgatttttggaaaggtaaatgaatattggcttcaacaaagtcatagctacattagtttccaacaagaaggtcagcctgtccatttgaagctttgaatccaggcattgacttctctctagctatgaaagttctagatcttctaatagaaggctgttttgtctacattgaaaatctgttgttcagcgtagtgacatacctcaatggtcttaactgggttttctggataactagctatagcttctacattagcacttgctgcttcaccttgcattttcatgttatgggccctctttccttaaatgaaccaacctctgctagcttatatgggtgcagttcatggtgctccaaaacaattatgatagtaaatcagaactcactgctcacaggttatcataacagatatagtaaaaatgaaaaagcttgaaatattgcaataacttttcttttgtagcttccttacttctttcagccatcatagaattgaagagagttagggctttcctctggattaggctttggcttaagggaatgttgtagggggtttgatcttctgtccagacagccagaactttcaccctatcagcaataagactattttgctttcttatcactcacgtgttcgctggactagcactttttttttttttattattgagacagagtcttgctctgtcacacaggctgcactgctttggtgcaatcctggctcactgcagccttgatctcccaggctcaagcaatcctcccacctcagccttctgagtagctgggactataggtacatgccaccatgcccagttaattttaaaatttttttgtggagacagggtctcactatgttgcccaagctggtctccaactactggattcaagcaattctcctaccttggcttcccaaattgctgggattacagcaatgggccaccacacctagccagcactcataatttccttcaagaacttttcctttgcattcacaacttagctaactgtttggcacaagaggcctagcttttgccctatcttggctattgacatgccttcctcactaagcctaaccatttcttgtttttgatttaaagtgagaaatgtgtgactcctttcacatgaacactaagaggccatcgtaggttattaattggcctaatttcaatggtgttgtatcttagggaatagggaagcctgaggagagggagagagcaccatgtactgcacccatataagaagagaaacctaatcaataaactttgtgttctgactgctccatcaaccttccggacaagtcagaacacaagcaacatttattgattaggtttctcttcttacatgggtgtagttcgtggtgctccaaaacaattacaatagcaatatcagagctcactgatcatagatcatcataacagatatagtaaaaatgaaaattcttgaaatattgcaagaattacctaaatgtgacacagagacatgaagtgaacaactgctcttggaaaaatggtatggatagacttgcttgatgtggggttgcaacaaactcgatttgtaaaaaacgcattcatctgtgaagcacaaaaaggcaaagcaaataaaatgaggtatgcttgaatatttggggacctgactacccatttgcctgttttgggcaactgtattctgagaaaaatctgagctcattggcaaccaatcagtagaagtagggtggccacagatacagacatatgtccttgttagttgttattattttgtaagagagtatcacctgtagtgtcaatatgtattaccctgccctgaactgataacatggaacacacattagctccaagtttttggcagagatgctgtcctttaactctttgttattcaatcctcatcaaatccttctttcctttttctaattgcactccttttatactcccgtatcaaatccttcaatgtaaactgttaattctatttctaaaatatattgcaaattcagccacttctttttctcttctgtgaaatcaggcctggccatctccatcatctttgtttaggtctttcttttcagctggttacattactttcaagtctgtctctcctctactccgtaactgaaaaactatattttttttctatggaaattccatcacatagctccctgaaggtcctcctgcctagaaaaattatcatcacacaattaccttttaaaacacatcttaaaaacccaatcagcaaatgtttgaggggctaatatgagggagcttcaaaaagtttgtggaaaaagtgaattaaaaataaaaatgaaaaatataacctttatttctcaacataagctccatcaagttcaaaacacttttgtaagtgatgatatcagccatttagtttatccctaaataactgggcactctaggtatataaccatatcattgcagtcttttttacattattaactaaagaaaaatgggtgccctttacagatttttaagattaggaaacaaaaaaaaatcaaaaggagttaaatcaggactttcaggtggatgcctaataactttcccttgaaacttttgtaaaattgcccttgtttgatgagcagaatgagcaggagcatcattgtggtggagaaggattttctggtgaagctctcctgggcatttttctgctaaagatttggctatgtttctcaaaacactgttataataagcagatattattgttctttcacctgcagaaagacaataagcaaaatgccttgatcatcccaaaaaactgttgccatgacctttgctcttcattggtcagcttttgctttcacaggaccacttccacctcttggtagccatggctttgcttgtgctttgtcttcaggatcataccggaaagccatgtttcatctcctgttacagttatttaaagaaatgctatagaatcttgattccacttgtttaaaattttcattgaaacctctgctcttctctgcagctgatctgggcacaatggttttggcacccatcaagtggaaagtttgcccaactttgatattttagtcagaattgcataagctgacaaatcaagatatctatggtgttggttattgtttctgctgttaattgtcactcttcttcaattaggacatgaacaaagtgaatttttttcctcacagattgatgtggatggtctgccactgcaagcttcattttcaacattgtcttgtcccttcttaaaatgagttatcgatctgtaggctgctgattcctttgaggcattgtccctgtaaacttttcataaagcagcagtgatttcaccattcttcttcccaagcttcaccttaaatgtgatgtttgttcttgtttcaattttagcagaattcatgttgcactgatgggggctctttttcaaaaaaatattttttattgtactaaaatatacatatataatttaccatctttatcttttttaagtgtgtagttcagtggtaataaatgcatttatattctatttgtttctttgactcttctcccctctccccttcctggcctctgataactaccaatctctatctttatgagatctacttttttagctcccacatgtgagtgagactatatgatatttgtctttctgtgcttggactttttcacttaacataatggtcttcaattccatctatgttgctgcaaatgacaggatttcattcatttttatggctgaatgatatttcattgtgtatatatatggcgttttctttcttcattcatctgttgatgggtacttagcttgattccgtattttcactattgttagcagtgctgaaataaacacgggagtgcagatatctctttgatgtattgatttcctttctttttgatatataccaagtagtagaattactggatcatatggtggttctacttttagttttttgaggaaccttcatactgtacattaggctgtactaatttgcattcccaccaacagtgtatgaaggttcccctttctccacatcctcaccagcatctgttattgtgtgtggtgagatgctgtctcattgtggttttcatttgcatttctctgatgattagggatattgagcatttttttcatgtacttcttggccatttgtatgtcttttgagaaatgtctgttcaaaccttttgcccaatatttaatctgaatttttttttttttttttttttttttgctattgagttgtttgaactccttatatgttctggttattaatcccttgtcagatggatagtttgcaaatattttctctcattctgtgtgttgtcttttcactttgtcgattgtttgctgtgcagaagctttttaggttgatataatcccaattatatatttttgcttgggttgcctgtgcttttcaggtcttaaacaaaaaatatttgcccagaccaatgttctgggacatttctccaaagttttattctagtggtttcattgttttaggacttctattgaaatattttatccattttgatttgatttttgtgtatagtgggaaatagaggtccaatttcattcttttgcatatagctatccagtttttgataggggctcttttaaaactgatgtcttatccttcttagtgcctcaaactagattctgttcagatatgttataataaattagtatgagtttattttgatgcaaaaaagttgaaatctatttttttataatacacatttttcatgaacttcttgaagacccctcctatttgccagacactgttctttcattgactaataaataaattctctctcctttcttttttcatttttcagctcttgggttttacagttttaaaaattaatttttaattagacaagtaaaaattatatgatttgtactgtacaagtgtgatgttttgatatgtatgtacactgtgtaatggccaaatcaggcatatccattacctcacatacttaacatttttttgtggtgataacacttagaatctatcctcttagcaattttcaagtatacaatctattgttattaactatagtcagcatgatgtacaacatatctcttgaactttttctaactgaaaatttgtgtcctttgaccaacttcttcccaatctctacattccctcatctctggtaatcattattttactctctgtttctatgaatttgagttttctagattccacgtataagtaagctcagatggcatttttctttgtgtgcctggcctattttacttaacataatggccttcaagttcatccaagttgttgcaaatgacaatatttctttttttggtaaggccgaatagtaattccattgtgcctatataccacatttcctttatccattcattcactgatggacacttaggttgattccatatcttgggtattgtcaataatgttgtaatgaacataggagtgcaggtatctctttgacatactgatttcatattctttggatatgtgtacccagtagtgggattgctgggtcatatggtagccctatttttaattttttagctctatttttaattttttgaggagcctctacactgtttttcataatggcattctcaatttacattctcttcaacagtgtacaaggattcccttttctacttatccctgccaacacaaattctaactcttcaccatggcccaggaggtcctgcatgatatggttcctgcctttttgtcagattttgtctcatgtttctctttgccctttctcactgcactccagccacaaaaatcctctttcagcttcttgtgaaggttttcctgcctagaggcttttgtaggtacagtgacctctgcaatgagtattcttgtctccattcttcttgtccatagttcgttagcataaaatccttcagtttttcagcttaaatatctcctcagagaagtcttccctgatcacctaatacaaagaagttttctgtccccctcattcttcagttagctaaaaataatagaaaacccaaaacaatagttgcttacacaccatagaagtttctttctctgtcatatgaaattatagataactatgcaccagagtgttagcaacccagattccactgtccagatgttcctttccaagcctacctcgtcatccaggatggcttcttccatctgcatttgagtgaccaggataaagacatgccaccccctttaagtaacatggccacatctagctacagggaagctagaaaatggggtctttttaaaactctagacagtcatcttcccagcaaaattaaaactgttattactaagggagagggagaaaatggaaatggagggatgaagaggagttacattccacattttatactcatggtagaaatggacttttgtacattattgtatcacatggcatttttaattatataattttcttgtaggcaaataactttcttatgggaaatttgtgctactcttaagcaactggcttgttttcctattatggacattgtgaatcttctgcctgattatgttttgctttttgatttgtttgccaggaagtttgtagctaaatttatggtcctctccagcaactacacaaatcctatgatggatattttttctgataatattatctgtagcgttattttattttactatactttcttcctttctttctttaccttcttcctttctttttattttcttcaatgtaattttgcaagtctcttcaaattcctttggtaataagtcaggaaataagtaaaacacaagtataaataaataaagtattttatatttaatgaaggtgataaaagtgcctacattatagggctgtcgagagaatccactgagttaatgtaagtaaaacatttagagcagtgcctggcatattgtaagacctatagaaatgctagttcgttattattattattttaattaaatctttcctgaagtgactgtcagataaatctgcttgataagacagttttactttaacttttgttctaggttaaacaaagagggaaagattaaaatatacatttaaggaccactcagcaacaatcattctatgtcttcatattctaatctacatggcagctagtaaatgcattgtgctgtgtaagataatgtgctaaaactcttagtggagatggcctctaaattttttatgtttagtatttaggcatcttgtagataaaatgtatggatgaataatcagatgaggattcaatgaccagaagtactgttgctctctctccatctctttctgttagaaatagatctccatcagataggtctgtgtttgaattttagatgtactaccaaccacactatgtgacctaggtcaagtctcagctttcatgtcaatatatttaccgatgggtggcagtaatacctatcatatagggacataaggattacattaaataatacatgttaagatctttgcatggttcctggccagagtacacatacaatagctatttctgatatcattattttcactcaagtcttttaaattgaagaattatcaccttttagcacttgaatttatattgaatctatacacacatcatttttttatttaaatatttgaaatccttaccctacaatccaatggaaattctgcaaatgtttaaagttttggactccatgacaaaattgtatagatagaatagtggttttaaatatggctcggggattacaaatggtccacatggatccttgggaatgaatcaagctacgagctcctatagcaataatatttctattaccatagcgtatgtgcctaagtttctggtgtggattaataaattattactgttgttaaatggatgcctggttttcttaattggtagctcatcaaaagcttattaaaaacttcctattcattttgttgatttcagtggttggggataaatggcccaggaggctctttgccctgctaaagtggatcatgaacaatgtgggatatttaattcaattcaattcagcaaacatattgaattcaaaatatgcaaaaagcattgtgctacaaattgtgacaatatcaagggacatcccctgtggtggccttctgttatttggtacccaggatccatttttattctatttgggaactacagccttggcccactccaagctatgtggtttgggtaggattggccccttacccaggtctgggggtggaatggccttgcttggcttaaggtagtcagcataaccctttcctatggccatggtattagatttatgagtgggcatataactcatgaatctttaaaagacttgtgcctggggcttctgaaaaaaaatgaagtctcctctgtctttgcagtgggaacttctggaaaagatactttctctttccctgggcctatagttaggatgtaaggtataggagagcctgcagatgttttgggggagaacaccacacagattttgaatatgaagctaacaccatgggtttggagtcggtctgacctggattcaaatccaagcactgtcactttctagtttggtaaggtatttgagcttcgttgtgcctccattttgtcacctataaaatgtggctaatgcccttactctctcctccttaaaactatttggtactggcttttaattgtaacagaattaacatcaataattggatttgtgcccatcaagccaatgaactttcataaaatgaaatccagaaaattttcatgtaattcatagagttcttatatttaacccatgtctctagaatcttcttctagtgacaaattatgttgtattgaatcatgtgaaactgagccaagtttatcattatttagggtagaaattctgttttgttacagtagtttcactcaagttttacttctctaagaagaacataagacacacttaaaattttaagcatatctacataaaaaagcccagtttgttataccattttcatagagttattttagccctctaatatagcactgtaataacattttgtacttgctacaaacataagcacactagtttctatcatttttgcccttggtttataaagatggaatttagaaagcaaatacatttagggatgaaatagtgaaatctgctgaatgtgtgtagaattattaaagagtataacatggctgcttgttttatttagaaatgacattgggtgggttagctaaccaaagctgccaatactgtattttaatgatcttgagtttatctcctatttacaattctttgtcatttagtctacaggtgttagatcacttaacacttgctgaattcttcagatttgtttgtttcctgccgtttggtgttgatcattttgatgtgtgataggaggaggaagtagttatctaattttcactgaacaatcttccctaaggtatcacatatattcattctatatcttctatcagtcagccatagattgtgaaaaactttgatagaaactttaaattcagagcccctgaattagtcagttttcactcagtaatgctatgataacaaacaacctccaaaatctcagtggttcacaaaaaccaagctttaattcttgttctgtatatatatatacatatatctgccgattagtagtgcctttgctcctgcctcaggtatctttttttaccccagaatgcagacagaaggagcagcttccatctgggacatgccattctcctggctgagggcaatgatctctctttttcttttttcttttactttttaagttctggggtacatatgcaggatgtgcaggtttgttaacataggtaaacgtgtgccatggtggtttgttgcacccatcagcccattacctaggtattaagtcaagcatgcattagctgtttttgccaatgctctccctccccgtactccactcctcaacaggcctcagtgtgtgttgttcccctccctgtgtccgtgtgttttcattgttcagctcccacttataagcgagaacatgcagtatttgatttactgtttctgcattagtttgctgaggataatggcttccagctccacccatgaccctgcaaaggacatgatcttgttcctttttatggctgcatagtattccacggtgtatatgtaccacattttcttagagacaatgccaaatcttgcaatggtccttaaagctcctgctcaattatgactgtatatcatgcgtattcatattccattggccagagaaagtctcttggccaagtccaagctcagtgtctttgactgagatatcgcagtttacaaggcaatgggtgggcatgagttttaagaggaaataatggaacatatgtcataggtctgttttggacagggctactggtgtatttttctcttatgtcctattcttctgctgtttttttctccaaaaactcccttccttggttctctcatccacccctccatcacttcctctgtactcttggctgccaagtagacccatggagcctactccacttttctgtccagcctgatgtagaatctttaggatataggacctaaattattgctttagtaaaaactggagctgtctgatgttataaggaatagctctactctgagccaagtaggcttggtatttactgaagtcatatccactttgttttattcctggtaatttggcttgaagtgaaattttaaataaaccagatacttattgcttatgcccactaaatatatgtccacagcccttaaataactacctttgtcttatagtgctttatggaacatagagcaattttaccaccattatctcatatgatggtcacaagaagcctggtgatgccaatattattgtgattcccatttcacaggataaaaaaaagttaagtagcttattcaggatcaaaaggctggtgagctttatagccagcattcaagccagggtatatagtgataggcatttcttgttattgacaaagaaatcctctgctttaagcatatatcgaataatgcataatgtaataaataccctgttttttcaaaaaaaagttacagagtaagatgttggcttgtttcactgaaaatattcaacttaaaatttttagaaatgtcttattagttttgaatgatctgatgactaaatttcagtttatataaaactttccctcataaaacaatcattacacagtttgggcactatgcttgctggagtataaaaccccattgcagtaaacagtgtgtcatcatgctgttactgaaagtggcctactatgctttatctccactgccctgtcccaatctaagccactgtcacctcttacccagaatgtggcagtagtcctttcaacagtcctctataccttttctgacttcctccaagcttttcctcaagctgagcctagtgatatttttaactgtgaatgtgaatttgtctgacttccctatccttacccaaagtccttaatacaagtctcccatgtgatatcaccctgcaaacgtggccagccttctatcgtcattctctccctcaatttctgcttactttctcatcttagtcctctctcctacccaccctccagccagtgtctcctagtcaattggcactcatttttcccatcccagcttcccagggaagctagccatgacccccagaccatgataactagcccattttagtctactgtagctggcaactcacctccatatcccacccattgccacacctggattttcctctgtaaatactgcttgaacctgactgaggtgcattatgcttcctgctgctcactttaccaggttagatgacagcggttttcatgaaagccgtccctcactcacgcacattagtcacctttacaaggaaacacccagtgattagagagaaagcaaccaccatgtcagccatgcttcaaagcaaccatattcaaaacaagttgtttttggaaaagagtatatttcatgttttagagtataaatgttccctgtgataattactataagaaatcaagatactccagtctgagtgcctgttcatgctgctgcaaaaacaatgggaaaagtttggattttaaggcaatccaatttctaaggaccagaagcagtctatgcttatggctgcttattgctagttgggttcttataaacctggagtgtcctacatttcatgttgaattgaacataatgggcctgtgataggcacctctccacaaaataacaaaagtctctgtataaactcaatattttagaagtcaaagtagacaggatactttgcttgtggcttgtcctcaggtatcagtacagcaagtggctctcagcacaccaccaaacagggcaggcagctggctctctagagataattataatttattgtgcccatggattttgatgcagtggggtctgggctctctcacaaggccaacagagcaggtctaatttgagccagatctcaggagacacagtccggagaggatgggtcatgtgccttcagttatcacttggagttgcactttgccccttgttcctctttctctcaactagtagctgagttttaatttttttccctgaaaatttattcagagagactgttttccttttcttcctggaattcacagaatgaagatggaggtccataaataccttggttaaaagttggaagatcatagagtgtcccactgtctgttttggggcctggcaggaatactcctaatcactgtaaatgaataggtgtttcatctatttttgtcttctcttctttgttctctacctgaaaatgtccttccctcattttcaggctactgaaatcttctaaagccttcttaaagtttcttctttataggaaacttcctagatttcttcctttagtcagaattaatgctgatttatgttctctcatgaaattgtactttgtactttcatttagtgctgtgactgttctttttaaagttattgtttacttatttttttctcctccagattatacaatccttaaggatagtactggaatttcctcatcttcctattgtccacattgcccagcgtgaaattttggcccagtaggaaggctatacatttgttgaattaattttgatctgtaaggcatattcttccacgaaaaggacattgcacaatcacaatattctccataaacaaatggacactcagaaagaactgttgtgttcttttatctgccttccatgaatgtgcagtttccttaccacttctccatggacctagttatcttgcatagtgcacacattagaagattatgtgataagagtagaaagctaggtttcctttgggtagggctagactatttcctgttcagaggtgaagacttctgaaatcagaatcaattttctaaaacataccacattaaaataagaccatagacacgtttttctgtctataagtctttttattttgatggtagaaaatgttgtaagattatttcattatcttcttattgttaactgttttggggaagaatcaaatcaggagagactgagattggagtctttttatcaaattctctatagactacatgatccgtgccaataccacagcagtcagcagctgttgtctgtgctaggagaccacagtagtaattacacacaggttaagtggcttaaaaaaattgatcggttttgaaaattaggtgtggaagatagaaaggaacctgaggatttttataatatttttgtgatataatagactatagccaaaagagttactttatagtgagtatttttagcttcagtcccacattctcttcagaaattagtattataatccttttcattactctaaccgagtctgatgactcctgtcctaggatgaaacacccctcccaactcccttattaagagattgggacctagtgtgattaacagcaccctgatcgatgagcaagattcttacagattaaggaaaagaattgctgacaacttaggctgacttttatatacctatttgttttccttcctaattcctcttaaaatgaaaatgccaagcttttcttttgatatttgttacatttgtgaaataatataacaatgcagttaatgggaagagcatgacccctggattcagatatccaatagttacaaatctcagcttcagcacctagcagttatgtgaactttcttctctgcacctcagtctcttcataataactactttgcagagttgctgtgaatattagtgtaaataatggacattcaaatatagctattactgttattatcatcatcaattattctacctatagaaatatgcaagttccttggaagtatacatttctggagagtgatcagggatggggtattatacttttattttttcggtttctcttcattcattcagtgggttatgggtatgtgtgtgtgtgtgtgtgtgtttcacacattatgtgctaggcactatttcaggcacttggaacttacattattgtaggggtacaactggaaactgataaatgctgtaaaaaaaattaaacaagctaagaggtacaggaggttgggagagagttgcaattattaatagggacattagggtaggccttactgtgaatatgacacaggttttgtgttcttagaggttttcatgaactatcttttggaatgggaggatgggaagaagggagatgagagtaaagagtaagagcttgctgatttgtaggcaggcatgaatattccctttggtataaggtgtcaaaacacaaactaatatggaagggtaaaattttctaggtggtctagttttattttattccatttgagcaaaaatcttcctaaagtattttgtacacaccctgccttcccaaacaatggctactgaatacagtggcccaccttgtctgtgactgctggaggaggtcatcaccatggctcacatctgttattggactttcatgaaacaagtccctcagggccagaagagatgctgtcatctgtttgtcctatgcaatggcctgagcctgcagtcattgtgagttctacccacatgtggctatttaaatgtacgtataaattaattgaaattaaatgacattaaaaattcagattcttagtcagtctagtcacatttcaagtggtcaatagccacatgtggctaatggctactgtgttagcacagatatcaaacatttctgtcactgtagaaagttctcttagtgttagttattttatatgtttctgactccaacattgttttttgtggtactgttgtcagttttcagaccttatttcctctttttgatttgttgtttctcatagctgataggtttaaatgccagatgtagaattttgtgtaaagtaagggtaaccaggctctaagagatcagaagagctttcttgtgttcaagtttttgtacttggaatttttatttctattctgagtgccccaaggcctcttttgcttggttattgttctgcagctgtactgtaggtgtaagggaatcagactgctgagttcctatgggagaagggctatcaaactttaaaggtaaaactgaacattcatggaaatgctttagatccagtcagcagtctcttatttggagcagcacaactccaggggtgcttaatgaccaactggctacatgtacgccaggcactgggttagtcccttgacacacaaacaagaatgaacatggacccaaatggaggaaattacagtttaaggggtagagagagtttcattaagtcaattcccagatatgtcccaggtactctgaaagtccagagaagggcggtacctgatccaggcttccctgatgttacaggagacaagaggccagggaatgctccctaaagaagtgattcttgagtggaatcttgagggatgcataggtactggtcacatgatgaaggtgggaaaaggtgtctgtataggtaggtgtctatacagggaaaagtgtctgtataggtaggcagactttggatgttgaaatgatgggttttcggcagaagtggaaatggggaagaggggttggggatgctgcctggggcagatctgactcttcagtagtttgacttgttcactctggcagctctgtgaaggtaaaaaggagccaggctggaggctggcacaccggtggtatgggagggccagggagtagagacctgtaatagttcaaaagagaggtaatgagggcctgctgtgagagtgtaagggggttgaacagagttcatgatttcaattggtattgatttctaaggagtaaaattatcagtattgggggattgattacatatgggggataaaggagacagaggaatcagagatgactgtgagttttcagaaaaacagattaatttaaactcttcttccaagttcacagtgataggttttgacctgtagctgctactagtgatttgcattggcaactgtggtgtctagattaggttttggcactttaggactccactctcttgtttgttaaaaacaaaacaaaacaaaacaaaaaaaaacttgaatggaagcatagaccataatgaagtaccaccctcgtgtgactttaatttcacagtggcctatgaaaatttatagaaatttggcttcatttctagtggctccaatccggatgccaaaattgccctattgttgcgacatcccttgagtggactatcgaacctgttattcattaggagcagctgcaaaccatcagccaagttcccatactatgccaacaataacgccagtcaaatttcaaggtaactccaggtttcagaaatgtatgaatctcaaaatctgtctagccaaactcttatttgtatttttatgtatgcatattatatgaaaaaagctggtggtttccttagtttccataattatacattgcttcttttagactataaattgagttctcagtgttggtgaaggcatacctatagatcttagccaatcactttaaagtgaaaatagaaattcagtctggatcatggtaccaggggtagccagcccaaagggcccattatgatgaggcctatattgaaagcaaaaattcttgcatacctgtagtgcattttaaaaggattttccaagtaacagttaacatttgttaagctttcagaaaaacttatttctctagtttttaatattaaggaaatatggaaatatatgttgatactttgttttttactgacatacttcatgactgcatggctaaagccacaaaacactaggcacttaccactttctttcttttagatatatttagccactgcatctggcctttgttgccaaatattttttcccttttactctaactactccatcaatttggatctttaatggtcaggcaaattttgaatgatttcttggaagatgtgaaaccctgttccctaatcaggaaaatgtgggcaagtcttatggtatgagaaaagaagggacatctcttctaacaaagacaacaggattatagcgccattacacaacatcttcaaagtttttatttgaaaaataatgatgtgtttggtgatgaacaagtaccgtaaatgggaagcatgggaagtttccactctttaagaatgtttctatgcaaaggaggaaggaaagcttactttttgtggttcttcagagagattacattaaccatttgttgaaagtttcatttatgaacaacattggcttctaagagtattcttcacacactggcatcctttgtatgatgttgttgtaggttgtttagcaacatatcaaaatagttatataaaaagattaatatgtgtttcattaatcctaaggagagctttctgaaattcatttttaaaaataaatgattagcatcattctttgaaatttgtgacttctgagggtgggaaagaattaaaaaagaagctatcttttcaagcagtttgtgatttaataccagctggtcaagtgagttgaaaaaccttatgatttttatgttatattattttgaatgccttttcactctcttgggaagttggctaaccccacagtccttttcccatggtaaatggctctaaaactttgatcttcttataccagtttgccagatgtagcagaaagagcatgtatgtgacctttcctgtgccaattcaacccagctgatgggaaactgtaagttaatcttgcatgacttttatttctaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggtgggggctttggcatctctcattcgatccgtggcctccttctccatctacaggtttgtcacaatgttcatttgaattcctttcaaaaacaagggttttccgtgaaggaaaagtccttatgaagtaaaaacaaaccattcaaatgaaaatacttattgttcatggagtttcccccccaaacacacacacccattccacatttggtcatttgtttgtaatatcttctttggcttttctggattccaagcatcacttgtgcattcctttaaaaagctttaaggcttttcacatccacagtgatcccattacattccttatataactaatatattatgtattttcattggaggaagaactgcgttcatgtctgcatttcatcaaagattcctaatgacttcagagggagccagcctgttttccatgttgctagagaagtggagtaaaaagagagtgggtgacatgatgggggccatctatggtatagtgaagagttagggaattagaggaacttggatacagacttggctctgctcccaaacaactaggtggtcttaggaatgtttcttaaacttctctaggcctcataattttcttctgttaaccaggggtaaagaataataataaatgtacaaaataattttgagattaaatgaggtcaacttgaaaaagatacttaattatctgtaaatgattatctacaaaggtccatataaatatttggtaatattgtttgagagtaacataggacttgtctttttctttgtagttttgattgaggtaatgccaaataactttattggccctcagtcctaggatgaaattcagtattacagtggataaaaagtctaaaaactgagatgtagatgttcagcctagtttaatagctattatggcagtgtcatacgttaaggataaaatatttgagaaacatggggaaaagaagcataactttagtgtgatagcctggcctaagatttttttaaaatgcaaaaataatagcagatagggtttatttgggtctccggattggatttttaatatctattggaaagggaagtttatttattctgcacaattgctatttggaactggagacacagctgcttgaccttaattagcaccctacacccctgaaaataaaaataactggggaacatatgtcagcagctaggaaatccagtcagaggaaagttgtacaaaagtgcagggaaaaggaaagagacattttccttatacagggataagatatcttcccaggggaggaggatggggcatgttaaaactacatgttagaaagttatacgactagttacattgatgtcatagtgctaaaaataatgttctttgcggggtctttagaggtttcaagactagtgaaataatgattgcaccatattcttttggatgattaagcttcccaggagggaagtcctaaaatggctagcttacttcccataatacctccatcaccccttggaataacatattcagcaagctgtggccattcaccatgatttcacggtcatgagacttaaattatggagctggtctgttgctttgtgaaactgggtgattgccagaaacctttatttaagaactactactcataagactaataaattcccaaatgatttaatgcacagtaatttgtcaggattcactggcatttttttttttttttctggcataatgaagacatctggaaacccaagctacaacttaggagtaccagtagaattgtccagcaagggacttcagaatctgttgctagcctctaagactgattataatgtttcactgattttatagccaatccatatttcactggactcttaacttgtataattctattctttcaacatttataaatacataataacattggactttacatagcactttagaatctttcccatgttactttatttgctctgacaacaattcagtggctcatgcagaagggtcattattagccctattttattgatagggaaataaaagttcagacaattagacatattaacatgtttaagttttgcatcctaagaaataaaaacgaaaataaaatgagataaactatgtttgtctacttctagcttattgtttttagaaccaaatttctttgatgagtattctatattcctacctctaattcctcacctttcatttgctcttcagactattatagcctggcttttgccaatactgaaacaggacttgttaaggtcgcaaataactgcctacgtgtcaaatttaatggacatttttcaggccatcatcttacttcacttttatgaagcacttgcctccatcaactgcattttcagtgtttcttctctttggcttccatgacttctttctcatgttttctctctctttcttgcttgctgtcactctcactctcttctctattccttccctatatctctggcttctcactgtgactgtttgacctgtgtatcctcatcatgctcctatgaatgcggttcatacttgtgaagatgtgacttgaaccacaatctacattgtggccatttccaaacccctctctcccatccataccactgccgccagctctaggcctatatattcacctgcctgtggattcttctctgggatgttccatagctatttcagtttcaatttttttcaaaattgacctcatccttcatcttctaagtcacatggtcctttattgcttttttctctttctgtgtccatcatttctaacagacactgagtctcttaggttctgctccttatcagtcatttcaacaattacacacggaacagctccatttcccagcatgactccacattccagcagtcagcaatcactaacacttttcccacgcaccacgtttcctcaaagtgttgtgactttgcatatgctttctcctctgcaaccctccatttcccttctcactgccacacacttatgagtttcttcctctggggatccctccctgatatccacttgtagcccaggtgagttacctcttttttggtatttccacatacatcgttctgtgcatgctctgtatcataatgtcttggaagtattgatagttttggttcgtgctttggtagagtagactaactgttgtaacaaacagcttcaaatctcagtcacttcacacaataggagtcttttgcatgttcacataatggtttcaagggggtggtcagaatgtggccttctgctcctttccatctgtggctctatcatttttgagatctgagttctctgcagagtcttctgcattcatctgacgcataaggggatagagagagaaagtcgataacctagagggagattttccatggttatccatatctaggcctggatatggcacacctcacttctgctgacattctattgggcagaatgctattacatggaggctaggaaatttggcctatctttatgtccagggtgaaaggaaagtgaatttggtgaaatactgcccagtctgccccaattgcctgtctccacactagactctaagttccagaaagacattgattacgtgtattttttaacctctggattcctatcatctagtataatgtttgaaacatggtaataacttaggaaatgtctacggaaggaatgaatttgtctgaggatgtagagtaaatcatggcagggctctcgtaacaaaccagctgacccggttcctggtgctctttgtccgaactatgtaacccatgtatagtaagtttgaaacaacttgaacttttagggtactttgctctgcatttggaggaaaatattcagatgcccaatatgccagattatacattttttctgccactacacttatgaacaaagatgttttgagttgctgattaaggaaaatagctcccttctctctgaaaagcatttcacctctatgggagtgggtgatactggatttcatctaaaaatattatagaggtcagcaacactagagaacattatattatatatatatatatatattatgatttgttgctgttggattcaaaatttgagaatcccctggagggtagtttgatttgaccagtttgattggacactttgtggtgtaatcatcaatatcatcagccattttgggtctgcagtggtcacacagttgcatgacagatgtcctgaaaaaatgtccattgcttgttgtcagcatcgtctccaggttcattattgttattctctgtgttgccattattagtgttcttgggctcaactttacttctaggagatattccctttattaatgcttttctaatgacacttctttccatcaccattatcaactgagacccccccattagagcttttttagtttttctgatggtaaaatacctttctttgcttttgtcctgggaaatatgttttaagaataaatgcaattaattagagatttaagtcccacagaggaaagcttctctatggaacaatttgtcttgcattatttctctaatttatcatattgtttagtacatatttcttgagagcttcctagttgctcagaaatttccgagtactaggattactaaggtgaattccatgtgttttttgtcctcaagaaatatttttatgtagccaaaagagaagggggtaagaacatgtaagtgattagtgttatttattttatatttagtgctaagtgaatgattgggggaaagggataaagaaaggaaattactatttattaagcaccaactttgtactattctaaagggttaaagagtttgtctcaattaattctttatgtaacccaatagaagtagatactgtattggtatctcttttactgaaggagagacaggttcagaatgattaatggcttatcatgctacacatctaatgaaagaactaggattcaaactcagtctctggctctaacttccatgctgttagattgtaccaagcaacctggagagctaatgctataggaatctagaggagataacagaaatctgattggggttggttgcactgacaatgtggatttggggtgtgttcaataaaaaggcagaattgaccaagagaaaggaggtggaaagactctctgtaaatatcaaagcaaggtgggactgcatgatatatttgggtaaaacacaagcagatcagtttagctggagccaggcctcctagggggtcagagaaatgcaattctggggtgagaggaagagaccaggcttgaagaattcagggtagcagattaggcagttttaagtctaatgtggaggaaatggagaaccatggaatgtgttaaagatatggggtgaattttacagcagtggttcttgaagtgtggtccctggaatagcaacatcaacctatctaggagcttattgatgtgcaaattattaggccccacctaatacccgttgtatcagaaaagctaagggtggggtccagcaatctggtttaacaagccctccaggtgattctgatacacattaaagtttaagaactactgttttagaaagatcaatttggccattgtgcatagcatgcattagacagggaaggacaggttactcctctaataatgcagatatgaagtaatgagggcatagatgatggcaattggaatggaaagaaatcagcaggaggcatagtatgagaacattagaacttggggattgattgtattcaaagggggaaggagtaggggtccaagttgataggcaaggattaaaatctatgggatgaatctgtatttagttcagcccaaaatttaaaaatcttaagtttcaaataacaataaggatttgtggttttagagaaaaaccagatttggtgatatatcttgtatgttccattgggcaaacttcagctgagcagattagccatcaaattcttcttgttgatgggatgtcccccctcttatctgccaagttttcccctctttttttatatactttattcatttatgttgcctattcgagtcctgtagatatttgagctgatgatccctgctctaaggatcccagcttggggacaggagaataagaaatgtaggggtcgggagagggagctggcttggagggaaaccagccagtttggtttctagacattttgagtccgaggcaactgtaagatagtcccattaatctggtctttatattttgcaagaaaaacagttcagcatttccatttctctgttgtccgctttttagatcacccaaggcagtttaaaattctaggctggctttcttgcaataccttgggacttctgcctcctgctttcttagcatgcgagctcaagaatgcaaagtaatttttatattagcccatgtaaaatataattcaaaaggtaactctactgaggccaaactgtttgttgtattcccactgccacacatacattttttcctagttattttctccattgccccagatagttgaacagggactgcgacttttaatcagctaaggaagcaaaagactttctcttcactttactgtgaaaattgcatcaccacactgggtatgaactcattgaggtgggaatgagttgttgatagggcttggctttggaaatactactggctgatgttttatatcacttggcctttgtgtactgtattgacagagtatagtgaagaggaggaggaagaggagcaatttagtttgaagatgactaagagctgattaaacattcagctggggagagagatgagtgaatccaggtgatgtttatggagtgtcagagagggagaatgctataccatctggtgagagagacatgaaaaagtacataaatcaatctctataatgatacttaattaatacagagttgataaatgacataattgaagcaatgggtgggctacatcatagagttaaatagcttcaaagagggtgctgattaaagccattacaatttataaaacattcttcatgttaagaaagcatcttgatgagatttcacatgaacattttgtaatcagagggccagcttaaaacactcagagcagaggtgaaatgtcttaagaggtctattttggatgatttttgaaaaccagttattctcagggaataaaaaagcttgctttccccactccctttgttttttaatgggaaaaaaattaatgttgcattcttcacctttagacaatctcagatttttgatgtcctggtggtttggttcttaagcatgaccttaagataattagctatcaagcttcatttaaattgttttgaaatatcattgcaatttggggagcatatgtgcctgctggtgaaaaataaggaaaataccactgggactcaaaaactgtacaagtgactcacctcgattagtaggcttattttgtttttgcttaactcactctgaagctcataacagatgcacagtaatcaagcagaatgccaattctcatcattcatgcaggtggggccactgtgctcccaagggggaaccagagaagacccacaacaaacactgcgttttttcttctcatcatcctttcttttccccctttctgatttttggaaggtacattctttgtttggaaagcctttgttagaaattccaaaatgttctttaatcactggattcttattattgtatcaggtagtgtgacaggcatgcttcctcataatggatagagccaggcaatgtattttggagcccgcattctggagactccatgcctgtgtctttgttcagccacttgccagatgtgcctcattggtgcctcagtttcatctgtaaaatgggggaaatatcttctttgtttttcttcctggagttttgagggttttctttttttgtttcattttgtttttgtttttctgaggcagagttttgctcttgttgcccaggctgcagtgcaaatggcatgagttcggctaactgctacctccgcctcccgggttcaagcgattctccggtctcagcctcctgagtggctgggattacaggcacccgccaccacgtccagctaattttttgtatttttggtagagatggagagtcaccatgttggccaggctggtcttgaactctcgacctcaggtgatctgcccgccttggctcccaaagtactgagattacaggtgtgagccactgagcctggccttttgtggggtttaaaagcagtaatgttattaatgcctgacctatagtaagttttaagtacatgtaaagttgctactattatacagtcttattaactattgactggacatagttattgaatgaaaaggaggaagggagggaagcaggtaatcagggagggattgagggaaggaagaaagagaagaaaggaaagaaagaagaaggaaggaaggaagaagaaagaagagcttgatttagttaatgtcactgttgtaattggtggattataattgaagctgtctggttgggagacaaaccctatgccatttagatctctgtctgttcagtttgtccaaactctgctggggttatgtatttactagtctgtctccctttttggattggcaattctgcagacagactgtgtgtcttactcatctgggtatcgccagggctgtgctctatacctggcacacagtagtgctggaataaataaagagctggaagcagcacatccctttctctaacatgtaaattcaaggtgtcaccatttcacattcatagacattgaataataatgtagatgaggtgactaaccttttgaattgctactcatcaaaaatggaatctctggaatctgagaggagactatatagttatgtaaatttcggcaaagtattgcaaactccatattactatggtgctttgtggggctgctataattaatggtctgtttgcatttctagtacaggctgtcatttttcatctgcttataaccttgatataaacatttattcttggctgctattttgcattcataattgtaaaatatatataaacgttaaccttctgtttttcagcttttttatttatcaaaagcacagctcaagaatcacatcattgtggcatgtttttctgaatctctagtggcaaaaagaaatgaatgcattttgaattcaggcttcaggattaaggcaatgttgtttgcttatgcagtgccctttgaaaaatgtgtaatgtagcatatgaaccaaaagaatcctgagaaactttttccagccggtctttttctattacttatgccttttttatccctctgtgttcctccccacctctgtcatcagttcaagatgactcttaaagtcctcttgcatccatccaaatgacccattggcctctttaggtgcctggagaaagtaccagcaaaggtatttgttggagtctatcaaaggtaacaatacatagagtgggtttcaaaatcagacaggctgggttctattgttggctctcccatttagatgctgtgtgaccttatgtacattaaacaaccagtgtgagcctgttttctcatctgtaacatgtggagaacaatgtttacctcatagagttgttgagagaattaaatgaaatcaagcccttgacacagactgaaacatgggaagtgattgatgaaatataactgacgtcttatcttggccatggtcattattatcactgtcatcattagatagtgatgggactaagctaggtaggttgacatgagctgacttatcttaaaaggcaccagctctagatagagccctcctcagtgttcaaagactcaaaagacttgggttctgtttatctcccgatttcgggagcccactctccttagtctccctcagtcattgactaaaaactatgcacttgtcttttccattctctctatcctcatgttaaatgcttgatattgttcttgcaagctgtaccaaagttgtggtggcccaaatcagtatcagtggccagcttacccaaaatgcagcaaatattctatttcaaacaatacccaagatattttccacctcagggcctttgcactcactgtcccctttgtctggaatgctgtttccctgctttgtgtatggttggctctgtttcaatctttacattttaactgaaaggttctttttgtgaaaagcctttcctgactatactaagtagagtagcactctccctcaaactctctcacacataatctcctctgtatgcacagaatcctaattatatttggtaatttatgtctatctacctacctacctatctagttttcagcatgtacttctgcataaaaatataaattgcatgaggactggaactgtgtctttcgtgtacctcattgtattctcagtacctaggagattgctggcacagggcaggtacttaagagatattgattgaataaataactattttaaaaatcatctaagacaatagagaaccaattaaacagatacatactgtattatagctatttttctgaagccacattctaaagcaccacagatttttttctcaattttttgttttgttttgttttgagacagggtcttgctctgttgcccaggctggagtacagtggcatgatcatggctcactgcatccttcaccccctgggaccacagacacaaggcacaatgcctgtctattttttaaaaaaaattttagtagagatttttgtggaaaaatataaatctatagtaaggctgaaagaatagtaaatgactcatttactcttctgagatcagacaagatctcagtgtggtatggccatagatgtgactcatatactctttataagaaattgcctaactttttatttttatttttattttttgagacggagtttcactcttgttgcctaggcaggagtaaatggcgcgatctcggctcactgcaacctccgcctcctggattcaagcgattctcctgctttagcctcctgagtagctgggattacagtcatgcaccaccacacctggctattttgtatttttagtagagatagggtttctccatgttggtcaggctggtctcgaactcctgacctcaagtgatccacccacctcagcttcccaaaatgctgggattgcaggcatgagccacggcgcccagcctcctaactttttttaaggaagttgtaccattttatattttcggcagtcatgtgtgacacttcaggctgctccacattcttgccaaaatttaattttagcctttttggcagatatgtattggtatatcactgaagttttgatttacatctccctgatttctgaatccctctttgtgaaaagtctactccaggcttttgcccatctataatttttttaaaaattactgagtggtaggagttctttatataatttagatacagatccgtagtcagatatatgttttgcaaatattttctcccagctgatgtctttcccatcttttgtgtcatagagtcttttcttaatagtgccttttgatgagtagaagttttaaattttgaagtctaatttatccacttttagttgctttcttttatatgcatctacattcattactcaatattttgccacatttgctttctctctctctctctctgtttctggatcatttgaaagtaaggttgttataacactgaaaacatttcacccataaatatataagcatgtattcataagagcaaggaccacctctaacataactgtaatatctttgtcatgcctaagaaatttagcattgctatagaaatattatttaatttaaaattcatccatattcagattttcccaattgtttcccccagtaatgttgttgatcttttctttctgaattccataatccaatcaaggacatacattacatttagttgtcataaagctttagtctccttatatctaaaattgctccctagtctttttagtattttatgacactaacattttcaaagaatataagggagttattttgcacaatgactctcagtttggagttgttcctcattattagattcacgttaaatatatttggcaagggttctatatggataatgtcatgcccctcattgcatcacataaggaaacaaataatgtcacttttccttattggtgagaccaaatttgatcacttgtctaaggcattatctctggatttctttatcgaaaggtagcattccacctttgtagaggaaatacattgcaattattgtgggatgctcttgagactttgtgaatcttaagttctttaacaaaatttcacccagtgagattttaacatccgttgatgacccctgcctgaatcaatcattgtactggaagttgcaaatgtttttctaattcaattatttctattacaattatttgctgtgtgcttttgtaataaagagcatctgcctccttttccttctttttgtttctgatgatcacttcatgggtttttaaaaaatgtatgtgataaaattcattactatcatcattctttttgataaagcatcaaaaatttcaaaataattaatgtaaaagttagcattacatgataagcttgaatatttgaagcactggaaggaatactctttttattcatccaaagttacccagactaccacagataagtcaactaattaggagtgtgtaatcaatatcatttcctctgaactttttattaacagcatgagctttggggtaataatcctgaagttatttttagtttacaattgccaatgtatagaatatgcaaataaagatccttcatcccatacataattgctgttaattgttaaaataagtgagcaaaatctcaggtccagcaattgcttctgagtttctgcagactgatatttgttttccttttttttttttttttttaaactatgcagctctgatgttgaggagtatgaaaagagcttttttttttttttttttttgcaagagaaataaggatctcaatataggtttgcagaggccagcagggatgtatctttaggatgggtttacctcatatctgtgtaatacagagaactataaattatccacccactccaacctccccatgtcatcagtggttgtgaaggggtaactagcctctgcctgggtgtcaacagtaatagtttaatagctcagtgaatgtctgttgcctcactggttactgctccgtagagtaaatatttgacatcaaggacaagaatttaatttttaactttctcaacttaattttattcagtaaacatttattatgtgtcttctatatttcaagccaggagaagacccaatttttgtaggggtaggaacttacataatttgggggcctctttaagaaaaacaatacaaagttacttctacacatttagatataaaatcaacatttatttacaatagggaagaaattataacaatttatgaatttaagagagccaccaaatactacaaacgtgacacaattcagaaaaatatcttgttttgattaaataactacctatcaagctgctgtactttgtctgcattttttatttgcacattctttgattgctctttgtatgacagtgcttttgtgttgtagtttctaaaacaagaataaaaaaggaattcagtctttcctgtagtatggttgatcataatttagcttttattattgatagtttggaaaagtttatttcagctttatagcttttttattggtagtatcattatacaattttaggattgttgtcaaatttgggaaaatgttatcaagttttgttcatgtatgggctgtaagatttcaggacattttatgtttttgtatagtgacaatgaatgaacatcattccatttagtttgctgtctagatcctcgtttttagtggcattttatgaatttttgttatgtttgtatttgtcagcattttgtgtcaaaccaacaagaaatttcaatcttttctcaaggtgatgtactttttcattatttggcttattgagtgatctgtgagactactcatcccaaatacccaaagtatgtctctttctgtcaataaactgtagttttgtatggcttttgtctgggaatgccatactttgtcagaataagatgtggtgtatattttaacatgtaatccaatatgttaacacaaataaaactgtgacttcatacatagatgcatttgctctttgagctctacaatcacaggaattctgataaattctattttgcatgacttccttaaaaatataaaattagaggttgtgttcgcaatagcatactctgaattactgaacctattcttgataggagagaacttccattttaagtaggaattaatgaggattggatacctcgactgcagttctgcatatctgataactggaagcattttccagtgactggcttctggatctccaccactgtctccatgctttcactgccagatgttgcaggatgcattcttgttacaatatgacctctgaccctgtgtctttgtattatgacactagtagtcccgggacacattcctgtaccaagatggaaacaactgtgaatcacctaagcacatccctgtaaacccaagccaatatatctccaggtcagcttctcctagctggatcctcaatgcctatagtcaatccagtgctgctccatatgttgggaagtatgacagaaaggaagtcagagtggattaaaagattccacacctttggtgtgcatggattggtgcagcccttctagtgagacatccccagatgttagctgataacatcctcaccctcatcctccccaccatcacttctctatgttttactggcctgatccagtttttggtggcttggcacttggaattctttacaagcactttctttctatattgacttactatcatttttagaacccagattttttaaatgttcaagctggatgaacccttatacatttgctctactctttcattttataaatgaggagcttggggctgaaggtcattcagctaagtagaagaacaaggacacattattttttagctctttatgccatctttcttttctttcaagtctccatcagactacacccagccttccaggattaaagtaagttaattaggcatgcattgatttgatctccgtaggtcccccctaaattgatatttttaggagttagaatattcaatgtgctccccaaatgctacgtaatagtggttttttgctcattttgatagggcttttagcagagtgaactgtttcgtggacactgtcacaggaagtggaaactcaccttgtgaaaaggtaagctttccatgggctttgagttttcctttcctcagcaggggaagggcctatatgtgttagtgttagctgcctggccttcctctggggcttggtttttaatctccagggaggcaaggctgacaaaatgtcatctatttgcctactaaggaaagaagctgtgaaatagatctccattgcttatgcacctcaagtcgcttagttccagctgtatccataatatcatggtgtatttaaaatactgctcattgcaatccttttgaaaagagattctgatgctcgtaaatactccaaaaaggcattaaggtgttacactgatttttatttttattttattttattttattttatttatttatttatttatttatttatttatttatttattgagatgcagttttgctcttgttgcccaggctagagtgcagcagtgagatcttggctcaccacaacctctgtctccagggttcaagcgattctcctgcctcaacctccctagtagctgggattacaggcatgtgccaccacacctggctaattttatatttttagtagagacagggttgctccaagttggtcaggctggtctggaactcctgacctcaggtcatccactcagcctcccaaagtgctgggattacaggcatgagccactgcacctggccgctttttatctttaattggatttattccctttagaaaacttaagtttgtggattcatatccaaatattgccctttactgatctagctttttctgctgtaagttctaggaaccttttaattcagagaggggtaaagaaaagagctagcatacactcaatagcttttatgttttggatgcttcataaatatcacctcatttggacccttacaagagctttgggaggcagggagctttagacacattttacacctgagtaacttgatcaggacattttgaaaaaaaggtttttgattatctgtttttcaacttgagagagtcgtgagataactaaactacaaatgaaaaatacgtaggtaagtctctttgtaaggtcatattcgtaaaggttgcaaaagagaccaaacaatgtattccaattgagaagtccaggtagagtatttggttcatttgtgctgctataacagaataccatagactgggtaatttataaagaatagatctttatttctcacagttctggatcctgggaggtcaaaaaacaaggcactggcagcttctgttgtctggcaagggctgttctctgcttccaagatggcaccttatttcttcatcctccagaggggaggaacgctgtgtcctcacatgtggaagaacagagggacaagtgaaccaaatctttgtgtgaaacctcttttataaaagccttaatcccatttatgaggggaggagccctcttaaaggccccaccacttaatatcatcacattggccattataagtgtcaacacctgtattttggaggggacactttcaaaccatagaataaagaaaacgaaagggggaaaactgcaaacaaatgtgctatgagattagatggatttgaaggggactcgacagtcttgggccctttgttttggaagatggattttgaaagttatcttttattgtattcctgtgaggcccatttgtttcctacccttttctcttgtccccctcttccttctctttattcagtatcttcctctggcaaatagcagttactaaatttggttctctgttatcttccaactcgaaaggcaaaaggcacaggcagtaccctcctggtaattatttatgatatttctccttccagagatttgccctatggcagcttcaatccgttaccatcactttttatttttttgcccatattggcagcttcccaagactttgggaggaaaaagcagatctgcagatacgcaaacctcaaaatcaagacttggttaatgaaatcactcctccacttgcccttgcctgttactgaatcctgttccagctgggatggaaaaagtgcattggtcatgctgtcaaaagcatatcacatttctccactgctatttccttccttcttaactaaaaacaaaacaaaacaccatagacaacaaatagacacacacacaaaaaaaaagacactaggtgagagtgaaggtagtttgtactattttcatttttcgtgtgttcaatcgtatttctctcagcaaatatgattggaagtggtgcttttccttccttccccaccttccagcattaggtttgtaggtgaacataaaaatacactgacactcaaagaaagagctctttctgctctgcacacatcccatctcgccctcttccttgctcctgcttatttctctctctttctgcctccttacctccttcagtttagagcttagagaagtttttcactcttcttttgacaggtgtcagatagacagtatgagctcatttaagctgaactgtctgggggaaactaaatttgttcaggagaatagcaatttggatgacaagtgccaggacataccagatggcacggctggagaaattcttatcgggctcccagctcacgttccaggcggcctctctgtctctctcctctattcttatttgttcatggttgacccagatggaaacttgaaatgcaaatgtatttcttcttggaagtttccaagtaaaaaaggtgatagtgactcagcataagatgcttacatgcccccaaaagaatagccagtacttgttatttatgcttattactactgatgcttcccagacccctgtgggcacatatttgaagaagtcttaattgtgagccctaaactgattgtgtaattccagttgtttactaaaataggactgttacctaagctgcaaaatatttgatgttcttgtcaggatgtgaatggaagtgttcttaaacattcttcctcagttgccacacagtttgactgattttgttggccctcactttccagaaagggaaccgtggacataaatgtcatgggaaggtatttagtagaaggtgtgatttttgggggcgcatatgaaacattctaaaattcaaggccagggcgctgtgacaggctctaatctatgaatcattatattcttaacatattctgagaacaggaagagaaagctcaacctttatagacacagatggaatttctcctgtgaagactggtaattcatgtgacatttgctgtttgcttttgtttgcagtcaaattctttctctcaaccttgcactgtgctgttactggtcacttaacagaccttctgaaagagcaatataagtttatattttaggtacacaaacaaagcagatgtttataatactgggcatgattttttttttttttggtcaatatttggttcacatgagaagatcaactttttctagcctgtatactttggctctgaatttacgtgttttgaaaggtttgttgttgttgataatttagtgatgaaacttactcgtggaaaaggcttattgtgagtgaataaataaatagtataggctaaagtgtgtgtagcctacattatttggtagtgtagtgtacactccacatacttttatcattttaattttctactaaattatgcatgtcctggtattaggattcccatagtcatggcaaaaccaatgatggtaacgccatacttatctggaggttaaagtttcattaacaatttaaggtggaaatcagagaagaaggcctctgagccagcctaatagctattctaaccccacacagcaaggtagtatattgtattgctgctcttctcaccaagagcttctgggcctttagcacattatttttaacatgtttaaatttctgggttttgtggacacatcacattagcagatgtgggaatgatagaggttattttgacatacagagaggagacaagaaaacggaagtgtaaccacaaagctgggttgccacatcctatggaggtgtaaattcataaggataacattgagtcacccagaaaagttgtattgtgtcttccttttaagaaacaatgtgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagcagggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaaaaaaatgtggtggaactaaaagcccagtaaaagtgtaacatgaaaggaaaggctatgttatattcatccaatagggtgtgtgtttgtgtatgtgaatatgaagaaatttatcataaagaattggttcatatgattacagaggctgacaagtcccaaaatcttcagggtgagtcagcaagctggagacccaagtgagctaatgctttagttacagtctgagtttgaagcctgagacaggagaactgattgtgtaattccaatcctaaagctagcagactggagaccaaggaagagttgacgttttacttcaaatgcaaaggcaggaaacattcttcctcaattgccacacagtctgactgattttgctggctctcactttccagaaagggaaccatggccataaatgtcatgggaaggtatttagtggaaaatgcaatttttggggtccatataaaacattctgaaattcaaggcttgatatcccagtttgagggcagcagggcaggaggaattctctcttccttggggagggtcagcctttttgttctatttgggctttcagctgcttgaatagggtccactcacattgggaaaggcaatgtgctttgctcagtttacaagtttaaatgataatctcttccaaaaatgccctcacagaaacatccagaataaagtttgaccaaatatatgagcaccctgtggcccagtcaagttgatacataacaatcacagccatccttccagttagtcacagaaagataccttcctgcatctagacaacaggcagctgctgaggagggctgggaacagcagttcatgatctggtatcagatcatgaacccaggggtccagcacaaagacgtagatccagccctgataggagaatgcctggtttttagaaatagggggattagcttccaaactatagaaagaattcattcatccattcattcattcattttaaaattcaggtcttaattcaaatatcacttccccagggaggcctttctgatacattgtctacagaagtcctttcagccgctctcatttattcattcacgaaaatgtatcaggcctaccctgtgaaaggcactgggaatccaatagtgactgtgaataacaagcaaggtcccttccctcacgcatcttacttactagtggggacagacagaaactaagtaagcaaataaagaaggtaatttcagatagtgataaatgccataaaagataaaatagggtaatgcattagagtgttgatttgaggacagggggaagttacactagatacacccgttagggaagacttctccagaagagcagtcagcttggattgaaggatgaaaagtaaaagctccattcagagctcttggggaagagcctcttaggcaaaaaacagctggtgcaacagatcaacggacagaaccatttggccagttctgggactgaaagaaagccagtgtgactggaatacactgagcaagggagagaaaggtcagagaggtgagcagagaggttggcagggcaagatcttcatggaaggtcatataggccctgattcagagcttgcattttatcctgattggaaataagttttaagcagaggagtgatatgatctaatctgtgctttgggaagatcactgcccagcgggacacagattgtgtggagcaggaatgttgtaagaagtacagacatgtaggaggctattccaatagtccaggtgagaaattacgatagctgggctagggtggtagctgtggagacagtgggcagtgggcaagcttggctgttctgtgaaaaagtcttcaggaattgctgatggtttggatataaggggtgagaaaaataaaggactcaagagtgactgctaggttttattttcttaatggcacatatttttatttgaaattatcttgtttatttgtgtacttctttactgttgatctccctcatcaggctgtaggtacagtgagagaaggaatcttgcttatcgtgttcactgcctcagcctcagtatccagaagagcacctgttccttgaatgtatgtgtatataaatattgattgagtacttagtatggaccaggcctgtactaaggctgagatacagaggagaacaagacagagatgacccatacgatcatggaggctgcattctggcagaggagatagacaataaacacatgaactgagttgtttcaggttttcataaatgctgtgttgacaaaaggatgaagagagtggttaaggaaaaacctcttctctagtggttctgttattctacatgtattcactagactctaacatctgtgaaagcaaggactaggtcttatattcttcgtgtagtgctaagaagatagtatgtgcccaggaaataaaagtgggcttgtcaagcctggaagccatgctcagttcctggagcatcctcagtacctgttttgttatctatgtgatgtgacctgctagggaaattgtccgagtctctcctttcttgtgtaggttgacaatgcctagacccatcagtctctgcctggacaggcctgtaatttaactgcctgcctggctctgattgctaataggcatgggtagccacctatggatttgcacagccacacacggccttgctgcaaatttagcagcagatagtgcctcaaggtcactagagaagaaatgaatctgtaaggtgaataaactaaggccaataagcatagagtgccagaaagtagtgcccagagggatccgaggggcatctgcatgtttattaataaacaaacacacaaaaacccccgcctcctcctctacttaaggaacacagtgagatctcctcttatgaagtcatttctcccatgacttctgctttgaacagaagattttcaaaagagctttgtttgcccttaagcagtcttatcctcagataaggataaacgatcagaggaaaatttcactgggttgttggtcagctatcaaaatgaaaaatgaaaaatctttcttaactggagtaagtgtggaatgcttgaatagtgcagcagcttttagtcattcttttacaactgctgtacacattgcagccagaaaagacattttagttgtcaggtagtcaataaatatttattacctgcttcctgtatactggttctccactgggaactgttcctaaaggtttgttttcttgttacttttcttgtccctgtgttcctcataactcaaaactgctgacccatttaggaggtatgggaaagcaagattgatcagaaagcagactgggaagagacaagtcatgataattcttatgctgtcaaaaactgagtttagcatcatgctaagcaggcagtattcaattcataattcaaaactgagtgtcgcagtgaatggggccctgcaaagtcaatgtctgattgttttcttgctgataagcaccatgatcagaggtctcttcactttggcttaaatcataaacatgtttggagcacctaccatgtatggccactctcctaagagtgaggtaggatattgaggtactcccagtgtagtgtctggcttctggggactcagtgttaaatgagtgtggagaagatgtgtatatgaagactgtgtcttaagggagaatgtactaagggaaatatgaagtctggtaggtacacaggagaaggagatattaatacttcctggggggaatccaggccttactagagatccttctgcacactgtcccccagctcctcactttgagtgtttcttttggattattcattttctctatcttgtggcaggcctcatcaagactggtatgtgcatctgtgtttgcttttatcagataatcttctacctactttgagtttaccttctatttctaattccttgcttaacttctgggttccttgcacagcagcgtctgatatcctgcatgttagttctttgttttccctacccaactgaaaattactaatgcaaaattatattagcaaaatgggcataaccagaatcaccactgctggggtagttaatgagcagaggtctcccatttgcttcctgcccaccagtctctctcctgccctttcaaggcagacgggttgctggctcactaatttcccacatattgcaatcttttcctgtgatgcagaaagctatgtgtatttccccactcctgaggtgactgaactgtttaagtagttttgataattcgttgctttaaaaaatacacaaagatttgaataatatagataaatgttttccttgactacccacaccaccctattgaggtcagtattcttagatataacgaacaatgtgagtttgatctatattcttccagactttgttcccatgcactgacatatgtatatgtgtgtgtgtatgtgtgtttgtgtagttttgtgcttttttctaacaactcagctgccaaatgatcagtgcatatagcactacttcattgtttttattctcttgagtgtcattcatgtatttctaactctttgtatgcctaatatttttttgtttgaatgccaggcattgttttaaaaagctattgatgctccataggtttacctttcctctactaggcagatcaggttgaaagactgattgccttaatccaacaactgactaagttgcatcagaacaggttgcaattttgttaaattactttttgttctccctatttcagaagcatggccctccagggcttttgattgtaattctttgtctcctcagcactaagagactgcagaatatcttgtctgcttttgagagatttgggcttagctctttagtcttctgtactgtgcagcttctgaacatgacaaataacttgacagggagaccaactctgtgttcaagtctcctcaaatcttcaatttaaccactgaagccgtacatggtttccagaggatctgctggtttctttgtcccagcagcttccctctgcctgaacctaccctagattccattctctagaatgagccagcttagggtggcaagtgtccctgaagttggctgcatgtcctcagatcacctctgaaatctttcctttctataattttactgttgttagaacttttggcttcattaactttctaatgtccttaaatatgtgatttttataatttatttaacttttctagttgtttttagtgggcatgttggcctgccatgaacaacttcattatacttagaagtagaacttctccctcattgcttttaactccttcagattctttcattgcatgatgtctgtggcttatttggccatttccctgttgatagacatgctgatttttatttgtcactgttacagtcttataatttaaaatgaagtacatacattttgtgtacttatttatagcaattactaatatctggaatttctggatttaaaatatggatttttaattttaatagagattaccaaattgttctccaaaaagacttaaatttaaatctcaggggctgaggcttccctttaaataaaccaggtctatctctgatcttataggttggccctagtaccaaacagttctactagtaacattgagagttctatgaactcttttagagactctgagcacactgaaagcttacctgctgtgttgtccttgccactcttacctcagtgctctcctgtgggtacatttagtacctttacaacgtgtgcagtgatcatgccatggattacaagagtttaacacattttctaagacaccaagtgagtaatgtagatactgaggagatattcagtagaaaaagccaaatcactaataatagcatattttcaatatacaggcaatttctcagttgaaaagcttagctattattgctatggccatggcttcaaagctgtgaggttcgctttttatttatattggcaattttcccatgtgcttataaaaatcagtcctttggatggttcactcagtgtatttgaataccttttccaattctctgaagctccttgatccagtaacagtttctttccttggcagaccatgaggagtgggaaagtagctttttctaagtaggcattgattggcattgagcagtgggaaagattggagctggtgaacatggggtgtgcaaatgtattcagccaacaggagctcttccagttcatagggtggatctgctggaatagttgccttggttctcctttcacttcagggtggaattaagctcctggctcaatagggaggaagcaggataagtcttagcctctggacacttaacctaaaattctaaagaaaaattccttattccttttttccttttcaatggcttacctttaaacagcattaatatcctgcctgttgtactgaagcaagaaactgtagtatctattttcaaaactagtacatggattttcaatgtgagtgtcttggtaataaatgctggtttattttgaatttaaaaatgtattttgattttgtactgacagtttaactctttgaaatataacggaggaagggtcagaaataaagcaatctttctttcttctggacttatttattcactcttctttaaacagttgttaaatctctcttatgcatttgacattgggctttgcactagtgatagaaaaatgaataagactgtgacatcttttggtactacatcatataaattgtctagattgtacttctaagccagcatgagcattttagaatataagaaatagaaaccaaaccaagaaactctagttcggagcaaaattatatgcccagttgtctaagaaagggctttgctttttaccagtaatttagaattttatgactaagacaaagcagaaaattgggaagaacagtgaaaagggcaagaagttaatggagtgcggtcagagctgagaggacaaaatctaaatgaaagggggaaaagcaataaggattgaggaaggttgtttaggtcattaagcttacaagatcttctatttcccaattagtacattctgaccctgaagacgtttaagtacatgacgaggatgtcactggagtgtgacaaattcttcacattctcacttccctttgctaattctggcgtcagaagttattgcagagaacatagtcaaccgtctgtggagatacatctaaaacagatgtgcctattgttaaacaaacatggtatgtttaaatccatatttatttattaaacaaaaattagataattactccgattatctggtacccacagggatcatacaaatgacaaacacaaagggccagcactctgagaatgagaagcctagagagaggccaggctgggatagtgccaaccctgacataagatagaatataattaggactttaaaggaaatacaaacaaatattgtgggcactcaggaagaaaagcacttttggtggttgtggatacaggtagagggagaaagcacaaacaactcagagaaactttcttgaaggagatagtatgctaactggccatggaaaattgtttgaatatcaacaagtgatgggatctcaacagggataaaggatacaggtgtcataggtaaggtagtggcataagcaaagccatgaaggaggacagcttgtttgatgactagcagtgtgtgttataggagatggggtggaggatgcagagaaacaatgtattttgagaccacacaactatgcctttaaatcccagcccttccgcttatgcatacgggaccatgcctaggttgcttaacctttctaaatctcagattactcatctttaatatggggacaataatattgatttttgcatttgtgtgtgtgtgtgtgtgtgtgtgtgtgtgtgtgtgtctgggagagagagaaaggagagagagaggagagaaagactggttataatctatgtaaaccttctggtgctcaataaatggtagtaattattatggcaagtagttaggctatctcaattttggacaatgtgttagataaaataaaaaaaataatttgtgatcaaattttgggtgatcttaaggagctagtttaggaatatggagttactttgataggcattggaaagccattgaagacttttgaccagggaatgatgtgattagggcttagaattgcagtgctgattctagatatattgtagagctacgacataaaggattagacaattagatatgaaccatggtgtcagacacctacatatctgttctttactctcttgcagttataaaaaccctgatttttagctggaaacatgactgtctaaaatgaagaccctatttacctgttttgcttgtggctaagtgtgcctatgtgacgatgttctggccagaagtatcatgcagtagcatacctaaaagatggctggcccaccttcttctttatcacttcctccatcctgcttcttagattacctgccatcttggtctaggtccagctgctaatttggaccctagcaatattggagggatgaactggcaggagactgagtcccaaagaacttcatggaacagaattctgccataccatcccttgactaaatttcactagccttctacatgagaaaagaatgaactaccttgttgaagcctctgagattttgagattctgttacatgcagttgatcttacaatctgattctaaccaattcagatatggaggaaataaatgaataagaacttagtttctaggatttcaagccagtagccattataggaatataaggaaacatgtttggagcagggggaggatgatggttttggtttgggattcaatccaggtggagatgtcaggtaattggaaacaaatgtcaggagcttggaagagaggccagagttggaggtttagacttggggtgggaagcaggactttaaatagctctgatagttgaatgtatgataggggaagacattttcaagggataaaagtataaaaagagtgcaaaaacctgaaggctgaccctggactaagtgtctgcttatacaggtgaggaggcaatagagatagtgaaattgggcaggaagaggtgtggtgaaggtgagggtaaagggaagaagagttgaggctgaattaatgagcttatttcttttgcatatggcatgtaggagaggaaaaggattcctaggtttctcatagtcaagaatgtactgattatatgcatttgcttcattaatgaatacagtgctattttgtttagtgtttcaggaaatgctttgattccagcattgttttccgcttttaatgcttggaaacagctttgctaggctcttctcaggtgagtagctgcacgccaaagtgtctcagtgacagcattgctaaggagttttatggagaatggatggtcttgactggaaagtcacttaatggcttttaaagttgtgagcagatgatcatactgtataagtgacagactgtgaagtctgagacctcatgaatggttttgatgttggcatcagataaaattactaacaaattagatctgacatattttaatggtatgtataattattattggtctttgtgattataggctacatagtaactgctatcactggtaatagccagtattacttttgtctggacacacaccagacatttacggaaatagctggaagaagaatgatattgagaattgagggagagggtggtttgtgccaaaaggaaggtttggaagaggtggacactattcctctctcacttcctaactggcttattctggagttggaggcctgcagtgcctcaccctgtcaagctgacctaggcacctagtatgtttagctgttccagtccccactctccagatttggccacattctcccagttggaaatgatggaagatattgccatctggagttctctgatttcctgtaagttcttggagactttatgcatggccccacccaaagcttttccttcaccccaacaggagagaaggaggctgcagaccacagaaacttcagagatgatgatttatgtggactcatcagaagtctaaaggggcatgtctgtgttcttaaagggtacgggaacctcagagagccaattggcccaagaagcagtatgtagaatggctacatattctatattttcaaagatcaaacagtgcagagtgcaagattataggaaacccaaaagggtcacaaaccaggataagaaaatatcccattcactgccatattttccaaacctaaaagagtgcctcaatcaatgtttgttgagttttaaataaatatctttatttcagtaatatttaaaaatgtatcctaaatctacttgttgtctgtattttcaaacatagggaaataagcaccaatagctaattggaggaataggatgggggatggggcacagcatgaggagaggagtgagagtatgtctctcccagaaaacatttattgtaggtattgattcaaattccagttcctttcattcctagctgtgtgatactggacaagttacttaaatttgagccagagtgtctccactgttaaactaagtaacaatatctactttataagattattgtgtaaagtaggtaaaatttatgagaacatgcttaataaattctaagtgacaaaatgttaggtgttattactgacatttataacaataataataataataaaataataaagattggaacatggccagggagtggtgaggggtcatagcattggtgtgaaagttggatttgaatgtcagtttctctggctcatatggtaactctgcctatccaggatttaacttagaatcaacagctccccaaacaacagcagagctctatccagtttgaacacttgaactagttcttttactcagtgagaacctgtgagtctgtctggagtagagaggcgggtgttgagattaaaccaccacagtgggctgtctctgtcttagggaagaataacagagaaggagtttctgcacaccagtctgacttagagctgagcagcacatagacgtgtacccaggtatctcatgccttatgcccagcgggacccttcctggtgtgtatggtcgatatgctaccctgtggagggtggctatttattgaattcctattccactcaacttcagtttatctgactttggaggggttgcaacacggccttgcctcttatgctgagctttctttggaattgctatgtgactgtttctttgacagacttagttagaaattcagatgatactgatttaaaatagacccgtggggtttgagaacagttagagagagcacagatgagaaggagaggttaaattttttctaaactcaagttgtcagtactaaattcattatcccccattaacaggcataataatgaaaataataatgtataactttttcactccattcactcatttattcatgaaatatttattaagtgcctatgtactagagtgtatactaaatgctagacatatatagataaatagataaaccatgcctgtcttagggagtaaggtggaaagcctgagggtggcatgtaggttagtctggcatataatctcaacaagcttttggaaagatgaaatggttgtacttagaggcagaaattgcattggttttggtcacagatgtagcctacctccattgcctgccacagaacctggctcagctaagtacccaatagatgttttttgaattggcttaatatttctaattgcatgattaagtggccagaatcagttaatttaacccatgagtccttttcactccttttacagagctagaaactttttgtggccagtcaacctggtaaccaaacatttaaattctggtaattggtaaatatgcctcgtcacaggtttgttgaatgatttatttttcataaaagcaggaggttcatgacaagctcagcaaatctgttggcagttttaagacattataccgggtagtttagggaaatttctcagcacatgagaccctttagattatgtaatattcttgcaaggcaactaggaaaaatagtttttaaaattatgtctattttgctatatttaaaagcagaaattatcttattacggagaattgattaaatatttgatagcatttttgtatgatttaacatatttataggtgttaatttctcacaaaatttaagttatagctctaagtgtagaattaatagtttccctttgattacagtttttttggtgttaacgttcatctatttttggatgatttgacttacccttcctttttaaaattcagactctaaatttaaggctatacatcaccatagtgtttatgaagtgaattaaatcttacagaatgttccagtgcaatctgaaactacagcaactacttgaggttttatgtctgaaaagtgttttaatcagtgatggatttggaattattgcagctgattcctgaattcttaggcctaggccttaggaacacactatccagatgtttataaaatgccattttaccaatgtcctgtttatactttgactttgtggttcaaaaaaaatacatttgcctacttcaaagtaccagatgaaagtattttacatcaactaaatactgcatttgagctgcccaacagtccctaacactgactccttctgccttaaaggcatttatttcctatcatcacctgttttctccaagacatgtgagaagaataaagcctgtattgtggcattttgtgtgaatgctaagatcttggcaatgtttcttataccttccctagctcttctattttccctaaaaagtattctctttttgaaagaaaaatttaatttctcaatttcttaaaccagattattaattaaaactgcaaaatgaaggaaggaacacccactaattcttcaaagctcagcaacagaatcaaatcctttgaagatctgtctgcttaactcatcactattaatcagtttaagactatttagaaaaggtactgagagaaagaaatgaataaaaatgggtgaataaggcaatattaagctgacactttatagtccggttggtagagtaaaaaagcaatcaaacttaacagctttttaaaaaattaagaatgttatataggttgatgttatttttattattataaatataatatttactccttttgccaacttggaaaatgtagaaaagtcaagaaaaacataacattcatccatgatcccaccacccagacaaaaccacttttacctttcccctattttttaagtcattttttgctatgtaattaatcaatttgcataaatacaaaattgaggtaacggtatatgcacaattttgaaacatgttttaatcactttcttgtggcattaaatattcttcaaaatatgtttttagtggctgcagagttatgttatgactttctcatcctttagttggtctttagtgtgtttttatggtgtccagtttcagtattcatgttgatctcctttcaccctttgtcttcactgagtcactcttggctcactatggtaatcattagcactggtttctagatatttctggctcttcacctgcacataaaacagggctgtacatctcagtcccttggagtttgggtgaggacatgtgactttttctaaccaatgagatgtgagtagagcatttaattactgatgagagagacctttcagagtgctgtcctctttgccacagtgactggcagctttccagagagtggctgctccattagcgtggatcccagagtgaggttgaggccaacataaacacctaattggcctgggatggataggtaatgtgagaagaaaatgaaactttgttttagtgagtgaaatcttaggggctgtttgttatcagtgaataagtttgcctgtcttaactgataacaccaatcatttgtatctagattgggaatctgatttagaccttgtggtcatcttatagactcatgttcaccttcacatctgtaaattatgtggcaggtcatcatatacactttctcaaacaattggggaatctttgcccctatgcatctgttttcagggtgtttctttagttgacttcaggcgtattcaataactcatatcatatacatacataaacactcataccttcattctcacaatgtttatgattagccttgttcatacttttctgttgcctaggaaaatgtcaatagaaattttaaagtaaagactgattttttttaaagtataaacttagtagttatatgaaaatgagaaaattcataaggaaaaaatcctgtcatttcccctgccattcaaacctatttttattatcccatatttcctctattccctgtgtataaaactttatattgcttatcatagtttacatacaacttgacattttctatatatataaaaattttcatgtttttcctacacttcataattaacattttaatggctgcaaaatattccactgaaattgaacaccgtaatttatactacaatttccttattactggttttttagtttgctgcaatttttttgaaattctgttggaataaataatttttagagcattttaaaacaaatatactagaatgtatacatctaatcagtattatcatataaataacttctaagtctaaacacatattctaatgcaggtgccattgatataaacatttctaatctcttttaaaatggtctttatggccaattgatgagctacaaattaaaaattagtctcattattttataatatatcttgatttggaccccaaatcattcattcattttgttaatcatattttggctgttttcaaaagttaattctaattttaaagcaccaaattttgccttcatttagaccatttggaaggctgccaaatgctctaaaggcaatttcagaggaaaagttccaaaactgttaacagcactgggcaattgctgcgataactgagcagcctaccatagtgatggttttagagaaaaaaacactcctttttaaatgtgagtttgagtggatttgttactgtaatcattaaatccacaactctatagtcacactgggcatggatgtaatattgttcaaaataaatgccagttgcttgatagcagggactgattctttcatgacatctacattagtgccttgcacatggtaactacttaggtatatttgtgatcgagtctgtgaaagtgatccctgttgagatcacactttttccattggcaaggacctatctttgaataaatcctttctgctggtgaagtcttgaagtctccagcactctagacttacagcattagcattatgtgggaatttgttagaaatgaaagttctctggcctcaccctggacctactaaatcagaaattctagagattgggccagcaatctgttttagcaagacttccatgttattctgacacataataactaaatggtaaagttagcctgaagaaaaactgaaaataaaggtcaaagaggtgattctataatgaaagaaagttggtgttagaagccacagactagcaaaattcaataaacatcttcagagcacctactgtggtccagaaattgagcttgtagatactaggtatgcaaaagcaaaatagatagtgtctatacagaagacataaatgtgcgtaaatgggtataaaataaatacaatgctgagtgatacttcgatatagaagaatatacaaaatatgggtggtgatgatcataactaccatttataaaccacatgttgtctgtcaggcacagtacagtgctttatatatatatttttttggtatgattatcagaaggaatataaagattaaaaggtgctgcattacttaaataggttcccttaaacctggaaagaataaaatcctggtcacaaagttcatttcttgcccagagcacttgacccattcagggatcctgtgtttgtcatttctcttcagaaatgattatattggcacctatctcagaattgatatacagattaaatacggtcatggatgaaattatttagcccactatgtatcatcaatattcattagatagtaatcatttttattgctactaatagtaatcatcatcatcattagaggggtgagcggcaatataagatagattctatagaggttaaaagcatgactccagccagattcagattgccagggttcagttctgtctttgtcagcttctagctgtgagactatgggcttagcctctctgtttcaattttgtcatctgtacaatggggacagtaagagtccttcacagggttgtaataactggtaaatgaattaatgtgtgaaaagcacacagcacactggcaggcacagggcaaatgctcagtaagtgctagcttggagtgttctgtcaaaaagcctaacatctctttgtggtattttgtgatttttgacagaatggtgtatgctttaggcatctatggaacaaaaatatcacccttccttaaatctgtggcgttgagggatcactacatatttgaataaaggcctttctctgatgtctaacaggaagaagaaaaccactgataccaaactaaggtttaaaaaaggccaaggggaagaaaattttaaatcaaaagtcatccattcttatttcatggaaatacgttatttaagcaaatatactgataatgatgcacagatgctgtttgtatacattactttcctcctttgaattcactaagtactgatttcttattggtgccagcgatcttcagaattagttctgtccccttctgtatcattgtgtgagacaaatatctcatatacaacttttctaaagattagaagactaaaatatgtgtctattgcctcaaaggcagagaagaggtacacaaatgtgaataaacagttaaaacattaacagatgtattggaagagtccttgaatacacatgtgattgatatcaagaaaacattagctttgtaattctgcctagatcgaacactgatgggctggcactacagaaagattcagctgcaagtatttcatgtaactgatggtgtaacgcaaaaacatttcagtagatatctttctaataatttgccacaggtgctcaaatgcctgggagctagaatttcaaggattcaaattgctactgtgatagcttcaggctttgcttccaggtttttttttttttttttttttttttaagcaggctgtggcacatgtttttaagaatttaagtctgtttattggtgatgctgcagtttgcttgattacagtttaagagggtgactgtagtttctcaaagaacccaatgaatatgaactcagtttacatcattgaaaactcatgttcaatctctatcctgtgtgtactgtgttcagttattttctttgaacttaacattatttcatctacatttctatgtactgctttcgacccatttacgtgtcatagatgtcttctcttttgccacttcctctcctgaagtttctgtcctgggtttcttctagagttcaacgtatatatagagatgcagagaacatcttagtacaaattattttttctttttttacgatattggcgatgagtttgttctccaaagcaaaataaccaaaacaaaatcagaatttttataggtttgctgcattttgggagatcacactctagaaagatcaaactaatttaagtgccaccagcattggttatacagattgatcatcccttatccaaaatacttgggatcagaaatgttttggattttgaattttttcagattttggaatacttacatgtacataatgagatatcacagggatgggacccaagtcttaaacatacagttcacttgtgtttgagatacaccttatatacataacctaaaggtaattttatgaaatatttctgataattctgtgcatgaaacaaaattttaactgcatttttgactgccactggccacagaagtcatgtggaattttccatttgtggcatcgtgttggtgctcaaaaagtttcagagcatttgggattttggatttttggattagggatgcttaaactgtatgtgtaattttcccatagcttatacggtaccagatttttattataatttaggtgtgtaataacttcttacagtaattttaatttagatttacttagttggtaggaagttatatatctgtgagagaaaattcttaatatttataatttgaaaatatataatgcactgatttatcattttggtcatggcaaacattgggatatatttgtctgcaaataaaagaaaactcgactaatggtggttgtattagtcaggactatccagagaaacaaaaccaataggatgtgcaagtaagcagaaattttaacatacggtagaattaaattggaaaggaaacaaggaaactcatatattttgtgatgtttactatgggttacagaatgtacagtaaacacaaaagctaatatttattcaatactttctagctcacaaaacattaagtgtaaaattttagctattttaacttttcttttatctttatttcacaggcacttacctcctgtatctttgaatcttctttatatttttatgtttaagagaaaaaagccaaaagtccttcctgtatggtgtggatgttaaataccaaacagttttattccccttaacattttgaccatcttccttcttccttgcactcttgtggagttggctgctttcctttactttggaagaagctacgtttttctgaccctgtaatggtgttcttctgagatttgcggatgaacataagatattaaacatatcggttgagttttgttcatgtggagtctgtcatcaatatggaatagaattcaataatttgactttttcttgcctctcttctgccatttcaaatgaatcataaaaattaggaaggaaatttagtcccatctcctctctcttgagcagatttcttttccttctcttttttttttaaacctgtgggagttgggaatattttagtgctccccctttgtgaattatggtgtaaatgaaactttttgcttttgtgttattaatgacagtttaaaagtctgagatggattttctcttattgttgttaatgacagtataaaagtcttaggtaaatttactcttaaggtgctaaattaaaaaaaattaataaagtcaattgaaaattttccaagagttattttaaagttgatttttaaatcaaataagcttttctattaagcaaaataagtgctcttttaattagaagctttaaaaaaaactctatggaaacaaaagactataccttcaaaagctcacaatctttacaattcccacttccagacctttttttaggaaacattccaaggctttaaactatttgtgaataatttttatcttagtcaatgtgttatatgcccctgcacagacttatatattcttcattgagatatataattgtcctcttgttggatatttaacctataagctgacactcactttcaaggattgatttgagctttgcaaattttgaaatgctcagaaacataaagtgcttggtatcttttataagaagctagtcagaactgcctgacatgaagggagtttgattgatgtgtgataatcaggtgggaaatttcaaacttatttatttaagcactgcatttattttatgtagatcaaaggaaaatattcagctggcttcaaatgatgtcacttttcataagatacacaagaaatttgatgaaatttgaaaaactgattaagacttatatttgttcatgttcattttatattttgggtgtactatcttgcaagcacaaacaccagcaggctttgcttttacacatctcataagccaagtccatggaagtataaatttttaatgagatagatactaggattctctccttaaaggaaaattggaaacttaggattcttattttgacttttataatagaagttctatttgggatataattcagacacaataaaatacactcctttaacttgcacaactctatggatttagtatattcacagagttgtgcaaccaccacaactaattttaggacatttcatcatcccaaaaagaaacctcatacctattaatattccactctcccctgccagtcctgggcaacctaaaatttactttctatctaaaacctaaaatttcctttattgaatttacattctatctagatctgcctgttctggacatttcatacaaatggaatcttgcaatatatggtcttttttgactagcttctttcacttagaataatgttttcaaggttcatccatgttgtagcatgtaccaaatgtcattttgtattgctgagtaatttcatcatatggctatactgcattttgtttacacatttatcatttgataggtattaaggttgtttctaccttttgactattaaaaataatgctgctatgaatatttgtgtgtaatatttcttcatgtgggcatatattttcatttcgttataatatataccaaggggtagaattgctgggccatgtgataagtacatgtttaactttttgaagaactgtcaaattgttttccagagtaactatgccatttcacatgcaatgtacaaggattcaaatttctccacatcctccccaatgcttgtttttatctctttttggtaatagccatcctattagatggaaagtgacatctcattgaggttttgatttgcatttcctttatagctaatcatgttcagcatcttttcatgtaattatagtccatttatgtatcttctttggagaaatgtctattcaaattattttcccgttttcataattggattttaaaattattgaattgttaaatatctttatatattttagatacaagtgccttatcagatatatgctttgtaaaagttttctcccattctatgggttgcctttttactttttgatggtgtcctctaaagcacaaaagtttaacattttgatggttccatttatctattttttattttgttgcttgtgattttggtgttgtctctaagaaacaatttcctttcccaaagtcatgaagttttgtagttttagctattacatgtaaggctatgattcattttgaaattgttttgtctatggcatgatttaagaatgtaactttattcttttgcatgtggatatctggtttgcctagaaccatttgttgaaaaaactgttctattcttgttgaactgtctgggtatctttgttgaaaatgaattggccattcctagaagggtttatttctggactctcaattctactctattggtttatgtatctatccttataccagtaccatgctatcttggttactatagttttatggtaagtttttaaatatggaagtatgagttctccaactttgttctttttttaaaattctaacttgttttgtttattttgaatgatttccatatgaattttataatcagcttgtcaatttctttttttaaaaaaagcagctggaattttgatatggattgcgttaaatccataaatcaacttgaggggcattgccatgttaacaatattaagtattctactttatagacatgaacatctttccatttatttagatctttaatttattttaacaatatgttatagttttcagtgtacaggtttcacatgttggttaaatttatttgttctattttattgtttttattatgaattacatggattgcttagttaatttaattttcagattactctttgctattgttttgcttttgcatcgttcattgctgctgcacaattgatttttgtatgctgatcttttatctgctaaccttgatgaacttcttaattagttctaatcgttttgtgtgtgtatgtgtgttccttaggattttctatatgtaagatcatgtcactctttctagaaatttggctttgatattaaaaatacattaatataaaactaaagaattagttagaataagattttgttaaaaatattaacttactcaaaaaaaaagatcatgtcatctgtgaaaagagatacttttacttcttcttttccaatatggaatttaaaaaatttttttattatttgattcctctggttagaatctccagtaaaatgtttaataggagtggggagacaaacatccttggcttatttctgatctcaggggaaaagcattcattcttttcccattacatatgatgttagctgtgggatatttgtagatgctttttatcagattgaggaagttctctttcattagtttgattagtgattttatcataaaaaagtgctagattttgtgaaatactttttcagcatctgctgggataatcatgtggtattgtcctttattatattaaaatagtatattacatcaattgatttttggatgttaaatcaactttgtgttcctgggataaatcccatttgtttgtggtatataatcctttttatatgttgccggttctctttgctggtattttgttaaggatgttttgcatttatatttataagggatttttggtctgtagttttcttttcttgtgttgtgatgcctttgtctggttttgatgacagtaatggtggccttgtagaatgagttgagaagggttccctcctcttctattttttgtaagaatttatagaggattgttattaatctttaaatcttatttagattagttatggcttccttggtagtttaccctttgcttttataaattgcagaaggggcttgtaaatggggacaggacggtggtgtttgtgctgattggtccctttacaataattttactacagtgaaagtagaggattttaaataaaactgagtcttcattttgcctccttctataaaacaatgatagatgctccaccattggaagacatgcttagttgcagaaacaaattcaaaggtttttatatcttaaattaaaattagaagatgcctttcagtgccgtctcctcagctgagccatgggtgcatgcccggctcactgtccccactttaagaagtcttaccagtaacctataagtacaaatctgtctagaaacactacttaaaagagcctgttaagaagtgttatactgaccttctcttgggtaagagcctaagaacaaggagagtttgttgaatcccagacatcacgtaaggtaatatgaataataaatatttagattgtcttcctacatgttgcaaggtaatttttggtcattaatcactccactagctcagtgggaaaaattaacaccaaagaagtaataacaactaatttttactaagtaattactatgtgccaaacactgtcttaaatcctttatgtatactatctcttttatttttcatagcaatattatgaggtcaatgctaacattattctccactttacaaatgcggaaatttagaaacaaagaggtaatcttagttgcaaagaatgctggagctgggatccgacctaggttaagtgaccccagaacctgaaccagaatttggaatagattatatgcatcccagggatttagactcagggtctctgtattccaagttctgggtttggaagataagtctttgtactccttttgatgaataataaaatttgcagtccaccttttcttttctttttttttttctgagacggagtctcgctctgtcgcccaggctggagtgcagtggcatgatctcggctcactgcaagctccacctcctgggttcaagtgattctccttcctcgctatacctgtaatctctggggattacaggcatgtgccaccacacctggctaatttttctgtatttttagtagagatggggtttccccatgttggccaggatggtcttgatatcttgacctcatgatccacctgcctcagcctcccaatgtgctgggactacaggcatgagccaccatgcccggcttgcagtctactttttagaaatgttcatagagggtatactcagatggtactaatcacttgagattagacagtctctgcagggataattgaataagcaagttaataaaataaatatttaaaatgcattgagtgattaatgtgtttgagggtaagtgatttagttgtataattaattatttctgcaaaataactctatgaaatggtattattatcacttccatttgtagaagacacccctgaaacaaagatgtgggtaacttgccctgggccagttagcaataagcccagatttgaacccaagcagtcttgttccagaccttctgtttttaacaattctacattgcagtttctctaagtaaatagtcacctgaaatatggctacaacaatacagtcacaccaagaatgtagttagagataagaatgcatcattgtgtttgtgcatgtggagactggagctgcttctataggagataagcaccaagctatcatctgttggagagaaatgtgttgtgggtgaaaggaggaggagggctgttctgtaaatatgagacaagctgaaacaaatatagaaatatgaaaagaaaatctgattttcaaaagtgaagtttttagcctatgctttaacagaagataggaatagactgtggcacgcacttggaagctgtgacagtttggtcctgagagcactgtggtgtgggagggttaggagccacacctcaggggtgaaaaggaacagtttgaaagggcaattttagaaaatgactttgataagctccattagtagatacagaggttgaatcaacagattaatataggcttcaattataagtgtttctatgaatataagaagcatctagaaattaacaggaaaatatctgaccagttgggatggtatttctcctttagtgccaaaagtataatagtttttttttctcttgtggcagtaaaattaaaggcctggatttattcagcaacttttctttatgagaataggaatatattcccagacattgttctacacttttcctgcgtggtgttctaccaccaatgtggagttatagatttagacctctgtgtttgggtgggaagagagtaggcccactggcaggcagtaaccacagaactacatgtatctgggccagttttattccagacatgtggatcttctggtctgcagccttgacaaacttcagagttcccttgtctccttgtacagatgtgtgtaccttttgatcatgaaggcactattaatgtccttcagagtttgtgtcaatttgcaactttgaaggatatccaaattatcaaataatttacatatgatgattattaaattgaagtttctaatttattcttaacaaaaaataaaaattacattcacatcaaaagcaagtaaatcaatacttcccacatttcctgtttcccagatgcaaacaaagataagtggaagttaaatatcaatatacaggtgctttcaaaaaagtcttttggtctatttccactttcaaggtaacctggtggcttcttctctcaagtcctcacacaggtattcaggaataccaggatggcgtgcccaagattccaacagcctgtattacggtggaagatgcagaaatgatgtcaagaatggcttctcatgggatcaaaattgtcattcagctaaagatgggggcaaagacctacccagatactgattccttcaacactgtagcagagatcactgggagcaaatatccagaacaggtgagtgaaggagaaggctggcctaagaatacagtttcctggtctagtttgagttattagagatagtttgggaaagagagaacgtgaaaccacctagatggtcctcatagattcgttgaaggcagaagctttatatatattttttctcatcaaaattttaccatgtttaccatctcacaccagtcagaatgggtattactaaaaagtcaaagaataatagatgttggtgaggttgtggagaaaaaggaacacttatatgttgttggagggactgtaaattacttcaacccctgtgaaaagcagtttggagatttctcaaataactgaaaacagaattagcgtttgacccagccatctcactactgtgtattgtaaccaaaggaaagtaaattgttctactaaaatgatacctgcactcacatgtttattgcagcactattcacaatagcaaagacatggaatcaacctaggtgcccatcaatggtgggctggctaaaaaacaaatatatggtcatatatatatatatatatatatatatatatatatatatatatatatatatatatatataccatggaatactacccagccatagaaaagaatgaaatcatgtcctttgcagcaagatgggcacaactgaaggccattatcctaagtgaattaatacagaaagaaaaacaaaaagcatgttctcacttacaagtgggagctaatcattgggtacatgtgtacataaatactggaagaataggcaatgggggctccaaaatcggggagggagagagggaagcaaggtttaaaaaaactacctgttgggtactacattactctttgggtgacgggttcaactgaagccaaaactttagcctcacacaatatgtccatataccccctgaatctaaagtttaaaaaataaaaaaataaaaattttagcacattgactgaagaagggcaggagtaattgaaggacagaatggtattcgtgatgtggaaattcaacctcggaacaattgagagtggtatttgtccacgtgttgtatttattccatttgaagctagcctggcatttgagataaaaccaatagttaatacttattgtgttaattatcttatttaatcctttcaaagcttagtgaatttgcatatattttctgtattagtccattctcacattgctataaagaaatacctaagactgggtaatttataagaaaagaggtttaattggttcacagttctgcaggctgtacaggaagcatggcggcatctgcttctgggaaggcttcacagagcattcaatcatggcagaaggcaaagggggagtgaggtgtcttagatggcaggagcaggagcaaaggggaggggagatgccacacacttttaaacaaccagatctcatgagaactcgctaacacaagaacagcaccagggggatggtgctaaatcattcatgagaaacagcctgtataatccaatcacctctcaccaggcctcacctccgacattcgaattacaattccacatgagatttgggcagggacacagatctaaatcatatgaagtttcttcattttataggtgagaaaacaaacctagaaggaaactcaattacccaaggtccacacagctaagtaggcagctaagaaggaattcagacccaggatcttgtgaatattaaaccaagctttaaaccacagtttatgtgcagtttccagagttcatgaatttatctgcaaataaagggatggtatgcaagtaattaacagaattattgtgaggactagattaggtaaggcacatcaaatagctttgttgagtgtttggcacatcacagctcactgaatgtaagtttcctttgtatggcatcaagtgtgcaataaacactttttataaggtttctggtgcaaatctcatgcatttgttattgaaattctagaaatggaacttaaaaatgttatttagaaatttcagacttgtattttatttgacagcatcagtgggatgaaggaaagggtgaagagtgatggcatttggtgatggagaaacaagtcttatgcacatgacttctcccagactaaggactgggagactcaggactcaggacttctcccagacttgagggctgtactgcagtaaagattcattttaagctcaggactcttttccctcttctaaaatcatctgcttcaaggacctgggcatcaaccatggcttttgccacagggatgatggaaaacaagaactcagtagaatcacagggagtcagacagctgtagagaaacggtggtttcaaatagacaagcccagccccttgtccctttaagaaactgataacaacagaagagccaagagtctatatttcagatgctaaatagtcagatgccttaaagtgtaatccttcccaggtattttccccagtcagtagttccagggtaaagttatgtcatcatcaggtagctagcccagggcttgaagggtttaggattataatactatcgctgtttggtcgagcaggctgggtgagctggcctaaggttgtgggcaggtgggtggcagggtgagagtgagttattgggatccttagtctgtagcagctatggagtctcagaatctgaggctgaagtatttaggcagaggagttcttgagagccagagggctgagatagtgctggctctgacagcttcatgagggacattaacatcttctggctaggagggcttgggcctatttgtcagctcagcctgactcattcttttattttttaaaatcagctgaattgaggtataacttatataaaataaatcaaccaatctaatgtacaatttgatgagtttggaaaatgtataatgtaaccactactacaattataatatataatatttccaccacccaaagtttcccttgagttcctttgtagtccatctccgactctaccaccctgccctggcagccagtgatctcctttctagagctatagttgttttttaaattattatttcatatataagtgaaataatataatttgtagtcattttctgtgaggcttatttcactcagcataatgcttttgagatgtatccatgttgttgattcagttgtttcttcctttatatccccgagtaatatttcattgtacagatatatgacaattcgtttatccattcagcaattgatggatatgtgggtggtttctagtttttgattattgtgtataaagcttttgtgaacattcttgtactagtctttctgtggacttaatgttttcctttcttctgagtaaatatcttggagtggaattgctggactggcctaaatttaagtacccttctctctgtcaagatgcttcactctgtattttgtcggggtagcaccttctcccagaaggtagatggacaatttcagagcaatcatgagatttaggatgttgcctagaattccaagagttgatcataaatactttgttaccaagatgtaaaaggtagaagtttaacaaaacttcttccacaaagaagtaacagcattactttcacagaaaaaaatgaaaatgaggacagtaaagtcaagtctgtggttgcgttttgtggagggaatctgcattctagctggcctggaaccgcaggggacatacagactatgaaggcaagcaagaagcatgaagtccctctgcaggtgttaagttgactaatgagcctgaaaaagaatggccttatccccaataaatgtcgcttcttccatgaagactgctttgataacattcccctcatcccaacacttcatgccactgttatggtgtcatctcctagcagaacttgcaaatgccctgagagcaggcactctgttcactctatttcctttcttttcctttttcccgccctaatggctatttcaggaacttggcatgcagtggcttctcaacacatgttttattttggtaaaatgaaggagtaagtaagaaaaaaatggttggaggatgttactaatcttgatcctctttaaatctggaagttttactgcccttttagaataccaattgttcattggcacattgaacctcatccctgaatgtagtgcaacatgtccaaatatgaacacattggctccctcatacctgattttttgtctttgtttcttgtttctattaaatgaaccatatttatctaacagcaaagttataaaacttcaagttaattttcattccctctcctttatcactgtcctacagtcaggtatcacatcctattcagtctattttcagcatattaaaaaaaaattctgttcctaccttgcctttactgctactactgccttaattcaggccctcactatttccccccgattttttttcttctggtcttttccatacttctttgcaatgaggctcaaagttattttaaaacatttgatctcaacatggtgattccctgctttcaggtccctctctcctgtttcttataagataaaggttgtgatgaagataaatgctgaggtgagtaatcagaggtgagcagaagacagagaaaaaaagacaaagagagaggggagtcagggttagataagaggcagttatagtaagaagaaattatatggtaccattcataaatgaacagaaaatgagaatgaagaaaggggaaaaggaaatgtatgatggtgaaaggcaatgtctggtggagattcaaggtcaactgagaactgatctttcataggccagggaaggagttcagttccaaagtctagcagactttcctaaaatcattcatttttaagttatcagtaatgctaacagtaacttaaaagttggtttttataatttaggttgactaacttctgcctgacacaaccttgctactttgctccatagcatactaaagaatagtggtgctaaataacttataaaattagctgcagtggaaattatctctataaaaggagaaggtctgttgaaactatcattattctgcctgcagaataatgcaaatatctttggagacttgaaagtaggcagaggggaggaaagtgggtatcttagtctgttttatgctgctattgaagaatatcatagaatgggtaatttataatgaacagaaattagatcagagttctggagacagggaagttcaagagcatggcaccagcaatttgcaaggaactaaggaacttcatgctgcatcatcccatggcagaaggtggaagggcaagagatggtgagagcaagagagcaggaggggaccaaactcctttttataacaaactcatttttgagataattaacccattcctttgataatcatattaatccattcctgatggcagaaccctcatgatttaattacctcatattaggccccaccttccagcaatgttgcattggggattaagttctcaacacatgaactttcgggtgacatatgcaaaacattgcatggactaacactaggcagtggctaatagatattgttcagtaataacacccagtatagttccttacatctcatcaaccatgcagagaaccttaataaaagtaaagcagttagcatgtaaataatccttccattttggcccaaaacccatgggcaaaatgtggtaaatatcagctttagaaaagtgtatatgtgattgataaagtattagtacatttcaaaaccctgttgcataattcatccataagcctggaccgaattaaccacaggctttaaaaagatgccaataggccaggcgtggtggctcacgcctgtaatctcagggaggccgaggcgggcagataactaggtcaggagatggagaccatcctggctaacacagtgaaaccccatctctactaaaaaatacaaaaaaaagttagccgggtgtggtggcgggcgcctgtagccccagctactggagaggctgaggcagaagaatggcatgaacctgggaggcggagatcgcaccactgcactccagcctgggcaacacagtgggactccatctcaacagaaaaaaaaaagccaataatgaaaatactttattgggtttcactttgtgaaaatagcagaataggggtaatatatacctaaaatctaccctctttccaaaaaaccgatggtggcacattctggctcctctaagcccagaattctctctccactctgacttcctcagaaactgtactcttctgtgatttgggcatgttttgcaggacccagaagatcttggacagtgtgcatgagtgcacttcactggggctaaagcagtcctctggaagctctgacattagcctcagaactgcattctctcaagacagctttatccctgggaaatcatggtatatttaagacccatctatggttgagaataaatccgagtaggtgaaaatgagcgctttttgatttctgagctgatacttcatggtactaaaatagcaatattatttctacccccacttatcaaggaactactttgcatttgaaaattcagaggaaacttcttaccatctgtgaataggttttattttttgttaactctatagaggttatcctaacaattaaaatagtcttagaggcagagacagagagtagggatcctagagatttagtacaaactctatgactttcagattaggaaaattgaccaaggagaacttgtccaaggggacacagcaaatatgtggtacaaacacatctggaacataactctagatttctggactcccatttcttttaacctctaagagattccattatgcctgggcatgccttagttgaatggtgtataaatttgagggctatacattgattcaggatataggcagttccatccttaccaagtcatttttataggagaaattgtacctttctctcatgctttttctcctgacatcttttccctaagcacaaagagttctcatatctaccgtcctttgtcgtctcagagtttccttagagcacccctgaaggagtttcacctgggaaagtcgcctgtgcttgatccattgattttatgtatcctccctctaagtcctccttgggtcatttctttttagctccttgtcactttggaagaggatctgatgaatgcatcacttctggggtgttaatgactctttatgacgccttgttcccctgtgcctcttttcacaccccttcaccaatcagctactcaggtccatctttatcagagggcaacagaaaaagccaaaatagatgcactactaatcatattatattgtaaaataaattttttagaaataattttagactcacagctattgtaaaaatagtgcggaaagttcaaatgtatgctttgaccaggctaacatgatcagtgataacatcttacgtaaccatagtacattaacctgttgaggacactggtgagaggagactcctgagagcgagctgctttcttggaaagcgagggctgtcttgtgggcatctctgtgtagcacccagtgcagggtggacctgctctgactttagcccccttagtctttttccagttttaatttatgatgctttcatgattttccacaaacagatgaacaaataaacacagaaggaaggttgtgcttgaattgacctgaccagaggacaaactgatcctaaactggactctctctcaccagtaatggattctctaatgttgactcttggggctggcccatttcttttgatccccagcaatttcctaggtcttattttgaggtttgcttagtaaaggcaatatttttaaaatgttaatatattcatgaattattctgaagttattgtatggaaaggaaagtgtttgggattttggagtggttggcggttgatggtattcaaacccattttgataaggccttgatgcagtgaattttttttttaacatgcctttttcttacagcagttattttcatgcattcaaagaacaaattcagttttatatgccagtattattttaaatatagtacagtactgtgaaggctagtggggaacattgaaatgaaaactctagtttgttaactgaacacttcactttcttttttcagtgtggggcaggatttctcaacatcatctctgttggctctttggatcagataattctttgttgtagggggctgtcccgtgcattgtggggtgtttagcaacattcttggccactaaccactaatgtcacttcctaccccacaccacacctcctgcagtctcgagcatcagaaatgtctccagacattgccaaatgtcccttgggggacaaaagccaccccaagttgagagtcactgatgtggagtaatggaaggaagactagatgggtgttgtgaggctttggttctggttttatttctggcacaaataagctgagtggcttaatccttcatctatagaaggaggaactttgtctgaaaaagcttgaaggtcattgccagccctaaaattcctttattaaaaaaatactgaaagatgaaaaaaaatacttaaagatgaaatttatcatcacactaatggtaaattctgtgtactgttaaatagcaacaagacgtcatggaagccctttctaaagctggtgctggagaaaagcattatttacagagtaagggtgttgctgttttgttttgtttttaaattctgtgttcgaatacagttgggaactttcctattcaaaaagttaaacaggctccctttttctgtggtacttcttaagcctttaatgtgctgatgtgcactgggaatctttaagaggtagctttgcagtattctgcaaatttttgatcatggaacactgttttcacagagtatcttaacataaaacattttgtgaaacagtaggatgaggcatgagttttgctgggtagattatgttttagtgttttttattatattctttttaaattgctcttacattaattcagcatctatttacttattgggtattggtatgtgtgaggcactaaggttatagcaatagcatggggtgggcagtatgctctgagcataacctgtaaaatttgcatcctgtctcttatattttgttggtagactattttgcctttctggatgtaaacatcagcctttcctgaagatgggagaacttatgcagaagttgagaaataggagaggcccattaggagggacagcccacggtgggtctgacatgccatgtgaagggccagggctttgtcctgtaggcagcgcgaaggcactgtagagttttagcagtggatttgcgttttagcagtggattttcattttagcttactctggccactgcatacttttgagtaggcaaagactgaaattcagccagaagataatagagtttaaaccaagacagttgaaatagtgttggaaaagaggagaaggattcagaaaatgtttggaaataaagttggcaggagttgttgaagtttgggtatatgagagaaaaagaggtagaagtgcagtttgggtgagtaggagaattcatccattaattctacaggaatttattgagctcctactttgctgggtgtattagggttctctagagggacagaactaataggatatatgtgtatatgaacaagagtttattaaggagaattgactcacacgatcacaaggtaaagtcccatgataggcaatctgcaagttgaggaacaaggaagccagcagtggatcatcccgagtcccaaaacctcaaaagtagggaagctgacagtgcagccttcagtctgtggccaaaggcccgagagcccttggcaaaccactactctgagtccaagggtccaaaagctgaagaacatggagtctgatattcgagggcaggaagcatccagtacagaagaaaggtggaggtcagaagacttagcaagtctgctttatcctagcctcactggccattgcttagatggtgcccacccagattgagggtgggtctgcctcttcccgtccactgactcaaatgttaatctcctttggcaacaccctcaaagacacatccaagaataatactttgcatccttcaatccaatcaagttgacacttaatattaaccatgacaagttcaccccttgtcaacttgaacccatacacatctcctgaaatcgtatataatctccaaataaagacaataattatgcctaatataatacagctatctcttgtgcaacccggagcacactaattgttaacctaaatgctattacataaagttaacaatacttaaatactgatatgaagtcaataactcttacgtcacatgacaaaggaaaaagaaaatgaagatattttcttagtgcaagtgtatacatctacatattcttaacaaaattaggaggaaatattcacaacaattacagtcctctttctgtagctggtcacgtggttgtagctggtattgatgactacctttttctactacctattctgtattccctttgccttcagcaagcacctcagtgggtcgtagttttttacttggtgtagtgacccaaaccttcactcctgaagggtctgggccatttgtagtcatgcctggattgggttgttgtagtttcccattgaccataatcacaaggcatggtaatactaagagatgccgtaaggatctcctgtattccatgcatactcttccttacctccattatgggataatagactaattttatcttgataatccggatcagttgccccggccaacactgtaactcccttcttagcctgttgacttagaggtaggcagagcccaaagtgtccagatggcaaccttaacttccaatttaatagaatcattgttgtgcctcctggcaacattcctccctctggaactaagacttctaagccagcagaatataatgtagcaggaacagaaaacaagaattttgctagtgggtcactaggggtgatggtgagtgatgccacttccatttccaccccttgttttttggacctgtgaatcctggctatgggagaaacagtaccatgtattggatgctgattcagatcatacacagccttctggagaacttcactcgagccctgcaaagccctgcaaagtattgtcgcctagttggcattgtaattgtgacttcaaaagtcattccaccattctatcaatccagctgcttcaggatgatgggtaacatagtaagaccagtgaattccatgagcatgcacacattgccacacttttttagccatagagtgagtgtcttggtcagaggcaatgctgtgtggaataccatgacggtggataagacattccatgaatccatggatggtagtcttggcagaagcattgcgtgcagaatgggcaaacccatatgtctattccggtgcagacaaactgctgccctttccatgatggaaaaggtccaatataatcgacctgccaccaagtagctggctgatctccctgaggaatggtgccatatcgagggctcagtgttggtcccggctgctggcaaattaggcactcagcagtggctgtagccgggtcagcttggtgagtggaagcccatgttgctgagcccatgtgtaacctccatctctgccaccatggccactttgttcatgggcccattgagcaatgacaggggtggctggggaaagaggctgagtggtgtccatagaatgagttatcctgtccacttgattattaaaatccccctctgctgaggtcaccctttggtgagcactcacattggatacaaatattttcacagtttttgaccactcagaggtccatccttaaaattttgtatatacatattatcccattatcaaatattgtcaaattgccctcatagcaccatagctgcatggtaagatgggcaattaaacaagcaacagtgatagaaggtggtaagtgccacagtatggcagctacatgcttctataggggctcatttgagggcaaccgtcctggtctaggaagccaaggatggctttctggagagattcagtttattcctactaaaaagaagattaactgcatgctagagattataaggatggggttgggatgaggtatattacaagctgaggaagtacatgtgaaagcctgaagagtagtgttactcttttttttaagaaacgtgatgtgacttcctttaacttctgaattcatttgctaatgaatcctgtttttatggagttatcctgtaaaataacccaaagacaaagacatggcttttttaatgtatatgtgtttttagaaataaatcattgaaaagctcagtaatccctttggagaacagctttagcattgatgctgtcaagacccttgtcaaaagaataaaccaaacctgattggcctggtggataaactcattccatacataactgaatagttagagactgtacagaaatgcagttttgcctttcatcttaatatgtagtctgatgatttgtaaaaaccttcttagtgggaacagcaggttattctgcctgggtgggagcctttttactagcttaagcagctgtttaaactttcataagcaaagtaattattaaatgtttcatgaacatattggttggaacgtttgttcacattttaaccttgagttggaaagtttcaggggggtggggttaaagagttttaagctggcaaattcattctttttttctttcttattataaactttttatggcttagaaccagccaacctaaatcatggaaggaaaaatacatgtgtggcaagcatgagacatttcattgtttatttttcaaatttctgaaatgtgctcatagctgtgcatgcctctgggctcataaagacagcaaatggaaatagctgaagccagacagactgttttagatagatagccacccaggtaggcaaggaaaaccttgtaggttactctttcctccaatcaagtcatattaatttgccaaaatgggattttcaagcaggaggatgtgatctttcataggtctgaacaccttgcctttttcaatgatggagccatttaataataatcataatcagaagatgaggaataatatacatttatagaatacttagtacatggcaagtgtatatgacacatagtagtctacgtgtttctcatacattatctcctttaatgttcaccacaaccttgtcaaacaagcaatgctgttatatccatataacagatgaagaaacgaaggcttagagaggtcacagaatttgcaaagcttctgagtggctgagctgggatttaaattcatctgtcctatccaagaacaattcattatcctgtacttcttagtgcctttttattctagtttgtgaagtgctgctacctaaagagtttcccattttactctaaatgaaaaagaaaaccaggacaaccatcagcatcaacagcaactaatgcttgttgaacaactactatgtgcaggacgctatgttataagcttgggaaatattctgggatgagaataaagaagataaaagggtccttgcccgtggctggtgaggaaaataggcagtaagttctagagctcacactgtgcagcactagtgcagggcctgcagcactgtgtccttgctggcccagtactaatgtctgcatatagtactttacaatttgtaatgtgccctcactgatattgtcccacataatcccaacaataggactgataataatgattcccactttaaagatgaggaagctgagattcagagggacaaaataattggactaaggtcaggcacacaccaaaataagtggaaaatacgattcaaaatgtggttctctataacttgctgtagtcattacctagagccctgcaattttatatagcataaaataaatgctttaaggattacctgaaacacaaccttaaaaaatgaaagcctttaaataataataattacaatatagtgaagtaatgagagcaattttagtagttttaaaatatgtccacatttttttttaaaatttctgtttaaaaggtggagccgaattctcttcccctgcatgtgtactgtacttagtgtctgacttctagtgaacagaatattgcagaagtgctgggttatggcagccaagattagaacataaaatgcagtgtagcttcctccttgctctttctcttgcatcacttgctctgggagaagccagctgccacgctgggaggagcacttggagaggtccaggtggtaagacactgacttcttctgctattaaccagtacaaactagctaacaagtaaatccaacaggtccagtctaggcttcagatgacttcaaccctggccaatattttgaccacaaccttatcagagaccctaagccagaaccacccagctatgccactcccagattcttgactcacaagaacagtgtgagataataactgtttattgttttaagccactaagttttggggtaaactaatacagcaattaaagggcacaagatacacagaaaggaataactgtgtctaagctgtcacaaaagatgggtactaaaatgtgacaaatatgagtaggaacttataggtggacaaggaatttattgggaggtgttctgggcaaagaggcaagtgtatgcaaaaaagtgtggaagtgtgccacagcaaggtacatttatgaaactgcacagtacagcacaagataaaaatcacaccaagaaatgtaatatatcataatataacaacaaatgttcttaagagtgactttgagtctgcaagaaatttagttctatatggactattttaaaagataggaaagcaattaaaacattgtttgaaatatttacttcaaaatttttttaaagtactgtataaatttttagttagagtctaagctatccagaaaagccacttccctgttttcttacttcactagaactgtctggttccatgttttgaaaactttagtttaaatgtagagccaagaattaactaatgaagaacacctggattttctgcaggatttcactgcaccaattctgttacaacaatcaggtagaaattaacattttataaccaattatatgttttacttggcatcatgctaaccaactgaatttttacaaaagagaattggccaaattgactcattattctccaccatacctcactcattgactgactatttattgagtgccgtccgtgtgttacccactgtgataggcccataaaacaaccctttatggttgcaaaaatcactttgcatcccagttgcagctctactgttttctagagttaatagaagttcctggtgaaaaaaactatgcttagtttttttctaagcatgtttaacttgggtttttaattaaaattaatacctactcatttgaaataaagagaaaagtgaaaagaagttttacttggaaatacattaattgaaagacagttgctgttagcatcttgctgcacttctttcactctattttcttctatgagtatctttataaagttataatattttatagatactgtcaaatctagttgttgtttaacatcaggcaaaatatcccttgaaacagaatttttaatgtatttaagttattctaacaaatggatatcctgcaatttacttaacctggtattagatgttttgattatacatgaatctttcaggaaaaatgatgtcatagttaaataaatatgtagctagtgaattttgaatgtgtcttttgaactgtttatgggctttgtgataattgggtaattttaaatgataatcagtaggaagcttaggaagaggttaacatggtttctctcccttccaagagaactgcctttgtaagattctgagatgaccactgtggccatgtgcccaagtgtgctgtcacagttatactgtcagttaaattaagcatgaatgattggatggagaacattattattctctgcacattcttgattcttaatttaaggttaaactaatttaatgtcatgtgaatttttagcagcaattatggacagttaatgcatgttcttccttagttatgcctcatctctttgcaaaattacaatatttcattccaaatttcttctgaccagatttggaagtagctctctcttctcttttccctcaatgtttatatcagaagggttttgagtttatactgtaaatctccatttgtgtattttcataataagactctaagaaccttgactggttatgagggcactggaatcaaagcaaatgagggcactggaatcaaagcactggacccagtgctttctccatccttcaggggatattgtacagacaatagagatgctatcttaacatctctgtttgagtttttccctctccacctgtcttgcataccaccctaaccaatactccttaagtatggctctatattactatgcccctatcaacactctattttaaaaaggcatggcttcacacttcctgtaagataatagccagtagtccttgaatctggcattcaaagctttaaatctacaagatgatatactggtcataccttttcctgcctattttctagagtcttttcccagaagactctgttccatgtatttggtgtcactttcctgtctctgtgccttcctcatactgacccccttttctaacctgactgttgaaatcttacctactcagtcttttttcatttatttgttgattgtttcaataaaattaatttacttaataagtatttactgagcactgattgctcatcagacaacattcaagagcctactgaaatggcaccttccctgagaagcctctcttaattacacacccatatacaatgtttctctcttcagaacttccataggtctcttttttatgctttccataaaatttgtcacaaatcccataccttatttatgtgcatataggagcatctaatgggaactcaaaattgctttaaagaacataaatgaatgaatgaacatgaatgagctaatgaatgaaagaaaagttatgccttctgcaccagcagaagctaatgactaaaataaaatggttaaactggactagaaatttaagattgttatgggtttctagtctaggaaacaccctcaatgtggtttccatattggattatcccaacagagaaagatatggaatccccatcttctgattcccacaccattactctttctgcaccatgttatcacatgctactctattaaaattgaggcagtattatcatactttgttattgcttttcattattagacatagtgttttaaggacagtattgaataggaagattgttttttcagagtgctgtaacctattttagcattcaaaggggcaaatgtataaacctgagtggtgagaaaaacgtagcagattaactaattttgaaagataatttattttgaacttgagtaggggctagggaccttcattagttcctaagaaaagtagaccacaaactcaacctctatgctcttttttatctagtcatgatattagagtatgtgtggactttgacagtgacacctaaatggtttttacttgcctcattgtttccttactaactgtatgaaagaagaacacgtgttgagcccctccaatctaaaaatacaaactctggaatgctccaaaatttgaaactttttgagtaccaacatgactccacaagtggaaaatcctgacctcacatgttgggtcacagtcaaaaggtagtaaaacaattgtttcatgtacaaaataattaaaaatttgtatgaaattatcttcagactatgtgtataaggtgtataagaaacataaattaattttgtgtttacacttggtcccatcctcatgatatctcattatgtatatgcaaatattccaaaatctgaaaattccaaaatccaaacatttctggtcccaagcatttcagacaaggaatactcaacatgtgagactctggaggtgaatttttgtttgtttgtttggttggttggtttttgcagtaaattgttgaagtcttagaaggggcgcattcagcagttagagcttcccttttaatttgcataccatgccgaagaagaggaggtgtgattctccttctggagatgatcattctttcaaaaagaattatggtgaattgtgttttttaaaaatagacttctagggcagagtaggggaaaaacatagggaaccgttaattaaggtatcagggcttgagaacgttgtttttgtctgcccaagacccttcctttggaaacagcacctctcccaacatttgtgctcctagtggactggtaacttgcactcctaagaactggaatcttgaggaagacacagagcgatagatgagattggggctgagtcatccatgatggtatcctgggcagttcagaatctctgagcctcagtttttcttccccccaaaatgggattctatgtctcactgagttatttgaggattcagtgagatgatgtctctgcaagctttggcacagagttgttattcaagtgaatattagctaccactctttgaggttagtagtcctggggacaattcttttctccccctaaagaaggaaagggaaaggaaactttctactgaggaggtagcaaatgcagaatcactgaaagtgcttgcgaagaatatccaactattcaaattatgaattagcaaaagataatcaggtgattgtgaactgtgggttgctgctgctttgttgtaatactgctgttaaaacccacgttagagatcacatggacacaggaaggggaatatcacactctggggactgtggtggggtcgggggaggggggagggatagcattgggagatatacctaatgctagatgacacattagtgggtgcagcacaccagcatggcacatgtatatatatgtaactaacctgcacaatgtgcacatgtaccctaaaacttagggtataataaaaaaaaaaaaaaaaagtcaatagtactgcagaaactcaggcttcttgttgggtcggggagtggcgaaatgtaaagggagtaaaaagggtggtagtctataaaggaactagccatccagccacccagaaaccaagtccctcttttaattaatagagttatggagaggctccagcatattaataaatgtccccctatgggtggtgagaacgtcaaatgtgaaacagagcatattggattttgtaataaaaatacagagaattataaatgagatgtccaggaggcatctaagttaaggacacctaagatcaagaatttatattctagttgataaaaagttgtggataaaattagggtgctgagatggaaaaagaaaggctcctgttggcaggaggaacactgatatgaagtgatgggagagttttgatcaagcctgtatctttggtatttaatatggggatgcgtagagagtattagaagccataggtacagccacatacattgttaaaatgtgactttttgtatattatttcacgtttgagcaattaccaacttactagcagttgtacaaaaagtaagccattgtgaatttgggatgcattttcacatatacattgtattagaccattcttgcattgctattaagaaatacatcagactgtgtaatttataaagaagaggtttaattggctcatgactctggaggctttataggaagcatggtgctgacatctgctcggcttctggggaggacttaggaagcttacaatcatggtgaaggtgaaggagaagcaggcaactcacgtggcgggagtgggagcaagagagagagagtgggaggagaggtgccacacacttttaaacaaccagatctcatgaaaactcactcactattgcaaaggcagcaccaagccatgaggaatcttcccccatgatccaaacacctcccaccaggccccacctccagcactagggattacaattcaaaaggagatttgactggggataaatatcgaaactatattagacatgaagctgcaaattattatttaattcatattctagcattaggtataccagaacaaggtatctgggtaagagaaagtcgatatgaagggcacaagataatggaggaagacagtttcttctatcgtctagggactttgagccaattcttgggaaaaaaaatagatgatgttgtctttgatggtccttttgttgttgttttgatcctcttcttcaaattcctggtaccttttctttctgactaacagaactctcttgttgtaaaacagcccagtgaaataggtattatcccaatgttacagttgagaaaagggggctcagaaaggttttgttaacttgctcatgccagtataataaataggaaaagccagtttcataatcaagtatgtctggctctaaagctcaccaagtccaacatttttgccttggaatgtgtaagttaacaatgcccccactaacaacatgaagcaatacagaaggaatgggttgagatggggtttgggcaaagaaaagatgagcttggttttaggtatgttgattttgagctaccttggaaagccattttctgttttgtggttgcaagagaaatcgtggtttgttgccctgtgttagacatgggtaaacttagagtgttccatttgctgtagaattagtggaggatagatagatgggatatataggcagagatcgatagatagttgtttgtacattggttgtttgaaagttgagcaatgtctgcagtcactagtcagtatttctattgcttagcaactctatttcctcatgtagccataacaaatggaacttttatatttattttttatgcttaagggtacatagtgctgcttataaatgatgcataagtgacaattttatactgtgagcattactctgactcttggaatcatagaatctcaaggttggacgggaacttaatagttggatttgttctatattcagactgctttacacctccatgaggtcctgactgacacatactactcatttagatagtgctccctatctgaaaagtcttggttttcagataacattttctttcctttaggcaaattattcctgttttacccatgaaggacaaatccaaatatcttgtcttcatgagaactcattgcacatttagaaataggccccatgtctctgccaattttctctttcctgggctgagcttcttctccatcttttcagtggctccttggagagatatattccttgagcgcaggactctttagcccaggttctgggaatgcacctcacagaaggctccagtgtcatcccctgcaggcattgtctcactggcagagagccactcatccatggccatagccttttccggtgtagtccccatctaatgatcaattcagatggggtataaaagctcagttatttcagtccaatatgtgacaactctgacaagccattttagtctcagagctgctcatggggtcagctgagtctattgttgggctgcattgcaacttgatttgttttctgttccttcttgagtccttcccctccctttctcaggtgttcattcccagggcataaacattctgcctgccaactctgatgcagagtctgcctcctggggaaccaagcctgcaatgtatgacttcaagtcttcttatgaaaccattccaatttgtttatggacttagacttctggagtggatagatacctctaggtgtaatctcctgtgtaatcagaatacattttgctttgaagaatattttaaattaagtaagattccacaaatctaatgtgtaaagctcatgcagtagaaagttttcagtgtggatgtcttagcttaggttccccctcaaaagcagagtgtgaaacaaggacttacatgtgagtagtttatttgaggaaattatcccaaggaacagaagtgggagactggaaatgattgttcacaataatctctgtcatttcatagccatagtttttcatcaacactttcctaatgagctcatctttgggatgccaagtgacattgctgtgtgctttcttcaagagatctgagcaatgtagtcagacagccaattaacatttttatttactttgggaaagctttgagtcctgagacctgcatgagatttttctggtagtatttccaactgtctaacaaaacatgtcaaaaatttcatatttgtcgttccaggaattcagcttaataagactacacagaccaggactgagaggttggtggcaaaggaaggagctactgagagccacacatcaataaaatgagatatccaaagcatggaaggagggtcagtcaaggcaatgagggatagactgggatcagttcaggaggctcctcccagaaccaggaatctaattaggagactgaaaagaaaggaagtgaaggggccccaagccagagagccctatgtataaaattatacatgattttatatatgtaagtcgtaatttaattctcacagaaatattgtgaagaatgtgccaatattattatcaaaactatttagcagatgaagtaactgaggcacaaagaggccaaataaattgtccgatgttgcataggtagtaagtggctgagcctgacttcaaacctcgatagacttttcccaaagttcatgctcttctgaatattacttatttctcatgtacctgtttctgaggcagaggttctcatgtattataaatttccttgatgaaagaccaggactggttcagaatgtgtgtgttggagaagaggggtgtaacagatacacattttatagacctccttccatcccatccatctgggcccactgcatcttgcactgcaccactcagggaacttcccccttgcccttgtctgctactatgtatctcggtcagcaagttccaacttggagtttctggctcttcttgccacttcaggacttggatgagatactaagccatggggcacgcaatgtggccccacatgtgttggaagaagccagatgatacaccctggacatgaaggagagttaactccttgtagggtgaaatttgaccagaggagggcaatggacaggagggaagtggctaaattccctcatcttgcactgtccaatcgacttctctgaggcatgagtttttcttctagctcattctttcccttgtcaagtggacacaccagcaaaggacctgttgcgtctctttgtggcttagtgtgaagtgataggcaggatagtgatccttcagttggcattgcttggcatcttttcttgcctcaatttccttctagctcattctttcccttgtcaagtggatgcaccagcaaaggacctgttgcgtccctttgtggcttagtgtgaagtgataggcagcatagtgatacttcagttggcgttgcttggcatcttttcttgcctcactttccttctttctaatccttgtaccctgggtttacccctttcaaagaaagcattaaaggccaagctaagaaaatgggtctggactaaaaagtggaaacaaatagagtagtaggcatagttcttaacagcacttcactgttcagagacaagaaaggacatagattctttgaaaaataagtgtagaacaagttagatgttgatattatgactaatgtgtaagttccagtacttaacaagaagttgttgtaaggtgagtatttatgaagaagggggagaagggaagaactccctgatcaggctgattttaagtcagatctatttactgcctgttatgcctgtctcctcttcctcttcatgttgctaatagcaaaaatagccgctattttctgaacacttaaatatatgtctgagaccatgctaagtgctttatgtatattttctcatttattcctttgaggtagaaaattgagactcagagaagagaagtagctgtcaagcagctaatgagtgctagcaccagatttcaaacccagggctgactaactctgaagcccatactaaaaatggatttgttctgctgtcttctgcaaagttccttatcaaaggaagttatctagagcagaggaaagccatatggagaaaaaaatatggcatgagagcatcttattcattttgttcttatttgctccgaaagcaacttctggtggagccagctgctggtgtttggagtgtctttgccttctaggaggaaatactctttcctaggtgccacactgttgatacttctcaagaccaaaataccacaggcctccagctccttgataaagctttaatgtgttgaattggcataaatcaattccctaagtctgcctagcagaaccaaactctgaatatggtgacctcacagggtcacctagctcaaggcagccagcaggcttcctacttgatactttctttgatagatgtctttaggggagccaacttttctttaacatctttcctttgactctaaagctctcctctcccaacatttcctctcctcagtttaacccgagttatgtgttcatgacataaatagggccacgtttgccgctgaatgatgtcacagtgcaggtgatccacagatagagaatacaaatagcatttgacatttgcctttgggatgccttatactactttttatcctcccagtaatgtttacattgttgttttgtttttgttttttgttatttaaatgataatggcaaaagacccttgttaagagtcatgagatctgggatctgattgcagctctgacttatcatctggatgtgactttgatctgtcacctggtcctctgacgactcagttcattcacctgcaaaatgggagagttgggagagattatttattcttaaaccatgctgatcatcagaatcaccacagatgctttttaaaaagggcccatctcagagtcctgaatcacacttcaggtgaagggaggagaaaggagattggggagaggagcaaaggtccagaatccataattgcaacaagctgcctgggtcattctgatgcacagtttaggacaactttatgcaatactgccagttgcacaactccaaggggtgccacttgcattctacagactccatgggcacagttcacatgaaatagaatctgaacagcccctcttggtattgtgtaatacagcagccctgtatgagctgattactgtatagggtcatttgtaagcatggatattctttgattggatgacagtagagtgctttgaggtcctcagtagacagtagccctgtattagttcattttcactctgctataaagaactacctgagactgggtaatttatagagaaaagaagtttaatggactcttagttctgcatggctagggaggcctcaggaaacatacaatcatggcacaaggccaaggggaagcaaggcacatcttacatggtgacaggagaaagagagagagagagtgaggggggaagtgccacactttaaaaccatcagatcttgtgagacctcactcactatcatgagaataacaagggagaaatccacccccatgatccaatcacctcccaccaggcccttcctctaacatgtggggattacagtttgagatgagatttgaatggggacacagagccacaccatatcagacccataagcatgtggttacagatgaaggcacagtagctgtgaccaataggataggaaagtggatggcttaagaacagctgatgaacactgccccatacaaagctgactctcagattgtctcccacattatagcattacagctggtgcccatctgacaagagggagaggtgtgtgaagaaagcaggatgttgagagcagcgtgagccaaacagcaggacctcgggtcatggtttccccaatagggttgaattgaggaaaagaaacaaggctttctcccagctaagaaaagcttttagttgcctactaatttctgtgctttggggtttctttgactttgttttccctttacacatggtgaaattccttttgaaaataaattcagccctgtcttaaccaaaaaaaaaaaaaaaaaaaaaaagactggtaaacctgtatggagatattacttgagttcctagaagccaggttttgttagtaaaaaattggataagtttgggtacttgggcagacagaaagttgaaaatctggggaaagactgttagcatgcagttgtgattacattaaatgttataaatgaatttttatcagaagctattgagatgctgctgagctgacttgaggtattccattgtctagaataatactctgcttaatttgcatgagaatcagttgaggcatttgtcaaaaatgcagattcctgccacagccccaggcaattctgagtcaccgggtatggagggggcatctgggctgtgcattttacatgagcatccaaaaatcatgctttgagaatgctgccctagacaactgatggaaagacagggaactttgttccagaatacatcctgtgttccttggaaattatattaactcctctcagccttagttttccctcatgtaatgtggataaggatacttaccctttccaaaatcagaggtcttagaaaagtattttaaaaaataaactggataaaagaggtaatgctagttacttagaataggaatttatgtgaataaaagtctatgtcttgggcttctgtaaactcacctctcaaccccagcatacagcacaagaatatggaaatagaaggaagtatgtatgcatatatgtgtataaatatgattgagattgtgtaggagcctgtcttagtccatttgtgctgctataacaaaattataataaaataccaccaactacatagcttatatacaacagaaacttatttctcacagttttggtggctgggaggcccaagaccaaggagctagctgactcagtgtctgatgaaggctcactttctcatagatggggcttttttgctatgtgtcctcctgtggtggaaggggcaaggcagctctctggggcctcttttataaggacactaattccattcatgaggactctgccctcatgacctaatcaccttccaaacaccctgcttcctgtcacatcacatatgaattttgggaggacacaaatgctcagaccataggagaaccttggaaagatttctagaaagtcaaacaatagatttttaagaagtctattttctaataagctattagttagtgcttattagaaaatagaatctgccaaagtaatgtaggaggagcatttatcaaggcagattgatagagacagctcagtagataaggcaaacaaatgttgaccagtgaattatattcataatatattttgtatttgtaatatattttgttcttatttagagaatgtactaattagggtaaagtatagctgctgtaacagagaaccaacaatctagtggctcaaataacaaagaagtttatttactgctcatgtagcaatcctggtatgagtagtcattgcctgatgagtaactttgctctgcatggtcattcggtgagaggttccttctatcttgttgccctgctgtcacgtaggacactgccatcatttactttgcagaagctggcttgtcacctggaaaagggacagagaacatggatcatcataaagctcagacctggaaatggcacatagaacttccattcacaaaccactagtgagcttaaaaacaccaggatgcctaagtgaaggggaggctggggaatgtagcctatcaaaatagccatacccaaccataactctattgttactgctgttgaagaacgggagaatggggttggtgactaactagcagtctctgccatgggaaggtatacagaactttgaaaatggagccaattactactttttatggcttcactaattggccagagctactactgtgctgtggagtatcagtgtttcctttgatgtgttgttcctagcctctctatgggcttatatctagcatcccaggtaaacctgagagttatcctgggcaatgtggatgctggtattccattttctcaattttagggttctcctcctgtatcctgtacaggtcatgagaaaagacttgttgagtcctatcctactgttaataaatgtgctgttgataggaaaatgttggcagaagtgccaatatgaatagtcttctagttgcttttctgatggttgtgacataatgaatctcaaatgtgacttttgtcatataattggaggctctgaacattaagaacattttcttaaggatcatccaggcagaaaatgagttcacaggtttttaacatttttactgatggttcccaaggctccacctgtcccttcattctattctatactgcctctttattggatttctcccccactgcaacgtgtgtgtgtgtgtgtgtgtgtgtgtgtgtgtgtgtctgtgtgtgtgaggagagagagacgagagagagaggagagagggagaagagagagagaagagagagacagaaagagaaaagattgacaatatatttcagaattcttaaggtttgctcctcattattctgtgatgtgcagtactattcataacagaaaggtctgataattagctgccttgggatgttctaaaggtgaagccactctcctgcaatgcatcttgcaagagagattagtgatgtagactggaggttggcatgtgacagagactgttaaggacaaaagcagattgataacagtgaaagctgctgcttggacaggttcatggatttagagagcgacctccccgccatgggaactggatccctatgaaactgtggcatgaactacaatgagatgaaattacctcagagaaaaatctgaaggcacatttgagggttgggacattgcttaggaagctgattaccaaagacaaaaacattcatgtgtatagtgggagaatgggagataggttactctttaaatagctagttggcattgtcattgaagtttgccttactggaaaaattatgcagctatttctcttttcagttttatacacatgcgcacacacacacacacacacacacacacacaccatatattctggggaagaggtgttttattttccttttgtgtcatgatttcatagacccttatattctctaagagatctgggctttcagccacattcccataggattctggaatttttccctctaccctcagcctgccccatcacccaagtgtgatttttgtgattcttgtgtttctctagtgtctcaccaactgtatttctaaagcttggtcagtgttccatcttggatttcttgttttgccacttgtgatggcaatttataataaaaccaagatatgacctgttttgtatccagcaatgaaacaagttggaatctgcctgtgatgtgcaatgtgccttcaatgaaggggcagctgtgatgtgaatggatcttgggggagagaaaggaccttaatttctcttctcttttcccatggatataaaactttgttatggtaaactaaacctctgatatcatatgcaaccgctggcattctagattgttttaatggccactccttattgcttcatgctaagcgttaccatctgtttctttcttaattataaatgcagcaggaattcacaattacatcagtaacggtggaaataaaatggagttagaggctttctacttaacacaaggcagccttcctctaatatttttcttctgttacaggcattggtcagagaggagactttttcagtggttttcttttccctctcttcagtatacttaccatgagaatgtcatgctataaattcagcaatttccttttaatgagagggagagctgtgtttattttctgtccatggagctggggatgtgtgggcagctctttctcacagtattggaaaccagtggtgtgactgtcctgctgttattggcctctgtttttgtgaaaacagatgagttataatagcccaatgacatgagtcatgtcatcccccagaggagagctgggagtggacatctaagaaactctggtagccagcctgcctgtctgtgaatatatgggaacatttatacagggaggtgatataaaagctgaagacatgtttaacccagattacttaggcttttatttttcattaagtggaaaaactaatcaaatttcagactcatgaaattttagtgctaaaagaaacccttataaatcaccttgatcaaagctgtagtgactgccctttcctttgtgtagtgctcgaccaggttgagcacgggatttggagtcagcagaacaggtttgattctgaagccaccaccatggactttgagtcctcttcactgagtttttagtgtcagttctctttatccatgacaggagacatgatgcttcttatgaagcctatgtttggattaaatgagagggaacaagtaaatcctagccattgtgtggccggtctgtggggtttttttccccttctttccattcacatttatgatagatgaagagatattggtccagagaggttaaatgccttgcccaatatgatacatctagttcagggtggacctgaagtagaagtagttttaaaactctatttcaaggcttttgcttactatgtcatatctagaccctttgctacctttctccatccttgtcaccattgtacaaggatatgtacttttgcacaatgaataaccacaatggttatcatgtgtatgatactttttaaatctgtaaagtaccttttaaaatgtatattcccatttaacatgaagtaggtgaaatagtgttataatcttttttttctctctctctttgagacggagtctcactctgtcgcccaggctggagtacagtggtgtgatgtcagctcactgcaagctccgcctcctgggttcatgccattctcctgcctcagcctcctgagtagctgggactacaggggcctgccaccacgcctggctaattttttgtatatttagtagagacggggtttcaccgtgttagccaggatggtcttgatctcctgacctcatgatctgcctgccttggcctcccaaagtgctgggattacaggcgtgagccaccgcgcccggctgaagtagtgttataatcttatccttcctcttattttaagttggaaattctgaaaggtcaagtatcttgttgaagtcacacagaaggctgagtcaggacttgaaccaggtttttaagactttccatatatgggcttcactctatactagatggactcttactgttacaccagtacatgtaggagaggactgaaagatgcagtaaaaagaaatcgatattattatctataatttaatagttgtagttaggactttttatgatgtgaatactataagaccaaaaccattttcttgaattatattaatattttagcgatccacgtgctttttacccaccagaaggttcccctgggtaagtaaagaggtggagcaggagagagcaggtttgcaccgaaagtagttacaaaacaaaacaaaacatataagacatcaaccacaagaagcccttgctccaaaatgcaaatgacttatttgctacttcaaaaatgcacctcatcaatgaagggatcatttgatcatttgttcctgccaagtttatgtttagtccaggaagggtcaggctggtgcatattctcacccaggggtctgagagcacagtggcaggtgtgaaaagagtctttgggccttgcacttgccttttcatgccaatgccctcatccaaataagaagtcccctttgcactttcccagcttctaggccatatgttatgtctgtttcttagagggtgattcaatgattcctggtgataatgacatcacactgagttttacttacatcctgtttctcttgtataatgcccatgctcctcttgtcatgcggtcctgagccatcagggcccactctataaagcttcctgaaaatcaggccttcctggcaacaaaactaaatcttttaatctcagaaaccctactactgaccatgtatagaaaaccatgcaaatttaaagaatgtaaatattgacattctcaggttttcccatgtaacctgatttagtctgatttccctattatttctgccatttctgtgggcattttactgaagccaggttttataaagcagcccagaagcagcatcgttcataaggtaagggcacaggctgtagtatcggccagacctttggtcgagttctggctgtgcagcttgactgtgtgatgtcaagtaagttctcagagcctccctttccccatctgtaaagtgatgataacggtgcccacccattagctggtgctgtgaggatcggatgagctaccgcatgcaaagtgcttaattacaggacaatgttttgcctttctgaccccccagaaccagatgaatgattcatttgtgatgtttttctcttattaggaagctttagctggacaaaggtcattcaggattattttaacatatgaaatgcatttgttttattgaaagagattagaaatgttattttgaaagttttataccttactttagaagtcaagtcttataacattagtaggttttcacttcaggttactttcatgttctgtcttttcactgtgagcaaggtggtaagaaagccattctttctattgtcttgtatgcgaatgtgaatatatcctctatgtgccaaatacaacttcgtgagcatattgtttgttttaatgtagccttttaatgtcagaaaaaaagtctcaaagttctagtataataataatgattaaaatgcttattaaagagcacattaaaagataaggctattttgaggactcaggggcatataaacaggttattattttttcatagatgtattaaatcagacatgtgctagccaaatgtctgaccttatataggttttcttcagagttttacagaaataatgctaaaataaaggaatgtgaattcctttgccagttctttgaaggaaatggtagagtctgacctacctcgaaggagtattaagagaaacaacctggttatattgctggaggcttagagtctttaaatagtctcagagatcaaatctccctcggctacatagaatgattccatacgctttcttctgaaacttcctctctatctctaaatggggccattttgagcccctcatgaggaggcgcagtggaagaaaaatgttctgctgagcagaatctgcaagccatgccacatgcagacatctcatctgataatgacattctcactctgtagaggccaggaccaactgtgttatcctctttctcctgctcctctcctcccacctcacacatgcacaagcacctgtcaaccaacatcctcataccccttcttctcttagaaaggaggggcttcaaataatattctagggggaaaggtcccatgactctctgataagaagaggaatcctttaattctactaaacatgcaaaagcattgagcaagcaattaggcaaccatgtatatagctccagatgtcccatacatatggacaattgtccacactgctggtggggctggcagcattttaaaaactggttacaacacatatggtcctttgctttttgctctggcatctgaagtcttgctaatccaaacacatcatcgctgtggtacttccagcacagtaaatacctatctgctctcaagttacaaatgcggtgtgcttccctagctcaaggttgtgggtaaattaattcttaaatgaaagtgagaggcagggagctttgcaaagagaagaagcatgttaggtgtaggaagaggaaattaaatggattggactctcctctatcttttcagtgttttggccctccacccattaaaagctttcaagctttattggatgatagtttctaattccccttctagccaaggctccaaggtatgatttcaggatggagagtaaattctttgtgtttcccatctctcagaaaaattgcttatcagctaaagttttcgaagagtcagtttatgggaagctattttggttgtctagctacttatgttatcattattcagtctaaagtcttgcctattgctgaaaactttatgcaaaacaagatattgtggttatttatttcttagccattgctttgttgtttacacacccacataattaccttgaacaccacaggaaaaaaattgcaaaataatatttcctaaacacactttgggtttacaaagtgattataaatggcttttaaagaaagtaattcttgttcatttcattgtattcaagcttctctacttaattgtgctgtgtgtgttggaggattgtggtggtaagttgagatatgtagacaaaacagattttgtcatttttttcagtagacaaaattataatagtgtggagatactgtcattttaaaattaatctgaaaaacatttattgagtactttcaatatgtcatcagacaacttcacctgtctttgcgtatgaagtttttgtttgtgttttgcttcgattagttttgtaaaaggagacagcaacccaaggactttatagctataaaaaggcaagggtggttactacaagctaaatatgagaaaaaaacagttttgattcattccttgaatgcctccatcacagagcagtttttagcaatggaagtaagattgtgaaaggaaaagaacagggccctttacagagctccaggaatccttttgtggtactttcagcaagtattggtggtagaaaattaatagatataataaacactgtgaggttggctggcattttatctatcccttgaacaggtttaggaaatataattgacttgtgtccacaaatctgaaatacaatttttttgtgtgtaatagtaattttccctgcagctttggcattcttttttccattaaacgtctcagttttcagtgaggggaatacatccttggtcctactttgtcattttgggatgatttattttaaaattacagtaagggactttgttcggaattccactaggctaatttcaaacccagtttgctgactccaactcgccataatgttccccacctccagcacaccgaacaggaagtggcatactcagatgccaggaacaaggcgattgctcagatggaataacacttggcagtttggaaaaatttgttgatgtaagctgaaattgtaggttagatactgacttgtgggatacatttctgccaattatggtccattgtacagtcaaaaatgggaaaaattacttactgcagctggctttttggcattgaaatcactgatggaataatcagagggaaatcttctaagttatcataaaagatggattgtgacacaggatgtcagtttccagggttatccgttttacctgcctcacatgactggaaagctttttgtttaaggaaagaatcaaagagccagagaactgttgagcactccttgacactgacttgcccaatgataactgattcctacaactagccttcctgtcctgctacttcaggggcctatgtttttaagagctgcagccttgggaagattttttttccgtgcctctcctgtgtccaaagctcctgaagcatctgtaacttcctattccaggagtgtacacattctgtaactagaagcctacagctgtaatgctgaacaccaaaataactacagttgatcactggaaacatgcctaaggctgaacataatttttcattttcattcatggatttgtacatattctaaaaaaaagttcactctgaaaataatatttgcataaaaggaaataagagaaaacatactacccacccatgtagagcaaatgagctacatctctttattgatgaattttaagtcatttgggtttttccatacttatttctcattgaatgctccttttccagaagacctcacagttgtctgactgtgtcctccatcacagtcctcccagtattcaggacagatcttaggattcctctcttgagggtcacgtatccctgctttgtaattcacctcctctgtcctctatttcaggatgctcggctctaaatacactgcttgcctcaaccttccctttggattgtaagttccttaaaggaacttaggcagccgatgtttcagcctccccagaatctgcctcctctttttctggaaatagtaccttaattactcaagagaacctcctctcccactttgcatacaggccaagtggcatcccaattaagattttcttctcgtttctgcctggaggtgatcacatgattcagttgaggctatccagattatctctgccctgagaatttgagctttgagtagaatccctgtaagaatggaaaagagagagatctgattcctcttaggagagttttctgaagagaaggcaggatatcctgctgcttgccttgacttgcctacttcccttcctttataagccccggttgagtagcttcactttagagtatgcgagttgacgcatatcttgccaatacatcttttaattttgtcccagttggcccaaattggttggtttttgttgacaaagtatcctaatacagcctccatcttccagttcctatttatgtgtcatgatgatctgaagcatttcaaaagaatagtgaaggttattgcataagattcagaaagttccagtattcaatgggatcatagatatgaattaaaccaaaaaatattctttattatacaactttatttcttcccagagttttagaaatgtgtgagtttaaaatggagagttcgagcaggaaataactggaaattcatgaccattatctttaaaaatgattttttaaaaattttagaatagttttaaatttactgaatttttgtaaaatagtacagagtttccatatagcccacacccagttctcccactattaacattttacatcagtatggtagatttgtcacaattaatgaacaaatattgaatatttttaactgaagtccatagcttatttagattcctctgtttttccttaatatccttttcctgttccaggatcttatacagggtaccacactacatttgaagtcacatcctttaggctccttttggtgtgatagtttcttagaattttcttgtttttgatggcctttacagtttggaagagcatggtcagatattttgtaccatgcttccgattgagatttgtcatatgtttttcaaaagtttagactggggtaatgtgttttagggaggaagaccacagaggtaaattgccattctcatcatcacatcaagggtgcaaactatcaaaatgcttattgctgttgatggtaactttgatcacctggctgaggtagtgttcatcagggttctctttcttttttttcctccttttacacattgcactctttggaaggaaatcactacactgtgtgtagcccacactaaagagttgtaaggtgagagacagacaggtacaaagaaagaggcagttattaattccaggatttaaaaaaacaagatggcattatactccacctctttaagggtgtagtttgtatatatatattatccataattcttccacacaggagatttatctattttccttttttattttatagcttatttatattaatgtagatacatgaatacttattctataagtactggttataatctagtactagtttatttattatgttgctcaaattgttacagccttggccatggccattgggaactctttcagtggctcttgtgtccctttggcatactcccattgttgtggggttttttggtttttggtcttttttagcccttccttactttctggcaacacaaaatgctcttggcttatctctcatacttcctgctccagtcctagaatcagccatttctccaaggaaccctggttctttttagtggagaatggcattaaaaatatgtatctggtgttagttatgctcattacacctagagtgtcattgcttctaggtcttctcagctgaaagaacaagaagatgtatgtgtgtatactaacccatctgtatacacatatctataagtatttctctgtgtaatcatttgtatctattaagataaacatgaacacatactgatatctccaactctaatctttcaccacattctaactttgtcctcttgcttttctgtaagatcccaatagtgaaaatctggttcccttcacccaccattcattgtccagttccagcatagatgtattgtttcagaattgttaactcatactcctgtggagaacagctgtatcaactagagtacagtgcttatagtgcagttactgttacctttagccgtatagagtgtactcttagtgtaccttattccaaccccctgcagtgacgttgtttcatactgttctctttaaaattatgttttaaatttatccaggggataatgcatagctaaagatgacaattcgtgctgataggcttataataaaaactagcagcccctttctctcactccttgtgcacctttacctgttccccaagaacaacactttcaactcttttagctgttcacatcaatttgtctaaaatctaaataatgtactttacagcttgagatatcaattttaaacattatacattgatttcctattattgtaggtaaggatttagctttattgtacctcctttccctgacctatttctttacaacatagttatttcacattttttattaaatcaacatttagtgtttacattgctttcctgtttgtttttttaaatcctgggaccaataattgactctttctttgtacccatttctcaccctataagacttttcccacatgatcaaacttaccagacagtatccagtttcttcttactcctagttcttacttcccaggaccctctgtttactcaggctgcttcattgagtgtatttatgcatagctaggaatagggctgctggtgtctgggaactgaatggggaaggagactaggtgggtggggggttctcattgtcttctatgtaggctttcatttcacctccttgttcttagattgatgtctcacctcacctcaccttccactgtgcccaggtcactaagtcacaagcctttctgagtcacttacagtgagactgatactactatctcctggcattggaaggatgtgggtttcagttgcctcattgggcatgaagggcttagggacctaagggtgtatatgcttttcatactgctttctaaaaaactttctgctttcaaccctatgacttaccctgctttagtggtatgtggtacctctaattcctgcaccttcctaaggttcttcgcagtaatgcatttgtttctctcaggtataccctaagattgccccatgggtacataagttactctagctttactgtgctgagtcagtaagaattcctgtatctgcttgacatcttcattttgtgtggttcagtgttacagatgtctttcgcctttttttttgtgctgttggttgttgtgagaggtgattgtggaaagaaaagggtgtgccaagttaaacctgaagtcccatacctggtctacattttgtatgaccacactaaactcagctcatgcgacctctttggagaaggtactcctgaatcttccaaagtaagtttctttgtctttggcttccacgtcattctgtctgtggcacatgccatactcttgtcattttccccactagacaataaacacatctagggcaggaatcatatctaactaactaacgtatgtgtactgtgaactctgtgctgctgactctactagatatcctcaatgtgtacttacttaaatctaagaatttgctacattaattgtaaactaaaacctctgagatatattatgttgctcaggtaccatctgagaagttatgtgtcaatgttgggctgaaactagaatttcacgttttaaagccttaaactggttttatgtcccacaactatgcggcccctggaaggtattcttgtgtgacctagaaaagattggaagaaattgaggatacttcaattagggaggttccccaaataacttgatttttctaattagatagagatatctttcatatttaaaattttatttctgtgcagatttgctgtgactttggtgtggcctaatctttagcagtaatcactttatcagtgaaatttaacttagaagtccagttagggttaagataaaaaggccacatgaggtaacaaatgagaatatgtactctggagttatacagatctgagtttgaactttagctccttcacttaccaaataaataagtcatcaacttctttcagcctcaattcatctatgttaaaattgggataatagcaatacaaacattattggtctgtatgaagattaaacaatataaaatatgtaaaacagcataatgcctggtatgtggtaagctttcaataagtgttaccttcatttgttatatatatcatgacagttaatacaatgctgagcgaatatttgatgattgtctgaaataacttgaaaaagtttagtgaaaaaattgggggatggaggggttgggaactgggcacagacaattcagccatctaaggaagcagtggcactttcttcactgagccctattaaattgaaagattgtgttctagcaccagggaagagtagctatatgaatcatttcttatgatctaaagtccattagctactccatttagctgttaatgttgcgaggccattggcggaaataaatatgttatttggtaatggacttgttttcttaacaattataatatattctttccaaatgctgtaatttaattctgccattgtgctaattagtcagccgatcagccttcagcattgtttcaatatcccacccaccacatttttatattaaagctcatttaattggtgttgtgggttgaattctgttcctccccaaattcacacataccctaacccctagtacctcagaaggtgatcgtatttagagatatttcatcttgaaaagattaaaattaggccattaagctattagggtggggtctgcttcaatgtgacttatcagaagaagaaatttggacacacaaagggacactaggggcatgcagagggggaccaccttgtgaagagacagagaacaggcggccatctgcaagccacagaaagagacctcagaagaaatcagccctgccaacagtttgatcttcaacttgaagcctccaaactgtgagaaatacatttctgttgtttaagccaccctgtctgtgggattttgttacagcagctaagcaaactaatgtggttggcattgaggagcaaaatttagactggaatttctgatttattttattctgtatagcttataaagcacttatcacacacgccatttgaacttcacccaatcctataaagtaagtgttattattaactcccgttttacagatgaagccattgaggctctgagagtctacacaaacacatagctgctcagggggcaggtggaaattgaacctgggctatttgatttcaatccccctttctttttatgtttctcatttctctccccctttactgtgaatgtagagcatgcacctgttcttttctattgcagttcattcatttgtgcaactgacaggttaccactggtgactgtggattgctgcctaatgctgggctgaagaaaacaacaaatttgccaatctcaaaagagagcatttttatttattgctcagcttccagaacctaatgcctttcaattttctgtcattgttccactgaaagtgaagaatgtaatgttgatatacctcttgttttttctgcttttatgccactccatgtggttagaccaccttttaggtgttcattcattccacaaatatatactgagcacctgttttgagccccgagtttggatgtcatgtttttgaggcaggagttaatgtgctcagcatgaagagctgggtctgcacagaaaactgctgcttcttgagccagggaggtcttcccatgatactatattgcagcttctttgctgtaatgaaaatacagtacacctttccccaactcccaaattaagctttcagtgttcttcattctctgaaaaacttttatagaaattctaagaagtgtgcctcaaaataatatagtaagcaacctgatattactggttttatataatcttagtgcactatcttattcataattaaagttacaacggtgactatgtggaagtatcttggaggagaaagtgaatagatgaggtggggggacatttgagtaataactttgattttggatgtcttctctactatttttagattataatttaaataagttcatgtgtattatattatttcaccaaaaattttactttaagatatggagaatgctccatttttccccgtaagagtagcaataatttttaaaattgtcttttaaaattagattaaattacttaattccagagacctgtgttgttcttgtgtgacaacacagagtatgcaactttaagttactggccgtctaattaaaaagatgtttccaaagtatgaccagcattggaatttgttcagacccatatttataaacagtaactatgacaactcattcctcccaaccatgctcaacccctcatactttcccaactgtctgttttacaagatgacataagtagagggtttggaaaaaagaaaaaaaaatctttggatgataaacgctttttgcaaacagagcctataaagctgtttgttcagcagcatgtgaatcggacagtgggagttcatcagacagcaaggattaaccccctaatttgtttctctcttttggaagagaacagactgctgtgaattccgtgtactcagcctgagctgccaaacatgattgaaaactatttgactgactggtggccaaaacatgaggcagggaccattcatcattttcctgctcttcactaccccatataataagttttgttttgtttgaaaggagtaaatgtatgttacagttttcaaaccaatgtctccgacaacctaaaagcatttcaatattgtacccttttccaatagaatggaaagatgctacatatctgtagcaattttaaccaaattccttctagttacctccatttccaatgcagaaactcctctcaagtgaatacatacacaggttataatatacttgatgagccagtttctttaggatgagtacatacatgactggttttgatttgaccattgtggtgtgcagtgggcttactgtgtccataccagtgtcagaatagtcagtcctctggtgcttgattgggtggcatagcccataagattagctgacttttaaaatcaaagtaataggaggactatgcaatggagacaactcctcaacattgacccatcccctcagtccagttccatatgttccattgggaattaatttcctgcaggcatagaggagtcgtaagagttgcctctgccagagaagccccatctttccttgagccaggagtcagtagaagatagtaggctacaaaccatttgactatacctctatgatctcttgccactgaatatagaaaaggagtataaagaagcagtataaaatatgaaattgaattgtcagtggctagatagttagacatatagtctgggtattcaaagggagtgccttttaaaaatgtgctcaacccccattagcccatgaaatgcctcctttccgttcctacactggcatatctttcaccagaagcatttaaccagattctagaacctgtccattgggaataatttagtcaccttcttcaacttatttttctctttttcccctctcaaatgtcattttttttcacatggctccagtctcaattctcctcttattttatccattgtccccagtaacacactcttctttgtccatctagtcatacatcaatccacctatctattcatccaatcaactattattgagccccaattacatgcatgtgaagcatattctcaaagcaccatttccctggccaagctaggatgataatgagagataagatgctctgtttcagtttggttattcaaagcagaccctataataaggaattgggagcaagtagtttatttgttaggtaattccaggaagcaacagtgaggtaaagaaggagaggaaagggggaaaaaaaacaacaaaataataaaggtgcattaagatgtgagaaactgcttataggcaactgggtttagtcctgctgggaattttttgagaaactttgtagaacgtgcctcagaattgtgcccctgaaggatgagaaagctgagatgtttatccatttacttcagtcctcactggctaagagttatcttgggggcattaaatccctggcattttcaggatgccctcccagtaggctttgcaagccttagtactggagagagccttcaggcagaaaagcagaagacaagggcatgcatagtttctgttcacctaggctgcaggtgaactcaaaagtggatgcagaggttttggttggggtgggggtaggggtgatggtggtgattccatagcatctgcttcaacctctgtgttaccacccccaactgccttaaatggaagcatatcagagtttttcattttctggtaaagagtaccagggtgggcatttactctatgtaatgtgcagaaacacagcactgtgtttagaattggacttactcatttcctgagtatatgtatagcttccctttctctacaacctcttttcagcagatttatgcagacaagaaaaatattgtaacccaaagcgccactgcaaatttccctgtgctgacattaatcatgcccatttgatttattatctatcatttgaaaagaatattttgcaactcttgtgcattgatttttttttaccaagaatgattacatccatgcagcataactcttctaaaggctaatgcagtttgcttttatcacccattcactccctaattatggtgttttcgaaagcagacactatacctggaaagttgggagagaaatatttgattcacccatctttcagagaagaggagatggatttaaaccaggctagatactgtaactgattattgagtatttggcttggggggcttaatttaccagctaccattgaattaattgaaatataaacttctgtggatattaatactttcaagagtcaaagtttaaatgccatctactttggatccgttcaaaatattttcactaaccctttataatttaattgactttttaacttttttgttctgttttgttttaacacagcgatctacccttttatgtaaccccttctgctccacatatcactgggctggggccaaaagtaactgagtgactaatatctgggaaatatttattgaatgagtgaaagaaatccacttgggatttatacccaagaacaaatgctcattaactgtaaattctccttcttttgaggttcatatatagatgctctatatgtgtttatcaaacacctatcaggttatgaaaagaatgcaagaatgcctctcttttctctccatttatccaaatctatcatttaaggccctggcataatttctccttctttaatgaagctgcttcaatttcttccaattcagtgcttcatatacttggctgcagttggggagctgtaaaaaatcctgttgactaggctacaccctagaaccctagatgatttaaaccagagcctttgggtgtggaattcaggcctctgctttttttttttttttgagacagagtctcactccatcccccaggctggagtgcattggtgtgatcttggctcactgcaaccccgtctcctaggctcaagcgattctcgtgtctcagcctcctgagtagttgggattataggtgcctgtcaccacacccagctaatatttgtatttttagtagaaacagggttttgccaggttagccaggctggtctcgacctcctgacctcaagtgatctgcccgccttggcctcccaaagtgctgggattacaggcatgagccaccgtgcctggcaaggcctctgcacttttttttttttttgagacggagtcttgctctgtcgccaggctggagtgcagtggcgcgatctcagctcactgcaacctctgcttcttgggttcaagtgattcccctgcttcagcctcctgagtagctgggactacaggtgtgcaccacaacgcccagctaattttttgtattttagtagagatggggtttcaacatgttagccaggatggtctcaatctcctgacctcgtgatctgcccgccttggcctcccaaagtgctgatattacaggcatgagccaccgcgcccggctggcatctgcatttttaaaagctcaagttattacaatgtgcagccaaggttgagaacaccactgtacctggatgtgattgctctcttctctgaaaacctaggaaacctcgatattaaaagccacctcttaaggacagttgtaattggcctagtattctggcttaagttactctgaagatcaactagcctaaccacccttccaattccaagatacctctgacagccttctggttgtccagttcaaatccttaatactgacatggaacttattcccagtgcagccttgcccatctttgggcagctctgaccagtccagatataagtctgtctctttgtagcttcaagctattcttcctgtctctatcactttggggtggggctgggagtgagggaatctttctaacaagtgttttaaatgtctgaataatctatttattcaataaacgtttatggaatgcctcctatgtattggacactgggctacctcattgaaaagcgatgtacaaattcctaggaggatttgcaagccagtcctcctttcttctttttcttcttcttcctcttcctcttcctcttcctcttcctcttcctcttcttcttcttcttcttcttcttcttcttcttcttcttcttcttctcctccttctccttcttcttcttctccttctccttctccctattcttcttcttcttcttctctttttattgtactttaagttctggggtacatgtgcagaacgtccaggtttattacataggtatacacgtgccatggtggtttgctgcacccatcaacctgtcatctacattaggtatttctcctaatgctatccctcctctagcccccaagccccggagaggccccagtgtgtgatgttcccctccctgtgtccatgtgttctcattgttcaactcccactcatgagtgagaacttgcattctgtttgttgttattttgttattaagctgccacatttctgacataaaagaatatctttggctgcaatagtgaaagagaaaatgggcgtaagctgcaacatgagaaatttaggtagcagagcgatgactattaaactttgagaagttttctgtttaacgttgtgaaatctttccttgaagctttaaatatgacatactttcatgtgattctatttatatactgccttgagggcagagggcaatgccctgtgttccttctgagggttccttctgagtgactctaagtctctagatgaggtagccctgaggaagcaagaatgaatgattaagatacttcctgatgatgtttttaggggaaagataaacaaggttgcttcccctgctggctggtgttccccatcgtgcatgcatccagatgaggtctccaaggaaaatcttggtccagcaatgcttgactgtgccagttccctgatgctgatggctttgctgggaaacaaagcacattaagggtggatctaggtcactctggacttcatacctttccaaggcaaggaaaggccaagccccaggggctccattcacattattgtgctcctgaggggttgcgctcctagacttcatcagtgtcactggaaatgatacctcccacagtcatttaatgaggtagtcctgggcatatagcacagtggagataggcaccttgtcaaacaactggtgctgcagaagtgctgaaaaccctatgctgtctcattggagggaaggtaaggggtctcagagactctctcctaggaattagaacatggttccacttactccaacctagaaacacatcagagaggaattttatactccaggaaccaagctaactaagatgtttccaccacctttttttgcctgcttagatttcagatccttctttctttctaatacaccaagccctgagatgacatgggttccttctaatctcagagtgtgaaattttctctctggaatttaattctggtttattcctccaccttgccctgctttatcctgtggcatatgtgatgccacaatgcagttgtgacttccctggatgcatcagcgttaaagcagacacaagcactgaaaatatgcagggccagaccagcaggtcccgtacagctgaagttcatcatggtgttttacaaccaaccaattactcaattcattttatgggttgactgtgcccatcttttactctcatgaagcattttctatcgtaagacagaaagcgagggaaaagtgctctttcagttccaaaccctggggcatttatgcactaataaccttcctcctttgtgcttttccaaagaatgtaaaccaaagcaattaaattaaatggagttaacattggcatggtagcataaatcaaacgtcaggaaattcattattaaggggttatcgttcctttcttatgagctatctagtatctgccttctctgaggtaaaaataagccaaaaatttggtcctgatataaatgaggggactgcatgagagagagacagacagggagagagagaccttgtgtttagcagcagataggcagacttgtgatttgtgggcgaaacatgtttatcagatgcttgtctctttgcctcttaatcaggttcttcttcccatggcatgctaagcaggcaaacacagttaagcagtttacctctgtactcaacagttccagaactgaaagtaaacagccttgtgtgtttaggctgcagccaccgggctgtgctctgtagagctgccagatttctccacatcactgattctcccagtgaaaagcaaaggcttcctcttcattgtgttcacagactgaaagttgcttgcaggattggcttccgaagttcagaccctgatgaaggaaaatgatactccgagtctgagggtggcaaatcagaagaaataatttgtttggattcgggtctgattttaatttcaggagtctggggcctgaaagctttctgctgagtctgaacacaaaccccaaacttctcaactcaggttgcttttaaggaattgtaaactatttaaaacctatatatttaaaaaattataatttattcccaatgagaggatcctctccccagccaacgtctattttgcacatgactttctaatgaactgttaacaagcatttatattaagagcttgctcgggcttttgaatgatggaagataattctgatttacatgagtgatagtttaaaattccaggtgctttatttctgtttattggggtgggacaggggaaggactaaaactgcctacaaagaccctttcaaaggcaaaggaatagaatgtataacattccattttgtcagcatgaggaaggtcttatttaagactctctgaacagatgtgaccaattgtattggtgaggaggaatgttggaagataagatgttctgctctgtttgaatgtgtatttttagcagtgtcctattgtaaagaagttatgcccattatcttttgacttgctttatcagattaaacaaagatgctcatctttctaggctttctaatatgctccctcaatgcaagtctctcagctccaatgctgtgtgttagagtgtgataccccctcctgttactcctatttggctgaatttcagaaatccatttagatactctcacggttttgttcagcattgctcaaaacatggcttctcaccaattctgactgtctctctgaaacatgattaattttttctatgtctatctttacactgtagagtttaggttgaaaatatacttttactgtagtctcttattttcaggaatgtgtacgtaagcacccaaatgaattctactctgagatacaattacccatgtatgcttccaactgaaagcatccactgaaaaaatatagatagagaattcagtagctctgactgttagagcatctcagtaggcaaaagtttccttacagtaattgctatgctttggaaacagcattttctgtgtactaagaactcaagggagagctgtgttcaggtcaaagcttgggtgaggtataataagaaagaaccccagctggagcagtgaaaaaaccaagaggcgagaattttgtcctctctgaacttctcggttagaagattaagagggagatataggttccctgagacatattcagaaactataggggtttctatggcaacagaaatgaaaaatgaaaatacagtctcatcttctcttgttaagatccctcagtttcacatgagcccaagatcaaggagtcaaatacagagaaagtcacagagcaaagagggagccatgtttcttttcgtccagcagatggctagcaacaagaactgcttagaagaccttcacttgttgaggaattgagagaactgttgaatttccttttttccaggtgatttttgggaaagattgaaaagttaatccaaagagttggttgagatagagcatttatctcacttggtagctcccccagtggaattgaagtccacagaattgctgtctcagaagtttcattctttggttagctgtttccaaagtgtaagtgagtccttcacaaacatgattaccaaaagtaataaataaatacatatctggcagtgaggatgattttttttggagatttttagttttaaaccacgtattttactggaagtataatgcacccatttcccagtggttacatggaaagacttcgttcctcttctggttctcccagcaatgacttttcagtcactgaagaattcagaggacaatgacaactcccttcacaggatcatacagacacctgtcatttgaatgcctgggaaaaggataggaatggagatgtatctggttggactccaagataaggaaaaacttttgatgggcaattggaatgtcagcagatttatatctccttgaacttgggtctgtcaacactgccatgagaaggaagatgtttttcccacagagagacatttatggggcaaagacagacatcagtgtgctaaatcttataaaattcctttgcatcatccaccttgacagatggtcttcaggaatgtgctgaacctccaaaacagagggttgggaggaaactcaagagtgttcttcccctgtcttctgtcaatgactacgacacactgaaggccacattgaccttccatcaaacatacatgcaggcttcaagccacccttccttcttccccgtaagggacaggttgaagcaaagatcatgctattaggtattaggtaacaagcctccacttacagagtatcctagggatgaaaacctttttgccttatagccatgctagcttcaaacatgagataggtaaaatcgttttgttttcaactttctttccatttacttccctttaacttttctattatgccacaaaggacaagtatgtgttttccttataaaaagaagttttggcaaaaaatgaagttttggtcctatagttcatagtggccccagaaaaaattgccttactatttccacaacaccattgcttgttttttgtttttgtttttttatatagtcccacactttcttttgctcctgtttcatttactaacttggaatgctcacgctcctgggcctgatacactcctaggatcacctaggctgggtgaagcttggccttcagaggagtagacagagcaggaaggatgaccactatggtcttagcttcctttagtatgacttccctttcttcagctggagtcccttccctaaacacctgcagccatcctgtggctttgcatagtggagcccagggactaacacgacagtggtctgagtgtctcagacttcgagactattgctttctcctctgttccaatctccaaaaagagttctatgagaataattgcccaaagagaaggtacttcatttggtagggctgggaaaagaggcatcagatagcatcttgatatggtgaaagatttgaacagacaaagatctatctggtgctagtttagttgccttgaatcatcattacagatccctctggactatttccctttagccaatcagcaacttccccagggagaaacttgagatcttttattctagatttctggatccctaacttgttccaatgttcctttctttttaaaattatttttagttttcaatttaaaattttttcaaacatattttttaaaaatgcagaaaatcagagaaagggcagcatgtatatattcactacccagattgaacggttgttaacactttgctatgttttcatcagataacttgggaagaaaggaaggaaggaaggaaggaaggaaatagtgcaaatatagttgaagttttactcagtatttcctgctctcttccctttcttccctatataatttacttaaaagtttgtatatattattcctatgtgcattttgattatttttattacatatacatgttctcataaaccacatagttattgatttttaatattataactttaaacaagcagcatcataaagtatgtatcctttttcaacttgatttttattcaacattattattacatttttaaagactcatccacattgatatatctagctctagttcatccattttaattatacgaactagagttcgttaaatggtatagttgctctaaatgccactttactatacaaagctgattatgtttcttgcctactcataacaacccagccccaaactgcctttccagtcatcgtgaattacatgttcttggaccctttccccttggtcctcctgtctttcaaaagatgtgctacattatgtgatgaattaattgtctgtgctttgaccccagtgagtacaaacagctttgtgagcagcctctttcaggtaagagagttcatttgagatatgagattttgtttgttcaccattatctttccagcatctaggagagtgcttgattcttaataggtgtgcaatagatatttgttggacaaatgtctgcatgagtgagtagacggctgtggaattgggtttaatgctgtgattccaatgcatataataaggaattaagttctttcctaaaatactcacatcacactctagcaaccattggcttcttgctagttgatttattctctaagaattgccacaatagattaaagagatgatgtttgtcaactctttcagatggtagaatccttgcttgcctcagagaggaccactgaatgtttgcaaagaactaccacaagccctcaccatggggaattggtgatttgaaaggcctggcagatgttacactcttttgccatctgtctcttggaagtagcttcaatttggctttcagtaggccccagcaaggtcatgaatatcagatttggtgagaaaacgccaagtgtgtagcttcagtcaaagggagacagcttttcccttatgctgctcttctcagcagcccaggcccatttgttcttcctctgtgtggaactggatgctccctcctgtagtaaatggttagagggtccagaatgaaatggaaagtggtcctgtatcatcagcagtagcttcttgtggactttgtcaccctcattcattcaacaattgtttactgaacaagtaattgacaagacattctaacaccgacaagttgtgtttaattcagaggaggagactgaacgctggtgtttccaaggcactaaataaatgctaaaacagggagaggaagcacacagggcagaggaacacttaggaggagcaccatactattctatggtgtggtggtcagcaaaagcttcctgggggaagtgaccttatctgtaaaatgaaatgggattaatacccatgttgcaagatggagccaatgtaaggtaatgtctttaagtttcctgctgcttgcttagtaatagcagtgatgaccatgtggtattgatggtgatgacagtgatagagaagaaaaaaaaatggcttcacaaccagatagtccggtttcaaatcctagctcttcttgtccttagctctgtggccttgagcaaatcacttggcttctctgtgcctcatctataaaatgcgaatagtgctacgtaccgctaccacaactgtaatgattgcagaaaatgttcacaaggaacctaacagtgcctagcacctggaaggcattcagtaagaggtgaaaatgcaacaggagcttgaagagaaggtagcagtaggagccatcagtggatatggagggaagagctctgcatgtggagtctagggacctagattctcatctgactatcactgagaagctgggtgcccttgggcatgtcatgtctggcattctctggagtctcccatcagtgcagagaggcccatccatgaatcaggtaatttttaagtgagagaaacacacaacaagcctaggattaaggatggtagagagattactgtgtgttgctatggcatgggaagactttgtggaggagaaagccctcgggctggatgctgaaggccaagtaggtgttagactgggggagctaagtgaagagggcattccaggcaggggcatgattgagcaaaaggggccaagtcacgcattaagtatgtcagccgcttccctcatctcctcacctctggggcagccttactcgtggagaagaatggataataggaaggtcttgacttcagctcagaagtttgtttctttgatagtcaggactggttctgggaaaattgtcaagtcattgaagttagtctgtgcgaccattcatcttaatgtgagcaacccacgttttttgcctgcacattgctgccacctgggctaaacaagccccccactcccaccccactttgcaagcctacaaaatatgccctgtagagcagctcctttttgattcttatttccaccctccaaagcatacccagaagcacagtatgtcaaagcttagagggagctcggagttcattattttaagcccccttattttattatgaagggccatacccaaagataagcacttacgggcagaaaaggaacagagacagatcatcacggtctcccagttgtgttctttcttccactatgcagcctacatttctctctaccatacattttgattacttaacctaggacatcaatacctatgtattaatcaggactcttgggattttaaacgtcaaacacctagagaaacttgtttgataagcagggaagttattggcttgtgtaactgaagagttttggtagggctgaatccaggtttccagaagatgtcaggtgtttgcctctccttcacaaggcttaacttttctcagtgtggcttcattctcaggcaagctgcctacaaatagtgtccaaaaggccttaatggcaacaggcttatatcctacaaatagtgtccaaaaggccttaatggcaacaggcgtatatcctaccatcttggcatcccaagaaacatagagaaatgtctctggcataggtcctagatagggttttcattaatttggcttgagacatgtgcctactttcattgtgatggggttatagaactgtgatagtcttaaactaggtcaggtacccaccactgaaaccaagactcaaggtcagtctcacccaaaccatggatgactgtggggaagaggaggttcccaagaggttaccaggtttctgtttccaaaagagagggaaatagatgttaagctagtatgtgttcactcacccacacatcaccctcacacaacccaccacaagctgataacagtttaaggtattgtattcctgatagcattagccttttgtgaaggactgtacgtgttttagttgagtataacatggaaatttggggtaccatggaaaggccagtgagggggttagagaaggtggagattttgtatttcagggttttttaggctccctcaaattatagcacaaaatatctactttgtggcatagcataaaatactttacttataaattctgtcctgatgatagccaggaactcagcctgagatgaaaaggtttccattagtgaaccacatgtagacaattgtaagttaatgctaattcattatcctcacacctgggctttccaaatttgtctacctcttttttttttcttaaccatgtattgcttatctttctcatgaacataaccaatgtcttatgagcccaagtcaagtagtgaacatcagataggaaattataattttgtgtatattctttccctcatttttgtggcctttttgtgtagttctcttgtgcctggagaaaactcagggtttgtgtgttaagaatgaagtgcttgcattccctcacccagatgcagtgcagcaatggggtacagtgggaccacattggaaggaggtaagattggtggcaggtagttaaaaggtagcattgtttactgtgggtctaatgcagtatttctggactgaatggaatggaagttttgcctaacatcttttagaaattgttttcaggtctgtttcaattcctaatgttcttttatataatttctgactcatttgcttaatggtttcatttgtgtttaaaaaagcaacatcaaaccttcattatttactttccgtgatgctttaaataccacagaattcagtaaggccatcaaagagacagagaggccaacattaaacattaatttttattactttggcaaagaattcttgagataattcagcacagaggaaccagtacaggtctctgatagctgtaccaagtgctgattaactcaacctcacaaaatctcttgcctgtcaacaattagtggaaacatacagaaatatctaaatatcccaaagatattggggagatatttggaaagtatatgaaaacatttagaaacatcagaagtttgaaaaacaaagttttccacatatatgaatgagactggggaagggagtatggtctgttttcttctcacaattttatcaccctggcagttattggtggagagaaggttctcagtaagcatatgacgtatctattactttatctttaccttgatttctccattcccatagctttaaaagtcattagaggagataaaacagggtcatttattttgtattgtcatatgtatggatttagcagcatgtgatatctttccttccttccttccttcctccctctctcctccctctctgggtattccctcctttccttcctccctttttctttccagtatttaatgactcctactctatgtcattgtctcttatgactgagagatgcataaggcttagtcttgccctcaaaaagcttacagttttttgagaggttacacacaagtaaatgggcaatttcaatatagtataataaatattatgatagaggaagtacacagtgcctttgggtcatttaaggagagcacttaaactcagggaatcaggaaagccttgtcaggggaagtgccatctaatctgagttttgaaggacaagttgagttagccagagctagttttctatggctgagtgggccagatgggaggagcctggacctgaatttaatctccctgctggggtaaggcaggtgtcggtggccacccccagcttcaggtgctcagatagagtccagtccagtagtcatagcatggtagccaaaggattttgccttgagttcataatcaagaaacgcctccaggccctggggagcaagagaggagatagtagtactggaagtctgccagaccttagaccttaggagagacacttgtatgaacatggtcaagtgaaattctagtgtctggagaccatgacacagctcagcctgcacagggcttgggacgtgagctttgtatgcacagtgcagtccaggatccagccgacagtccagttgttgcctatacccgcagtcaattgccatgttttttaggaagcctctgtcgagcgactctagaggtgtttctcccttccctcttattactaaaccttacagaagctaagcttgcttctaagatatcttttaggtttaatattcacaggattacagtgtctgcattccttagacgctcctatcatgctgtgctagtcgggcactgtgctaggcacagggaatgttgagataaaaggaagttggtttgttgtttaaactacccagattgtgcattgttaaaaattattatttttttggaactcttaaaattttgttttgcccaaaaaattacatgacactttcctcttagaaataagttagttatataatacagaaatgtaaaggccaaaacattaatattttccttctttaaattctagcttctttcaccagcgttaacaactgataaccttctcttgtgtatctttttagtccattttctatgcttgcatatccatatataattgtatcagttgagattccagtaggaaacagatggtacattcaaattagaataatttagaccgggtgtggtggcttatacctgtaattccagcactttggaaggccaaggtggaagaatcgcttgaggctaggagtttgaggctgcaatgaactagcatggtgccattacactccagtctaggtgacagagcaggaccctggtctctaaacaacaacagcaacaaaaccaaattaggataattgaggtttagtttaataaagggactatttatatgatgtagagagggtatagggaaagcacaggggatcatgattatcaaccctaaatctgaaggggcacagagaggaagtggtcatggaaacctggacacagaaagggtgctgcagaaaggaccctctaatgggcactgagacctgtgatggagggatgcagccagttcttagcaaccacaggaaaggggctgggaataaatgcactccttcctctctgcttctaagcgcccccattgactgaaccctatgggaagccaagggaacaagaaaacctattgatgtagtccatataggtcagcccccttagccagagagctgagtggagaaaggtggagagtggatcagaggggcaaacagaaggtctccagtacaaatacatacatagcatatagttttaggagcttttactttctgtgcttccttgttacagaaatgagattgtgctgtagtacgattctgggactttttgttaacacaatttgtcttgaagcctttttgcatcagtatgtatggatctaatttaattattttattcattggctgcttagtatttcgtcatacaaggtatctgaactttttaaaattatgtatatgtaatagttggtatatacaacagaatatgtaccacctatgtgagttatgaagcctagcaataaaacagtcatctgtaaatttatctctcaacctaagatcactaataccatcgaccttagtcaatcaaactacttgacctcagatcatcaggcaatcaggcattagttagaattacctaaggagcatgcatgtgcagttcacaatagggtttgggtttctatgagaatctaatgctgccactaatctaactgacaggaggcagagctcaggcagtaatgctcacttcctgttgtgcggccatattcctaacaggccacagactggtaccagtatgctagctgggggttggggacccctgctatacagtcttcctgtgtcccctcaccccgccaatgctagtctgaagttttttgtgttaattctcttatactttttaaaaatagtttttccatattatgagtatgttgaaacaatatattatatagttactttttaaaaagctttataaaattgccgttttagttgtacatagtcttttacaatttgcttttttaacatagcattcatattgcagtgtgcagctgtgcttcatttattttcatagcttataacactccattgtgtgaatatgccgcaattcacctctccattctactgttgatggacttttgggtcatttccagtttttgctgtttcaaacagtgctgcttatgaacatttttgtccgtgtctcctggcacatacatacaagagttgctctagggtatatacctaggagtggaatttctgggtcacgaggtttacacatacttggctttgctaggtaatgccaaattgttttcaatgggattatgccaatttacattcccattagaagtatgtaagaattctggttgttccttttcctccttagtgcatggtatttgcagaaggcttaactttttaccatcaatactcttttcagggataccaagcaaaaacttaatgagagtctgactctgttatcataataaatatttttctacttttctctgtaaaaatgattttctctttcttgccctattttttttgcctcattgttccctaagtttatgtcatctactaataaattatatttaaaaataattaatacattaaaacaaatctgccaaatgggcctttcaattctttccaactctaaaataaatgtaattctagtagaaatccatatacaaatcatggttcataaaactgaaggttaacattgctaccatatggagaagttagctcacatacaaaaagagaaaaccatcagttctccaaatatttctttttaccaaatttgactttaacagcaaactggattgtgtgtactcttgaaaggaatagtgctccatcttgctctccctctctttcttcatccttccttagttttgttctttctttctttgcttcttttatgtattcattcactgattcactaaaacccagtggagaagacaaatgaattattactgtgtagcctgcaaatgggatgatgaggaatggacagatgtcttttggagtgagagaaggaaacttgacttctgtatttcttgagttcacttcagttcttaagataaagtaggttctactgagtatttgctaaatgaatgaacaaatcaatactctaaaatgttttcagctttttactcattgtagtgtaggaagagctacatggagttgaatttctatcaactagcccatcttttattactggagttagtcttctttggtaatttaatactcagagtacctcatatgatctctttatcgatgccttcaggagacattaaacgttctatcaattaattatacttaaaaagaataccttttggattcattcaagcacttcatcttctttccccaaatcttgggaactggtgtcagctccttaaaatgagccagcatgctttttcaccctcccatataagtaagagcttgtaatcacccagtgtttctctgacctagaaaagctgagaaattcacataaatgaaaacacaggggcttacaaaattgctttcggccctctcccttagaagcatatctggcacttggtaactggctggatggaatgtgggtactacatggagtgccctggtgctgctgctgctgctgctgctgctaggcttatataactttgaaatcagaaagcagattcagtggggtaggggagaactgcttttaacaagctgctgggattggctgaacttgtgctggccttgcactcttactattataaacttgatgtctttctcatttgtaaactttatttgcatgccagagctcagctgaatttgcctgggttcctagtttctttaatcttttgtcctgactggcttgcatgtaaatcagcttcagactttcagctgcccatatattgccctagtttgcactctataaagagttctttctttgtaggctcctgtccaaagcatggcagtatgtcttaaaactgtacaatatggttactattagtagtaatgagttgttattgagtgtcagtatgaggttgagtagatggagcaaccaaggcagcttagaactgagggtttcccagctaacatgctgtggaaccctggaaaatttgccaagctcctccaggtctcctattccatcctgccagaggtgatgtttttctttcctgctaggtatgtcatgaatataactgagaaccatgattctaaaacaattagaatgaaactttgtgattttatttgatgagataagcactgttttcatatctttacatacatactgcgttgttaagtcctattgtcataaccatgaattaaatgtagtcatttttatatttttaaatatagcaatgcaagaaaactgaactgatagagtgataataaggcagataagtgaaagaggaaggtgtttagccattcaagctactgctgaaatagtgaatctctttaatggtaatatatgagctggaatgtttatccttatcctttcctctagagaagattaatttatttggcaatatctaaataactgagaatggtatattcctcattcataacttagagaaacaatttggctacttttgttggcagaacctgaaatagcattgcccttccaaagactgtttaacttgatttcacaagtaaaccacaaaatgcaattatttgatattttaccatatcccattcccttctttcatccccataatgcagggggctgagtttggatttgcaaaccttactccttagcctaagcccttacaattgtttgtatgtaatgccagatgcatgttaaggaaggaatcctatagaggcaggttacttggagcgaagttttcagggtggccagctctgcccagttgccttctttggtcccagcgagatttgtagttttggtttctctgtttgaggctgggttgggtgcagggaccaagcaaatgaaaaacagacccttggggtataaaagaggtgagacataggtcaaacaacctatggctcctctagctgatacagaagatccatcaccaacaacataggtttatggctcagtcccatgacctgggtggaatatccggagcagttctggaaatataccatccattataatcatctgagtgcttgattaaaatgtatattcctttaaacacaaacaacaaaaacaaaaacatgtagattcctgggacccatgctcagattctgattcactagatctggggcgggacccaggagtctgcactgatgcagatgtcacagacaattctgatgctggtgctctaagagccacacttggaaaaattcagtttagtgcctctttgtcattcttccctttggctccttgcctttatttcaggaaataactatgaatatgactttcaatgtcacctctaggagctgcagccagacattcctatgatgtacttatagctaatctagttgagctccatttgagaggattctagatatattacttactagagatctggctttctagaaggctcccactggatccaggtaatgtccagtggcttgaacgatagaaagctggagtcagcagctggccttccagacccatacaaatcctctttctttggaaagcctctagcacttcactgtaaaataacagataatcccaggccagaattttaattagaaaagctgaatgacctgtaagtaaattattaagaatttcaatatcagctaagatcaatggaacagaacagacagccctgaggtgcatctgtagatgcgtgtacacaataattaagtttgttataaagatcctatatactattttctctgtatgtaatggtgggacctattttcatacaatccatagatacaattgaaataatacaaataatacaaatcattgataactgactaccatgggtcaggccttgttctgcacgatttctatatattctgctaatactcataataagcagcactttaagtattattactcttctccttttatagttaagaaaccaaggcacagggaagctaagtaacttgcataatgttgcacagcaagaaagtagcaggctggtcctcttggtttatttaagttaaaatgaaataatggaggaaattaggaatctgaagaaacctccattttcaaaagagtagaaaaatagatacctgaagggcatcgtggggtcataacataacaactgtgagaagtgttgtagctttttgtatgtttgtgaaatttttcaaaaatgtgtctaggtacagtagttgaagcttctaatgcatattggggttaattccaggactcttatcgtcactcagggtttgacaaagtaatagttatttgtattactaaaccttttaggctggaaggttttgtacattaatagatgttaaagatcttactgcagaaattactgtcatgattttggaagccctagtttaacccacattgatcataatatgtctctggcatggtcaagaagttcttttttcctgattcaagtactttataaagcatatttaaaggctggcttcaatctctctggagttatacagcccttctgttagtcctggtacaatccctcttgagaattttttcttttttttagtgttatcaaaaacacagtaagacgattgatattgcttagtactgaatcccggagttctgtctatgatcaaaatatcctctggcccaccagccaagattccaaaagtggtctcattatggttcatacccagttttccatcctacagccttgggttgagagctgcagcctccctccaaagtcccctccaggcagttctgggagttctgaggtgtttctagtctgttcagtccatttgttcatgaccccctgcttctgtcgtctcgttagtatatcctgatataataaaagtttgaaaatataatcaatgctagtaaggaacagagtcctatgctgtaccatttctttctgaagtgtagctttgttattaaaaacaataataaaaaaaggactggtacaaaatttcctgttctggaggtgtggagtttttcatatgtcaaccagctttaaccttttgaaggtttaatgaaatcagcaaatataatccactgtacgagagtggatatgaatcaagtctatcattgttgaacaaacggcattaatttccagtgcacatgtggatctgagttttaaaatattggtttgaaaaatgtcaagctgctcattgttttagaatatttgagcagcttgctagtatactctttttaaacagttgtacttctaaaaggttacagtgtttgcatatttattcctttcaatttaaaaaattcttccagtggcctgggtagtagggaaatacctcgaattcctttttttatggattgtacttcctagagggtattaaaaaaaactccctttcacttttagcagtagctgaagctacaggactcactttacaccccagcgctcatcatcatgtctccgggtgaagttctcttcagtgtccccagaagctgtagaattagattgcttaaagctcgtggaaaagcttatatctcctatgtccagtgtcagccccctaggaagaaaagagctctgggggaactaatgcttgttgagtgctctaaggaaccagggattggatgatgagcaggacggccatgggccctgctctcctggagatcatggttgctgttcagccagggtcagtggggcagagagcacagtcgtctcaaaagtgggtgtggggagatccatgaggatgttggaagcaaatataaaactgagggttttctcattttgaatttccattgttgcagatgtttcataatgcagatagtatattggtattttggtgcatcttttacaacaaacttaattattttgtatacacatacacagatgtgcttcagggctgtctgttgtgttccattgatcttagctgatatctttaagaaggattgacaactatattttaaaaatctaatctatctaatcaggaaattgatttaaacaaagcactccatgccatacaagatttgattgagctgttttttcttttttcccaagatgaaagagtgcctaggagcgtggttatttttgcccctatatccaatttagcacctctttcaagttaggtttgaagttggaagaattacaacatatttctataaaataatctgtttaatgatatgatgtttcatttcttactaaaacaaaacccttcccattaacttgttcgcttgtccccattttatcatatatgcctagggagaagtctccattaactggtttcttcctgctcctaaactgtatcctctttcttaagcaagttctccacactattagtttgctttcaggttcccctgtgtttgctctctgttcaaaactggtgatgctgtgaattgtagtcagctcaagtgacttccaggtgacttgccttcagcagtggctgctcatttcatgcactgcagaatccctgggtcatgctgacctgttgatgataccagcatcacagactgcacatatcaggcctgctttctatgatgctggttttccaattaactttgtgaaaaggtatatccctgcttatgtcttcctggttatccagctcctcttgcatttgatttcatcttcagcactcgtctgtttgccagttttccatagtagaaagatagattttttttcaaaaacgactcttcccttttagttccattccataggacttctaaaacagatacttgcattgctttcatttccaaaacaaaattatttgataattacaaaaataattctagaaaataattgtcatgttagtttgctatattgaatattttttgggacttctagatttaatgtatcacatttcactaattgaaagaaaattattatcagcaagataaatctgtttgggagtgtttacttatttctttaattttctatttttttattatactttaagttttagggtacatgtgcacattgtgcaggttagttacatatgtatacatgtgccatgctggtgcgctgcacccactaactctagttatatctcccaatgctatccctccccctccccccaccccacaacagtccccataattttctaaattaacatgcccctccataattctgaaatccaaattaaactagtatttctggtacctcaagattccctaaatggagcttcctgggtcagtacgccacttaatctaacttgtgaagaaagacttcagcactcaaactcattctgaccctgtggactttgcttcagctgctccctttggctgtagttctctttctcagagcttcatgtggccagctcttatcactcaagtctcaactcaaaccttactttcttggaaagaccgttttctggccgctgaggtctctgccactatctgtcatagaatttgattttattttttcacatcatgtgtcagtccctggaattatttttgttaacttgtacatctactgtcctccaattagaatgtaagttgagaagaacagagccattgtctgtcaagttcattgctgtatccccagtacatagtatggtggccagcacacagtggtttgataaattcttggtgaatgcatggatataacatttgagaaatgctgcataaaatatcattcaatgggtttctctagagtgagatatattggtacagcattttccaaatatatttgactaagaacatgtatatatgccatgtgccacataatgcagttttgatcaatgactggccacatgtatgaaagtggtctcacaaaattataatggagtaggctatatcatctaggtttgttatgtacaccctatggtgcttgcacaacaaagaaattgcctaaatgacacatttttcaaatgtatccccattgtctcctactattggtctgtatgactgtcattatgtcagtaccatattgttttgattactgtagctttgtaatacatgttgaaatcaggaagtgtgatgtttccagctttgttgttttttcttataattgatttggctatttgtggccttttgtggttccatataaattttagaattgtgttttctatgcctgtaaaaaaacaaacaaacaaacaaacaaacaaaaaactgctattgggattttgatagggattgtagccaagcagcttggcttcaaaaatgcattttaaaactttttttctcctttctcttttctccttaatctcaagatgtaaccttgaagctaactgcagaagcatttccccttaaccttaaaataagacttcatgtccctctctttcccatcattatctaactgtatgctagtatctaattatgtgcttacttaaagttctgggacttaatcttgagacaggcagaccaaacccggaaaccctgcttcaaaatttcagataacctcaaggtagctagtcaacaacttggccattgttgagatgatgccagcccatgctccaggtggaccaagacccaatatagcaaccaaaacaagacacgcagatctagtacttagcgcgactcctgcttgccttccatatcaagtctcccctttttaaatacttagcttcttcctagaaattcaaagtggttactttggatagggaatctggccacttccccattactagttttggttaataaagtcactttctttctaccagatctctctcttgttaattggactctgtaagcagtgagtggccagacctgtgttcagttacaagatgacattgaatctttaggttgctttggatagtatgaacattttaacagtattaatttttccaatttgtgaactgcagcctgtaagttttgatatattgtgttttcatttgtttatattgaggtatttctaatttcctttttgatttcattttgacacaatggttgtttaaaagtgtgttctttaatttccatgtatctatagatttttcagtttttcttttgctattgatttctgtgtcattccattgtggtcagaaaaaatacttggtatgatttctaccttcttaagttggttaggactttttttgtaacctagcatgttacctaccttggagaaaaatttgggggcacttaagaaaaatgtgtattctgccactgctgggtgaaatgctccgtatgtatctgttaggtctgtttgatctataatattattcatgtcctctgtttccttacttatcttccgtattgatgtcctcttcattattgaaagtgtggtatcgaagtttcctactattactgtattgctatctatttcttccttcagttctgttaatgtttgctttacatatctaggtgctctgatgttggatgcatatatatttataattcttatatcttcctgatggattgacctttttaatcattgtatatgtccttctttgtctcttgtgatagtttttgacttagagtatgttttgtctaaggatagccacccatgcattcttttggttaccatttgcttagaatacctttttctagcccttcactttcaccctgtatgtctcactaagtctaaagtgagtttcctgtggagtgcatgtagttgggtattttgtttgttttccattcagctactctatgtctttggattgggaattaattcattaaaattcagtgtaataattgggaaggggaggatttaatattgcggtttcattagttgttttcttttagtcctatagtccttttgtcagtcttttcctttcttactgtcctcgtttatgttttcttgattttttttttttgtattcatatgctttaattcttgttgacatttttagtattataccttttcatgggttttggaattttcgtttgctgactcattttgagtgggatgtttttacattcactttttattacattttttccctttctctgggcttactcttgttttccttgaggttttgtgatcacttttatctggtctgaaagacttccagtccagacccaggttttattatgttctatcagccacccttgccaatggtgatattggggatatcacatactctgttatcaagcgagcaggtggtttgattctgtgcctgggtctgaatcacatctttgtcaacttttccctcacaggcttaaatttttataaaactgcttctcttagtgtgtcgtgttttttgttgttgtagttgtagttttgtttttagcttcttcttattagcccaacctccttgtttggctttacagttaacctggcttaggtctccttatctccagtgagccaattttagattctcttatcctgtaggagcagaatgcccagcagtcagtgctggcttctaaatctggagccttgcaggttccctgacttcagacttactcactgcttgtgattctaatgcgtttctagtccacagagatgtttatctggttcttggaaacaaactataaacatttttatgtttactttttatgtttcatctttaattatcacgtttggaataggaggagttttataatggtgtgaatttgctgaatcatgttgaccagaagtctcaccattacttctgaagcattttaaagcatatttctgtcctaatttcttgtccatagctctgtatgattctgacctttgaagactataataaaggttcatcattttttaatgtacttattgtttatactcatcactgagagaaaataagttacattacacagtagtcgagaataaacttctttaatgggtttatgtgactaaaattgtaaaggtcaggggaattaatgggaaatttgttttaattatgcattgatcacaaaacataatattgttttctttaaggaactgaacttgctggattctgaatcatattttattactaaacagaaacaaataaactcagattgatttattgaccctgctgtatgccaggccttgtgaggaatacatgggaaggaaataaaaaggtctctgtcattagaaaggctggtgtttctcagctgaaggctgaggttggagggtctcctcctcccctctccccagtagaaatctgtgagaatctgaaataggaggctttttaattttcaaactatgcaccctatctccatttcccagccccctaccaccaggggagtgtgtctgttgcccctcaactgcttcagaactactatcagagccacttttaccaagaacatacaccatagcaattggacattatgaaaacaataaaatatgtaattaaattctaaaatgaattaggatgctagatggattgagcatacactggatactaggcaatgcattaggaccttccttacaattgctgttacatcaactctgtggacagatgttaacatccatttttagatacacaaaagagggagcgcagagagctcaagcagcttgctgaggttcctagtaagtggcagaggtggacttcaaatcccggcctgcttgcctctgaaacccagatcttaattactgtgttgtaataagagggagaaagacaaggttaaaatatgtcctactgtattgtggtttactgaaggaatttatggagattaaaattcataaattgttatagagttaaaacagatgaaataatgcttctttgacagaccatttagttttttctttcatctttaaacaacgctgcactaaaatttgtctgtaatggcataaaaaaaaccctgatatttgccttttcttctccattccccatgcttgtcaatcgttacagagattatgctcaaatgtgatatcaggaaatacttttagtccccagcttaagcttctcatttctatgtgaaatatggcagacttttgatgctttctctaaggtcccgttctggatattctccctgtgttcaaggcccttttagggagagagccagtctatggccagtcttgccaactctgtaaatgcaatttacattcttaaaattcgctatcaccaggtcaaaactagcccctggtgcattttgggaagcttcagttcaaacacctgaattcattttcaccaatgctacctggttaccttgtaactccagagttttttagagaggttttgtatatgattgcttgagctatagctttttccctttttgtaagctattattgaaataaaaacgtaacttacctatttcacggtgtatggatgtttttaagtggaataagttcatgctgttttaacttaggttcaccaaacaacatttttagaatattttcacctttctaaataatgtgcttttgattgatactccctctaattcaaactggcagtgcatagtaccctaaaccagtgcccgcataagcagtctgtataaaacatgcttatgcttttcagcttcccaagtgaatctttcctagagagaattgttttttttttgaatgtttgaggtcatcttacaataattatgcataatcagtaatggaaacaatttaaagagtttacactatgtgcccggaatatgatcatgataaacaagtcatctcatttatttcttacaacacactttttaagggtaggttcgtattatcattcccactttacagagagagaaacaaaggttagagagattaagtaacttgctcatgtcaaggtggtagtgagaaattattgaaagcacccattatgccatgtgagtaagcaaaaactggcagattaatttttagcatactcaaataaaaggtcatgcattagaaaaaaagcagtcaaaagtagcttctgccccatctttagtgaagcatacagagggatatgattgaaatagtcctcagctctgggtcaaactctctggcttctattttcaggccctgccacttgggcaaacattccttctctgtggaaaagtagaatgttggccacaatctcctaaagtcattctagctttgatagggtgtgattgtaggagcctgcaaaggaatctagaatcattgtaggtttcctaatgtctgtagctctatgcaattaaaaagattgagtaaatcttgggagctgtcaagaaggttcttacagtttatatataacatacaaaaaaatgtataggatatatcatagttttgcttgctacatctccaaaatctagtggaattcaagaaagtttcagaaggaaccaccaaaatggcatgatgagactattataaggggtatagcaatctttagcctgcaaatagagaaaaaagtcttatttagaaatgtctacaaaattatgattgttatgtatttcatacttaagaaagtaattttagttgagataaaatgaagtactgttttacacagtggatgataattttgtggaactttccatctgtagaatcaaaacataaaaaataaatgtgaaaacaggcaaatgtagaaataacagtccatcatggattatcaaaggacactataaagtatggagttctcccctaaaagctggtattgatagggatcttagttattatgccttcctactgtatgtgccagggttccaatggaagttgtcaatacagcatagctccaattcaggaaggcaaattttaagtcataaaaggttctgtttaggatggcagatttccttaatcattaattttattagtagtataatataatgttaaatttttgttttggttccagttgaagagcagcatgatgataggaatttgcactagaaaacaatactaatatcacaggaaaacattaagagtttcttctctctgaatagtggtcataataagcccatccttccttttcatagaggttgatggtgtctttggagatgatctatctcacggcctcctcagggcaggtgtccattgtttacctggcaggtgttccttgcacctctgcttgaacactgcccatatttggcagcttatcctctggggagtactgttcccttgtgggactgctcaggtttattctttactgagctcaaatctatgtgcatatgctctttctcactggcctgattattccttcagggcaagtctactcttcttgcagatgaagcatctagccccttacagtcttctcttctccagtgtaatatattctgctgctcttcaagcagtgcatttctagacactggaaaatcctgtcagttcttttctgaccactgtctcttttccaaactctttcctcaggtgtcctggacggaaacaaaagggagtaaaaaagtgttggatttatttagaataaaaagggagtattacttcacataatcaacagcattattttatttttatcaatgaaccttaaaatctttaaaaacattttcccatgactgagatactgttagctcaatatgcttgtggccaccacctgagtttcctgattgttgccagacagaccgctatcaactcaccctctcaaagtgcagtgtgtgcttcagatttatccccactgaattatcttgtcagttttaagctattatttgtgcttcaggatattttacaatcttgattatttggtccaacatattaatgattcatcttatatttttatcatcttaaaattcataagaatatctccaaggtattgatggaaatgttaaacaagattgtatcaagggccgagttaagttaagcaatgctaacattcaaaacttaatgagaaatataatttagtaagaatggtactttgatgcttgtatttcctttaatcttgctctaatttatagcctattaaaatatactgtttatgctaataaatacaaattaaattttaaaatacatgtttttgtttgtattgttttttcaaaaaatgcacaattgagaaaaaaagtccacttttctttctttttttttaaggttttccacaggttgtgattattcaacacatggctacaatcgactaatgagatttaactgatttaatgtatgataatataatctaatgacaagtcaaaataattagggggacagggacaacctcatgagtgttgactttaaaaatctaaatccacaacatgacaataatgtcacagtgtccattgatgaagaaagtgaacagtctttttttaatgatgttcttttattttagttgattgcatttagagagaggacaactaaactattcattctcctttgtggtatctattaagttttaaaaattaccttgtctttctgttattttttttatttatttattatactttaagttttagggtacatgtgcacaacatgcaggtttgtcacatatgtatacctgtgccatgttggtgtgctgcacccattaactcgtcatttaacattaggtatatctcctaatgctatccctccccactcccccaaccccacaacaggccccggtgtgtgatgttccccttcctgtgtccaagtgttctcattgttcaattcccacctatgagtgagaacatgcggtgtttggtttttttgtccttgtgatagtttgctgagaatgatggtttccagcttcatccatgtccctacaaaggacatgaactcatcattttttatggctgcatagtattccatgatgtatatgtgccacattttcttaatccagtctatcattgttggacatttgggttggttccaagtctttgatattgtgaatagtgccacaataaacatacatctacatgtgtctttatagcagcatgatttataatcttttgggtatatactcagtaatgggatggctgggtcaaatggtatttctggttctagatccctgaggaatcgccacactgtcttccacaatggttgaactagtttacagtcccaccaacagtgtaaaagtgttcctctttctccacatcctctccagaacctgttgtttcctgactttttaatgatcaccattctaactggtgtgagatggtatctcattgtggttttgatttgcatttctctgatggccagtgatgatgagcattttttcatctgtcttttggctgcataaatgtcttcctttgagaagtgtctgttcatatccttctaccacttgtatggccatactgcccaaggtaatttacagattcaatgccatccccatcaagctaccaatgactttcttcacagaattggaaaaaactactttaaagttcatatagaaccaaaaaagagcctgcattgccaagtcaatcctaagccaaaagaacaaagctggaggcatcacgctacctgacttcaaactatactacaaggctacagtaaccaaaacagcatggtactggtaccaaaacagagaaatagaccaatggaacagaacagagccctcagaaacaatgccacatatctacagctatctggtctttgacaaacctgacaaaaacaagacatggggaaaggattccctatttaatgaatggtgctgggaaaactggctagccatgtgcagaaagctgaaactggatcccttccttacaccttatacaaaaattaattcaagatggatgaaagacttaaatgttagacccaaaaccataaaaaccctaggagaaaacctaggcaatactgttcaggacataggcatgggcaaggacttcatgtctaaaacaccaaaagcaatggcaacaaaagccaaaatcgacaaatgggatctaattaaactaaagagcttctgcacagcaaaagaaactaccatcagagtgaacaggcaacctacagaatgggagaaaatttttgcaatctacttatctgacaaagggctaatatccagaatctacaatgaattctgttatgtttttaaaataattattccttatggactttcagtctaagctaatttttatttgttctctccagcaggtctatctttataacattcaagctccccctactccttatccttggagttcacttttatggggacaaaagatgagttttctgtgctttggaaagcatgattatgcttcatgttagctttggaattagaagaaatcattttcggaccattttttttgagttgtgatacacaaacattataaggttaatcagcattttggcttattagtggcccttgattcttaggaaactaagataattctctttttcctgcagatgtgacatttgactatgaatattgaagttaaacttcaattcattgtattgtaaatggaaaagaagagtttttcattttaggtatatatacataatacatatattcttttccttggctctcatcatgtttatattagatacaaaactagttaacatgtctagtctggcatttttcctccaagatatataaattctaataaaaaataagacaagattggggaatggggataatagtattcttttaaacaaggatgcaagaaaatgaaatgtttaatttttgcaacatctcctttctaaaacaaaatatactgatggaaatttggcttgtttcctagagtctcaacacaggagttattaactgcgatgaccgggctaatactatgtgaggtggagtatgataaaaggattaaaagctagaggtactgtgcttggatagcaagctggatgcttgtgcaggcatggagcctttcaaagtaaagttggctccttgacactctgtcctgcagcttgcgctgatttttaagatcattgaaaatcaggtcattgagaagtcttcttttagggatgtctgtaacattctttgactgtcttatgtttaagctagaatttaagcatccaaataaaagttgttctcaggtgtcatcatcataggaagccattcagctaccctaaagttcactaaaaagtcctggaacttgaggtgattgacttctgactccccattgtcagtgtggtccagggacatggcaggcaggagccaactgcttaaggtagaaatgctttgagtaactttcatttaaactgcacagactatcatggctgggtatttttcaaagctacatagggttctggaattttagaaaccattaggggccaagaagaatctgtcagcttatagatctaaatgttcaaaatttaagttaaagcctgtttcttttggtaggaagcaccttgactcccattttttataatgaaagattgatgatatctctattagcctgtttaaactgagccataaaagagtctgtaggaggccaggtacagtggctcatgcctttaatctcagcactttgggaggctgaggcaggcagatcacttgaagtcaggagttccagaccaggccaacatggtgaaaaccggtatctactgagagtacaaaaattagccaggcctggtggcacgtgcctgtaatcccagctactcaggaggatgaggcatgagaatcacttgaacctgggagacagaggttgctgtgagccaagatcacacctctgcactccggcctgggtgactgagtgaaactgtgtctcaaaaaaacaaaaaaaaaaaagtctgtagggtaccaaatgcttttttttttttggagacaggatctggctctgtggtacatactggagtgtagtggtgtgttcatggctcactgtagccacagtcttctggactcaagtatcctcctacctcagtccaccttcccctctccagtagctgggactatagacgtgcaccactacacccggctatttttttttttcaatagagatgagttctcactacattgtacaggctggtcttgaactcctggcctcaattgatcctccctccttgacttcccaaagtgctcagattacatgtgtgagccaccatgctcggccttcttcttttctaaaatcccacccacttagcatgacaaaggcctgggacataatggtaagtgaatagttgtaaggaatgagaagttttagctgtgcactgtaccatgcttggatttgattatgggaaagatgatcaatattaacatagaagttacctaaactctctgtgtcttttcccttacctcaggaagttcaaatacaatgttgtaattcagctcttctactcttcctgtcctctcaaatgagacaacttatactgtggttgctgaggctaaatagaggaggaattcaaatacatggttcttctacttaagatcatctccagttgcatcaaatcatgacttctggatgcaacccagttgcctccatttcatgagaatggtttccttccatagacattctctgctgttcccctatcattgtcaaatcaatgtttaatcaattccagccatttcttgcaaatccactgcaatcacattttataaatctacctagtgcttggttttcatgcgccgcagataaattaggtccttcttgttttatcctgagctatcagtctagtaacatgctcacagcatgcaaccaggaataggcatgatctcctttttgtgagtctaatctgagtgtcctttacaagtaagaggggatagtctgagagtggaaacagctcttttcaggaccagctgggtgatccatgagcatttgaacagatggcccatttttgtgggaaaggattctgtatcctacaagctaacacccaacagcttcactgaaaaaaaaaaaaaaagcttgaagataagaaatcaattcaagaggaacccacatgtttgctgtgttgcctctgaacacaccctgtatgtcaagagcttagctttattctgtagaccacctagtcagaatcattggggaggaaaatatttgttcaaacatagtcccttttgtctgtgctgggcaatagcacaatacattcagcaaccaccctctgaaagccaaggctttgtctccagtggggattatgaaaacatggatttcttgagaagtgcctgcccacctgtgtttagattttaaattttaggaagatgcttgacagccagaaaagaggtgctcagggaaaagtctgttgagattatagagactttttgaaagaccattacctcctttaaaatgattagaatagaagaggaattcttgaaaactggcatggaatatcgtattagatggaaccttggaaggttttatttatcccttctcttttagctttctgtctaaggcctcagattgtagtctattttagaaaatctccaaggcaggaaatttttcataacctttcccctgttagtcattttttttaacttcaacaaaagcctgcatcagaagcttcttgctcgcttatatgaccctaacgctcactgctgcagtccaagcctggcttcctttgcactttcttttgctgttcatattcttcacagtgggacctgtcttagctgaagcccattattaggtcactccttggcctcttctctaaggctaaataatgagttatttttttttctccttttttggtacatcatattttttcaaccatttaatgatttttgttgttgaaaatttggggatttcctgtgtctggaaatgcattaggcctcaaactttgtacccctaagacttttcctgctaccttttaaaagacaccaagtaaaattaagactaggagaagacagctgctgcaatttttaaaaaatcacaaaagcaaaaaaaaaaaaaaaaaaaccaaaaacaccgagtagctgtctttctggtttttgattgagcaagatatttgtaaaatgaagcatactttattgtcagatgggcctgttgtttactgacaattgaccaacatgaatgtggtcaggtttagatgaatatctatacaactcacataatttttaatgaagggagttaaaagctaagcatgccaagaaaataagtatgactcaaaagtggccctttcttagtatattggatgtattatggcttctagttaccaagggcctttgaagatgactgggccattattttaatactttttaatatgcttctggattcaattattgcagatttttacaattatatttgatctctagttagtttataaggaggacactatctttgtcaggttttaatatcaagattgtgatagctttgtaagtaaatgtagatattttctatactttttctttgctttagaacagttgaaatagaacaagatcaatctgacatctaatgtttggttgaactcacttgtaaaactgtctgagccccttgacttccaaaggtaggtttttgataattcttgctatagtttaacatatcacacatatggaagactttatttatctatgttcaatctagagaatagtaatggaaggattacacatgttctcaccactgagttgcagaaacagaacactatcagtgtctttgaaggtcactgtgttcccgtacctgatcacctcctcctctctgccctaacccccatttgacataaacacaatgctaactttggtataccattgctttgcttttcttcatagttataccatctttgtatatattattactgaagattatattatttagtttagttgaaatttatattatagaatcataatcttctacttcttttgtcttttttgggtttttgttttttgttgcctatttttgttttgagattcatttatatttaataatgcatcactaggtcattttcagttcactttactactttgtaatagtccattgtatgactattccacaatgtatcgattctactgatgatggacatttgtgtgttttcagtttgagaacttctgaatgtgtctgtatgaccgttttggtccatgtctcctggtattagaattcctctaatgtttacaccaagagtggaattgttggattgtggaatgcccatatgttcaactttataaggatatgtccaattgttttcccttaattattttaacaattttctgcttctaccaggagtggataagaattcctattgctcagcctccttgccaagatctcatttgtgtgattttaaattttttgccagatagttgtaaagtggtatcttattaaggatttaatttacatttacatttccctgattggtaatgaaattggtcaccttttcaaatgcttgctgtcattcataatttcttttctgtgaaatgcctctttatgtgttttgcctatttgctttttgggttgcttggcttttttattgatttgtaagaattctttacccattttgaatataaatcattttgagttatatatattgtaaatgtcttcttctaatttctagcaactcctctcattctatgatttctcttgatgaacataaagccttcattttatgatagttaaatttatacatctactattcatgctttgaatttttattctatttttaaaatctccacactgaagatataaagatatttttctctgttgcacttaaaactatcattatattgtgtttatttattttccatcttcccaccagaatctaaattcaattaaggctagaatatttgcttgttttactcatttcggtatctctagcacatagtgggaactcaataaaaattgttgaaggaaaccatgactgaatgccagagagggtgaaatgttcttcagtatcttgcattagctcattttcctaagaatgcacatcctctgaggctatttcctctccctagtcctgccatatttttcatatgtctcattttcatctcataatcaggtggatccatttggactcagtgtcttcatatgcaccagtaacagaggggcttgtcctcaggctgctgtctgcacatctttgatttcgtccatctccactctcagacctacagctggcctgcaggtggatgtatgccgttgtcattctggttccttctcctagcaggctttcatccagtgcatttctgttcgactgcggtgtattcttcccctattcccaaggccctcattcccaaggtagtcagggctaatttagtctgcctcgcaaataacaaaccctacatttcaaagaactagagttcccattctgcctttctagttgttttgttacagctgctactgctgttgttgttttcagagtaactttttactctatactgcatttggaaaagatgatggtgaaaaggaagttgggggaaaggaattggtcagtgccttgagtgcctcaggatgcagaacacaaggggtagatgggcaggtgcccacttctctgttgattctaggccatgcttttgctcaaaggaatccagatctggcaacagaggcagtgaagggactgtgcattttcctagcatttatcaggtgatatttttcatgaaactgcagtttactgcatttctgggtagtctgtttttgtttgtttgtctaactcagatccaagtttattataactaatgttcttttatgcctgaccctgacataagggagattttcagtagccttgtgcattggtatatttttctgggttatcttttgtgaggtaacattaaggaatgctagccacattccattttgagtgaaacctcctgcactgctattttctaagtgtatgcagaagctcatatatttggaaaattcaagttcattcaaattgctactgaattagaagtatctttttgtcattacctagttttaaatcaatagatattaaaattactactactatttcattgttgccccagtttttttttctgatttaaaaaaatatactaaaacaagctctcataatccagagaatatgtaatcattcttctatagcactataccaaagaccttatcctatgggatatcgcttagtttcctatcattcaaaaaccatctttccaattttttaactaccagtttaagtaacagtaagtagattacagaatggagaaaacataaagaagtatgatcgtaaacaacttcaatttttctgaaagaaatctgaaggataaaataatagcttccttgacttagttgttcctatatattatctgagaaaaagtttattgaagcacatttttacacttttaatccactggaacgtcactgagaaaatgttctgagagtcataagaatgttgactaattgggctgtttgtcccacatgggattacaccactactttctgaatcagaagttcctgctattgcaacatgaattattctttattttttatttttccctcttagaaacaatccatttgggttcattacatagccatttgttagtttgggggattgtgcttgtttgtaactacaatgaagtcatactagactgggtccgtatgtaagtcagtgggagatcgtgcagctgctcagtgaatcattcagtgcaaagggtcaccctaatattttaaccccaaagtcctgctttcccaaagtcatgggtaatttttattttaatcatcaagaagattggttcaactttggtttacttagtacatgttgcacatacatatcaatctgtaaaacttctaaaaaaattatattgaagtataatattctcagagaaagtgcacgaatcctaagtgtatatggtgaacttttacaaactgagtacacctgtgtaactgctacccagatcagaaaacagaacatgaccagcaccccaaaaggtttcctctaccccctttttgtcacaaaccctcctcaccaagagtaatcactctcctgttttgcgtgtttttatactttatataaatggatttatacatcatgtgttattttgtatctggcttctttcattcttcattatgtttatgagactcatacaattttatcatgaattgtgttttttcattttccatttctatattattgctatggagtgtcctattgataaatacaacacagtttattcattctattgtcagcagacatttcatgagttttctttctttttttttttttagaagggttaggcctattatgaatactctgttatgaacattccagtacatcttttttggttaaagtatacacacacacacacacacacacacacacacacacacacacacacatcctgttggatatataacgaggagtagcattgctgggtcatagttttgtgtatgttcagatttaatagataagccagtttttccaggtggttgaatgtacttacactagcaatgtacaagagttccagttgctctacctcctcaccaatatttggcatattttgtctttttcattttagccatctggttcaatatgtattgaatgtggtttaatttatatttccctaatgataatgaagctgagtatcgtttttatgattattagtaatttgcatatctttctttgtgaattgtctgttcatatacatatatatatatgctgaatattttctgtttttccgtgggttaccttttcactctcttagtggggtcttttgatgactagctttcctagtttaaaaaaaaacactctcacatattaaagatcttagtaaatatttagaaaattgttaaccaatgtgtgaggatctcagtagtgacatgtttaactcaaaatgtaatttattatttttttcttttatggcttataatttttgtgtccagtttaagatatctttgcctactccaaattggtgaagttattctatgccttcctctaaaatctgtgtttagatatgtaattcatctgactacatatttgtatgttttataatgatcaagatacattttttttcaaaccaatattctatataccccagcatcactttacttggtttataacttgtttgaaatgtgtccacaaaatttagtttcagtgaatttttaaatattttcttataattactaatatttcctaagaagaattttaaacctgtgatgatttcaaatgtgtaatataatttctagatttatttaatactaatgtcagttgaaatttcccttaaaagttctcctgttcaattggatctagttttgaaatccagctatttatttattcaacatcaatctataatgcataaaacaattttttaaataaattattgttctcattttctcatttaaatcaattcaacacatgtttattacgtttcttctagaatttgggacagttacgaatgtggttgaagtttcaagcttcatttttatatcctttaggttttaagccatataataaatttatcaaatatctgtcagtaataagccaatttcttttctttttttttttttttttttgagatggagtcttgctctgccaccccggagtgcagtggcgcaatctcagctcactgcaagctccacctcccgagttcacaccattctcctgcctcagcctcccaagtagctgggactacaggcgcctgccaccacacccagctaattttttgtatttttagtagagacagggtttcaccgtgttaaccaggatggtcttgatctcctgacctcgtgatccacccgcctcggcctcccaaagtgctgggattagaggcgtgagccaccgcacccggccaagccaatttctttagtagtcaaaattatattaataaagaaaggtacaaagtgaggatttttattactattaggatagacttagaccccttatacaattcctcaataccaagttttccactaataatgacacatatctttaaagacataaaaataggaaagaaaatataaaagtttcatttttatattttgaatacctataaatgtttactctttgatgtcatttttgcttagttttattttttaactttttattatttgttctaggttgtactggtcagtggacatctggacagctgggatgttgggcagggtgccatggatgatggcggtggagcctttatatcatgggaagcactctcacttattaaagatcttggtaaatatttagaaaattgttaactaatgtgtgaggatctcagtgacatgtttaactcaaaacacaaaatacttaacagattagttactatggtatgttcaaagatcctcttgaggtcagttgattcccagaaaagaaacaacttatgctcttaaagaaatttttattcatgtgtacgccagacatctaaagtgtcaaatgttattatcagccactggggaaaatgaacaagcaaataaaactgaagcaaatgtaaccacaccagctaaagaatatgcaaggaaaatatgatgaaatgcaaagaaaaatcagcagcacctcctacttcctttcccttattcatcttaacacattatcagactattaggacaatggataaaggctggtcgtctttccatcatagaaataaaagagtaacctagatagaaagaatgatttccatagccacaataaggaatccaggcagataattctttgttgcaaggtctgtcccatgcatgataggatgttttgcagcatccctgacctcttcccactagaagccagtagcaccctcccctaacctcaagttatgataacaaaaatgtctccagacattgccagatgtcccctggggggccagggaagcagttgccccattttgagaaccactaatataaactaataaaaatatctaggtaacctgaatacagggtcattttgttaaagaaaacaaactaattggaaatcttacattgtatatacacttttaccataattaccatacatgacagaaaatattttgaccacctactttgctttttataaagcactttgtaaaagctgggcatataggtttaaaggatgtcccctgttcttaagactcttagaatggagtgggtaaccttcacacatacatacacacatagttatcaatatagacataatttcaacatctaattttagaattggggaaggtttgagagagaagttatccagcaaataaaactgaaaatcacacattccttcacagaaaatctgggagacgctatgttaattctctcctcctcttctcttaaaaatattcccttggctatctcttctttctgtttctcatatcattccagaaagaagtgggttctagaggaaagcaggaaaaagtcgaacatttttcctcttcaaaaatcaccgataatgattttggacattaattttatttcagtatgttcaatcagcttgattggaagcacagtggtggagtaaaaagagaaattttctttagacccatttgaattggactttaggtcactttactatattttggtccttaagcaagtcatttgaatgctctggacttcatttttctcatctctattaaactgtaagcttcagagtatttcatttgctctagattggaataaaaattgtatcttctttaagctttgaatcttacttcttcggtattcagcatgggaccctaaatcactgttaattgaattgaattcagttgcatggacaaatgttaaataccatgcaaaagtgaattgagtatcttttaccagttctcaaagtacatcgacttcagttgcttttgatagctagtgaccagtctctttaatttgggacttaaatctccaaaagatttctgaaagtctatgtaaagatatgaatagaactctaaaataaagagtaatatttcttttgagtaggcattatgaggcaccatagtatactgttaaaaacataggattctggagccagactgccagggttcaaatctcagctctgcagtctgctaggtgtgtggccttaggcaagttactttgcctctctgtgcctcaattttctcatctgtgaaatgggataataatagttcctatctcataaagttgctttgaaaattaaataagcagagtatacttagaacatgggctggcccaacccaagttatcaataaatgttaacttttataacttaacttaataagcatgattctgacagtaccatttttttaatataagagaagatgataatttagtttacctccatccccattagtgattgctttgcctcctaacttttagtatattagctatactaatgtaactttagggccagttgctatgtatccctaaaatatcctttccctttactacttaagtcaccatcccttgtatgatagaaacccagtgacccctccactttttttcatttcacactaaatttttagaagtcttaaatttctcctggttacttctatatcctgcttatgtttaatgcccagtatctactctgcacctcactttccatgattgcacccattgagtcttactctttaattttgaaattgtggatttctatttgtagattgcctatgtattttaacatgaagagctaggttcagcatgtgatgtgtatgaattctggatgaaaattgctgatatacttgaactagaaatatgcccttgggcttgaggccaagaaataggttcataattatattacttaattacatggaatccaatctgtttaattggtaaaatgtgaaagctctgtggcaatctctttttccaagaaaaatgagactccttttggatgctattccttggatgatgtgtcatgcagcatgtcagagtccctcagtggagcgtgttaacttgaagagctggtccagtggggatctctgatatttggaaatatttttctaagattcatccttctggtatcttcttctttgtcttcccctctcaccactcttatagattcacttttttgctcaagccttcagcttaaattatattcaattaatctaacagaagagttatttgtgctttgtaaatataatcagtctttcccgagtaactgtctacagaaggctgtttgctgtgaagcgtcgttgaatacttttctgtgtctgtggtttactggacttgaaactgtttatttgaaatgttattttctggaatgttctggtgtcagtggacaaagcctatggccaatgatgctccaaaatgctcatttggcacttagaaaataaactaccatccatcccaaattcttccaactgtatcattttctatgaagttagaattttgagtttccaggtctaaagaaatgaaagatatgagaattaacagtattacctggttgttggaatgtggaatatataagaaacatttttccagaaaaaatgtaaatgttgagcctcctgactgtgattactatagagcttgaaagtctatgtcttagaaaaatattttattggtatgtttcttcattcattcactcaacaaatacttgtgcattgactgctggttcatgtatcagatgccttgcactaaagaggaaagagaaatggccctttaagtccttgaagtaggagagacatttaattcaaaaattgcaatgaaattgtggtaagttctctgaatgtaggatgtacaaattactttgggcacctggtaaagaaacagaccaacatggcttggctgggtcagagcaacttcactaagatgttatttgaactttctttcataaagataaatagaaattcctgagatgaacagtgcagaatgaagtattcccagcagagtacagagcttccagttctgtgtgtcattaaaaatgagaagaaaattgttgacagtagcagtcttgggattatagggggagacaggagttgtggaattacaggagaggttcactttttacctgatatatttgtataatgttagatttttgtgtaataagtatgtgttacttcagtaatcaagaaaaagctatcaaatactcctctacccctactcccaaaaaagaaattaaaaagaaaagaaagagttttggtattgtcattatcataaacaccctgttaacagaaacaacacagcagaggtaaggagttggaagagttgtccaggagtcaccaagcctccctggcccagaatacaaccatgaagacagccaaaggcatgccagggctttgatgcaagttccactgtagctagagccttatgcagccatttccaatgcagtgggttctctcttagaaatggggacccatctgggaagaaggttttcttccctaaggctctggtcaagactgtcttggaaaagccccaggaaatgtaattcagagtaacagagaagaaaatgaacagcctccagtgaaatggaagcctaaagggtagagctagagatggctggtgtcctgaaacgaatctgggactagcccagacctacaaaagatatctcctttggaaaggacctccccactgggtttagccataccgctgggtataataaaaatattgagagctagcattgactgaagattactattgtaagcattgtgctaagcactccactgagtacatattctcctttattcctgaaaataaacccaagcagtaggtaactcgtgttatattcattttacagaagaggaaaccaaagcagagaaaagctaagtaccttgcccaagatcaccagctattatgtgaaaaatttaaatctaggcagcctgacgccatgcccaacactcttttttttttttttttgagacggagtctcgctctgtcgcccaggctggagtgcagtggtgcgatctcggctcactgcaagctccgcctcccgggttcacgccattctcctgcctcagcctcacgagtagctgggactacaggcgcccgctaccacgcccggctaattttttgtatttttagtagagacggggtttcaccgtgttagccaggatggtctctatctcctgacctcgtgatccgcccgcctcggcctcccaaagtgctgggattacaggcgtgagccaccgcgcccggccactcttaagtactttataatattgttttaatggaaaaacactgccagtctgtttctaggaacactcatcctcaggataaaaagagatattataaagaaaggggggaaaagtgtcctatggtcagataagtttgggaactccctcttggtaatttctttatttgtaaataacatttgttgggagagtattcactccgtgggtatagcgtactttggaacacaatgccctgcggcattttttgaggtggcagaactgagtaaggatacaagaatccttacacagatgcacttctggaagtgagtacaaatagccttggatttgttttcattctagattttctaggctacctttgggagcctgagattgccagaatattgacaagctagaaccatatgatgattccttaattggcatgatagagcctattgttgtgtctctccctgaagaacatttgtatccacccaagtgcaaactctagctgacaactaactttttatccacactatctgagtctattttttcaaaatgaacgtagtattattggaaatatttgaaatatgctaatgactctatcaggtttttcatggccccagatgaatcagaatttgtaagatttttattttctagaaggaatttttattttaaaacattccatgaactctccctattgccatgttggatacgctttctgcacaattatttgggaacaaaggaagggagactaatggccctgggaaaggtatcctattaaaatcactggtcctcaatatgtttagtgaataatacatctgcttgtgaagctgtccagtctgaagctgtgttttaagtcttaaatatttcccccaacattaaattttatttttattaatttaaatgttaatgcgtagatgctgcttgcttctttggttctgaattttggtcttgatgttttataattgcacttatcgatgaaagtacctaaaccagtagaagaattagaaacttgaagaaattgtgaagaaggattaaaatggcagataggaggcaggactagtttgcagctcccattcgaacagacagagcagtgtttggagactcacatagtgaacttttgctctaagaactacctcaagaacatatcaggaaagccaagagaatccacagaccctttgaaggaactggatcaccactgcaggcttcctgagatgccaaaaaaaactatgagtctgtttgctttctcaaaggagaggctcttggtctggggcaagttctcagccctagttacctgttgcctggaaatagattcagtgctgttatgggggcactgtgggagtgagaccggccttcaggattgcaggctgcatgggagcagggtaaggcctgtgactgccagctttcctccacctccctggcaacttgtatgactcagtagagacagccataatccccctgggaatataactccattggactgggatccacaccctcatagcccacagcagctgcagcaagccctgccaaaggagaggctgaactcagacatgcttaccccttcccccacctggtagtctttctctacctgccctggtagccaaagacaaaggtcataatcttttgggagctctatggccctacctatcacctgagaaaccacttaaccaagtgttcctagggcaactaggaacacagctgatacactcttgtcagtgccacctcctggctggaggccaaccaacacaaaaccaacactctaaacaaaaacacaaccaaggaccctcgcagagacgacttcactcccctgctaattccatcagagcaggtgctggcatccatggctgcaagacctgaagacagatcacatcacaggactctttgcagacactctccagtaccagcctgaagcccagtagctcctctgggtggctagacccagaagagcaaaaacaatcactacagttcagctctcaggaagccccattcctaggggaagggaaagaacatcacatcaagggagcatcccgtgggacaaaagaatctgattagcagccctgaatcccagaccttccctctgacctagtctacccaaatgagaaggaaccagaaaaacatctgggtaatatgagaaaacaagtttcttttacatcccccaaaagatgataccagttcaccagcaatggatccaaaccaagatgaaatctccaaattgccagaaatagaattcagaaagttgattattaagttaatcaaggaggcaccagagaaaggtgaagtccaactaaaagaaataaaaattatgggatatgaaacaaaaagtcttcagtgaaatagacagcataaatgtaaaacaatcacaacttctagaaggcaagaaatgcaaaatgcactggaaagtctcagcaatggaatggaacaagcagaagaaagaaattcagagttcaaagacaaggctttcaaattaacctaatctgtcaaagacaaagaaaaaagaatgaaaaaattgaacaaagcctccaagaagtttgggattatgttaaacatccaaacctaaaaataatcggcgttctcaaggaagaagagaaatctaaaagtctgaaaaacatatttgttagaatcatcaaggaaaacttccctggccttcctagagatctagacatccaaatacaagaaactcaaagaactcctgggaaattcattgccaaaagatcatcacctaggcacatagtcatcaggttaactaaagtcaagataaaggaaggaatcttaagagctctgaggcaaaagcatcaggtaacctataaagggaaaaccccatcagattaacagcagatttctcagcagaaaccctaccagctagatgggattggggtcctctttttagcctccttaaacaaaacaattatcagccaagaattttgtatccagcaaaactaagcttcataaatgaaggaaagatagtcttttccagacaaacaaatgctgagagaattcaccactaccgagccagtactacaaaaactgctaaaaggagctctaaatcttgaaacaaatccttgaaatataccaaaatagaatctccttaaagcataaatctcacagaaactacagaacaataacacagtggaaaaaaaggtaatcaggcaacaaatagcatgatgaataaaatagtacctcacatgtcaatactaacattgattgtaaatggcctaaattctccacttaaaagataacagaatgacagaatggataagaatgcaccaaccaagtttctgctgtcttcaggagactactctcacacataaggactcacgtaaacttaagatgaaggggtggaaaaagatactccatgcaaatggacaccaaaagcgagcaggtgtagctattcttataccagaaaaaacaaactttaaatcaacagcagtttaaaaagatgaagagagacattatataatgataaaaggactagtccaacaggaaaatatcacaattctaaatatatatgcacctaacactggagatcccaaatttatgaaacaattactattagacctaagtagtgagatagacagcaacacaataatatgggggactttaatacaccactgatagcactaaacaggtcatcaagacagaaagtcaacaaagaaaaactctacctaaatgataccctacaagtgaacttaacagatatttacatgacattctacccagcaactgcagaatatacattctattcatcagcacatggaacattctcctagaccatatgataggccacaaaacaagtctcagtaaatttaagaaaatcaaaattatatctagtactttctcagaccacagtggaataaaattcgaaatcaactccaagaggaacccttaaaaccatgtaaatacatggaaattaaataatctgttcttgaatgatcattgggtcaacaatgaaatcaagatggaaatttaaaaattttttgaactgaataataatagtgacgcagcctatcaaaacctctgggatacagcaaaactggtgctaagaggaaagttcatagcattaaatgcctaaaccaaaaatctgaaagagaaccaatagacaacctaaggtcatgcctcatggagctggagaaacaagaacaatcgaaacccaaacccagcagaagaaaatgacgaagatcagagcagaactaaatgaaatttaaaaagaaaaaagataaatgaaacaaaagctggttctttgaaaagataaatgaaacagatagaccaacgagattaaccaagaaaagaagagagaagatacaaatatgctcaattagaaatgaaatgggagatattacaactggtaccacagaaatacaaaagattattcaaggatactgtgaacacctttacacacataaactagaaaatctagaggagatggatatattgaaagtatacaatcctcctagattaaaccaagaagatacagaatctctgaacaggcagtgagattgaaatggtaattaaaaaaaattccaaacaaaaaaattccaggaccagatagattcatggctgaattctatcagatgttcaaaaaagaactggtaccaattctactatttcaaaggataaggaaatagagaatcatccctaactcattctatgaagccagtatcaccctaataccaaaaccaagggaggacataacaaaaaaaaaagagagagagagagaaaactacagaccaatatccctgatgaacgtagatgctaaaatcctcaacaaaatactagcaaactgaatccaacagcatatcaaaaagatacttcaccatgatcaagtgggtttcatactagggatgcagggttgatttaagagacataagtcaataaatatgatacatcacataaacagaattaaaaacaaaaatcacatgatcatcttaatagatgcagaagaagcatttgacaaaatccagcatcgctttatgattaaaaccctgagcaaaattggcatagaagggacataccttgaggtaataatagccatctacaacaaacagataacattatactgaatagggaaagttgaaagcattccccctgagaactggaacaagacaaggattcccattttcaccacttctattcaacatagaattggaagtcctagctagagtcatcagacaagaaaaagatatcaagtgcatcccaatcagtaaagaggaagtcaaactgtcactgtttgctgatgatatgattgtatatgtagaaaaccctaaagactcatccaaaaagctcctaaaactagcaaatgaattcagcaaaggttcaggatacaaaattaatgtacacaaatcactagctcttctatataccaacagcaaccaagctgagaatcaaattaagaactcaacccctttcacaatagctgacaaaaaaaaaaaaaaaaaaaaaaaaaccttaggattatacctaaccaaggacgtgaaagacctctacgagtaaaactaaaaagctctgctgaaagaaatcatagatgacacaagcaaatggaaacacatcccatgctcatggatgggtagcatcaatattatgaaaatgaccatactgccaaaagcaatctacaaattcattgcaattcccatcaaaataccaccatcattcttcaagaagtagaaaaaacatcctaaaattaatatggaaccaaaaaagagcccgcatagccaaagcaagaccaagcaaaaagaacaaatctggaagcatcacattaccctacttcaaactaaactataaggccttagacaccaaaacagcatggtactggtataaaaataggcatatagaccaatggaagagaagaaagaacccagaaataaagccaaatacttacagccaactgatctttgacaaagcaaacaaaaacataaagtggagaaaagacgcctattcaataaatggtgctgggataattggcaagccacatgtaggagaatgaaactggatcctcatctcttaccttacataaaaattaactcaagatggaacaaaaacttaaatctaagacctgaaaccacacagattctagaagataaaattggaaaaagtcttctagacattggcttaggcaaagacttcatgaccaggaacccaaaagcaaatgcaacaaaaacaaagatagacatatgggactcaattaaactaaaaagcttctgcacaacaaaagaaatcatcagcagagttaacagataaccacagagtgggagaaaatctttacaatctatacatcttacaaaggactaatatccagaatctaagaactcaaataagcaagagaataacaaataatcccatcaaaaaagggctaaggacatgaatagacaattctcaaaagaagatatacaaatggccaacaagcgtatggaagaatgctcaacatcactaataatgagggaaatgcaaatcaaaaacacaatgcaataccacctcacacctgcaagaatatccgtaatcaaaaaaaaaaaaaaatagatgttggcagggatgcagtaaaaagggaacacttttacactgatggtgggaatgtaaactggtacaagcactgcggaaaacagtgtggataatctttaaagaactgaaagcagatctacatttaatccagccatctcactactaggtatctacccagaggaaaagaagtcagtatatgaaaaagatgcttgcccactcatgtttatagcagcatgatttgcaattgcaaaaccatggaagcagcccaaatgaccatcaatcaatgatgggtatatatatatcatggaatattactcagccacaaaaaggaacaaaataatggcattcacagcaacctggatgtaattgcagaccatcattctaaatgaattaactcaggaatggaaaatcaaacatcgtatgttctcatccacatgtgggagctaagctatgaggatgcaaatgcataagaatgatacattggactttggggactcaagggaaaggatgggggacagcaaaggataaaagactgcacattgggtgcagtgtatacttctcagttgatgagtgcaccagaatctcagaaattaccactaaataacttactcatgtaaccaaacaccacctgttccccaaaaacctattgaaataaaaaaaaattttttaaaagaatttgttcctttcctttttttaattacatgtaaaactaggtttatggccatggggcatctgtgactcctcctctttttctttagagatgatcttctcattttttattctgatatgttatttcctctagcggcaacttatgttagtgaatggcttttctgtaagacccatggcagatacatatttttttttctgctgggaattgctgagagcttttcctaaggtttgaacacatttagaagcttcactaacacactcaacaaccttatgtctcatcagtttacatagacatttctactaggatgtgtaaaaagacaaattgtgtgtaaattgatttgcaaaatacatctgtgagataaagcaagatttgtttacaatgagtcacttagaatgtggtctaccttttagtctggatttggtatgagagattccatagtcattttagagccttaggctacatgaatattgctgttgttattgtatcatttagttagaatatacaatttctgtgcaaaagtagacaccacccagggtatacagcataataatgaccagttcttttctatctgacagtctggaagggtggcagatgaatgctatgagagggcccccttttctacagcatgcttagcttcctccccgatgtatgctttgatttggccttagaaagtgaaggcatgtggttgtaaaggaagcggaagcttaagaaattggtatcatttatcctggagaataagggccatagaaaatcttactaatggtatccttagtgccccagtggatttcctcccacccaagaatggaatacatacaaatccatggtagggctgtctggaaaacctaggctaccttattgcaatggtatcatcactgtatcacacacttggctcacaaggagacgtcttatttcaataagaagctttgactgcccacttcatgtcaggcaaataatatggacaggacacagttccttgcgtcaaggagctcatagtcaggcaacaatggcttcacatggatagaggcatttaaaccaggccttgaaaagttaggaagtggtaaaaaaaaaaaagaacaaattagaactcatgaaagtacatagtttgaggagtagaagatgtcttcataaatctagagtaatgggtgagtgaggagggggtgggaaacgagtaaagtgaaggatgagagtttgtgaagggtactggatgcaaagctaaaggttggagttggtgctataggcagcaggcaccactgaggattttaagcatgataggacttctttctaaaatagggatatcacattgactattttaactgctaaagtactatgataaatagaatagagatacagaaaaacagagtagggagatcccagttatactgagcctagagaactacagctttggagttgcttagcaaattttatttgctgtggtggatgagccagcttctacttctctatgttaaatataccaaagaggaagtgatggggtttccagggatgctgtgttcttcgcctacacgcttctctgcatcatgctaatgctgcattttgcaaaagctgtggtttacccagcttccaatgaattttgttccagtaaacttgcctaaaaacagaagtctgcaaaaaataagaaaatatgctatgaacatctgatcggacctttatggttaactgggtttttttaattgccgtggaacgtaagggtttagttagtctattcttaggctcctcgactcctgcaaacattctcaaaaataagcactaggaaaagaacgtttctactgggtatgtgacaggataaagaaagtattgagggaagttgattattataagagtacttatttataatcctgctcgtgccctcctcatattagataatcattatcgatgagctgatgcttggcccatgtgcttgcctgacactagcattttcagactacatgtgacccagatctcactgatttttcaacctttaagtcctcctttcttaatccttaaataattcaaaatctctaggtaagtgagaggcagcatggatagtagaataagcatgtgctctatgttagaacatcttggattccaatccttctgtgctatctagtagttgtattttcctggacaaattatttaacattctatcattatatatagattttgaaacagagtctcgctctgttgcccaggctggagtgcagtggcacaatcttggctcactgcaacctccgcctcctgggttcaagtgattcttgtacctcagcctccagagtagctgggatttcaggcacacaccactatgcccaactaatttttgtatttttggtagagacggggtttcaccctgttggccaggctggtctcaaactcctggtctcaagtgatctgcccacctcggcctcccaaagtgctgggattacaggcattagccaccgtgcccagcctaaattatttaacattttaaatctcagttttctctttttacaatgggaacaatttatcttcagttcttgataggataatttgaaataatatacacagtaactggcccctgctaagccatcaataatagtaactattattatcagattctaattgccaaaacagcaggttggatgttccaggagaggttataatcccagtatcaactctcagctctcgagtcttcatgtctgtatcccattgcaaagttcagcttggtcaggggaatcctcacagtgaggaggccctcataataaagcccacatgtgagtttggcctggataagttaactcacaaaccttcaccccagtgtagccaccatccatgagtatacatgaggctagtgtataaggctaattctctcctcactgttgtagtgaagagcacttaatagatgtgtcataaatgttatgcagacttaacactctgaggacatggggatgcacagatcatttttcccatcccttttgctctctctgtgatgtccttaacctaaataacagtgtgtagagaaaaatttataatattcctgaggaaaagaatagtagaaacagtaaatagctgttaaggtcaatataatttactacaaaataagttgtttgagatacagaaaaaaatcaaggcagagaaaacacaaccaaatctagtgcttactatttacaatttaccctggggcctgaattttcaagaaatctttctgttttttaatatagtcacaacaccacaatttttaagcattttcagaagatcctcatgcataaaaaaccaaggatggtgaccactgatgcttgtattattttcctttctctgaaataatggcatcttttaaaaggaatatatttaaaatgtaattgaaattattgagttgttgctctgattaatgtatgtgggaaaatagaagtcaggaaatgtttcaaaagctatatttctgttctcatcgccaatcaccatagaccctagatccatttagccatcccatattcacttgttttaggcaggatgttagaataaagaaatattttatgaagtgcttcatactggaatttactccttttctgaaagagggaagtgtgaatttatcttttatagtgaaataattttacctgaagtcatttcaatgtcatttttggtcataaatgaagagtttggtagaggaatctttgaactaattacctttctgaaaccttacagtattttgttgcaaaaaacaatggttaaacttataaagcagaggtttttggtaaagatgcaaaacatctacctaagaaagccccatgtcctatattttcatttttataatctataaacattaattgaacacctgggagaatggaggagagaaccaatatttacctcctatgtgacagttacttaccatgatctttttaaatcctcaaagccgccctgtaaggcatgtattattaccactggcaggtcattgggcctgtctgggactcagttccttatcagtaaactagatggtaacatgcttgcaggactgttatatggatcaaacataatctaggaaaaacacatgtctattagagttgcaaagatggaaaatacatggcacatgatgttaaagaaaactgtagtggcagtgctgctactaatggtgatcatctcatggcttgaattgaaacagagcactttggtggagcagtgatgtgggatatagagtgacaaggcaatgttcatagtggttgtgataaggaagaacttcaataatgtcctacagcgttttataacagaagcatcattttactaatcacaaatatataacatttcccgatttttttaaataaaagaattggcagtgaatactcttgctttaggacttaaatgaagtagagtcaaataagatttctcatccaggtcttttattttttttctttgatatggagtcttgtctcccaggctacagtgcaatggcacatcagctcactgctgcctcaaattccctggctcaaatgatcctcccacctcggcctcctgagtagctgggactacaggcatgcaccaccatacccggctaattattaaaattcttttttatagagacagggtctcactgtgttgcccaggctggcctcaaactcctggactcaagcaaccttcctgccttgacctcccaaagtgctgggattacaggtgtgagctactgtacctggcctcatcccagtcttcttaaattgatgtgaagatggtagtagattatttcagattttaggatgaactaataatagcagttagcatgcttgaacagactgtatctagttctgagctaaatgctggatatgtgattctcattgagtccaggaggtaggaaccactattactcctttgacagatgaagggactaagactgataatctcacaacttgcaaaactagaaaatctcatatttcttttttgtaaggttgttttttattctttgcccttttttaaactaagaaatatttcaaatattgaaaaataacattgaatatcctccacctagatttcataaatgttaacgaatctggatatttgtttcagatccttagttcagaagaaattaaaagttaccaatacagttgaaacctgttttctacctctccacaatccatttccttctccctctgcagatgtaaccagtgttctgagattgttttaaactcactctagaatatgtatataaaaaatggtatcatatagtttttgtgattttgaatttacataactggtattttcttccatattcaggtttatccttttgtttatttcttctatctttttgaggtaaatatttagtctattaattttcagtctttcttattttctaatgtatacacttaaggccatgcattaccctctaagtactagtttagctgcattttgcaagtttgaaatagtgccttaaagtttccaaaatagagagttattactgcgttactgagctccaattttgttgcatatgagttgtagtgtggtctatagaataccaactttttgttatttattgagagttaactttggctcattactggtcaatatttttttaaatgattatattgacttgaaaagaagatatagcctccctttgctgggaatagagttctacatagttcattagagcaaacttactaactattcaaaagtactgtgtcatttgaaagaagtatattaaaaggccccattaggattgtgattttataaatttctcctttaatttctatcagcttagctctatgtagtttggggttttattgctttatacagtttagccaaaagaccttctttatccttaatgatgaattttctctgcaagtctattttatcaaatattaatatcatagaaccaattcttttttggttacttttttttttttttactattccttttctgacttacctcggttgttgtgttttagttgattctggtatattttaaaatatccaatctgacaatagcagttaacagggaagtttgtcatgtttattgtgattacttacattttgtgattttctaacattttctattaaagttgctattttgctcctttttttctccttgtttgctttctattggattcagtggtttttcttaccctctctcctcattttctctccactatttagaaacttatacattccctttcttttttttagtggttactattaaatatcacatgtatatttgtcttaattaaataatatagtaaccacagattgcttcaatatatccccttccatcatatatattattgttgattagtgttttagttatgccttgtttataaactgtccccagatttgttataacatggtcattattatctgctgtggtctgaatgtgtctcccaagtttcctatgttggaaatgttggaaatcctcaatgcaacagtgtggggaggtgaagtctctgggagctgtttaggtcatgagggatctgcccacatgaatggattgatgccattataaaagggctggaaggagggagttcaccccatttttcccttctgtcttctatgtgaggacagtttctcccctctggaagatgaattgttcaatgtgccattttggaagcagagactggatcttaacctacagtgccttgatcttgaacttgtcaggctttagaactgtgagaaaataaattcctgttctttataaattactcagtctcaggaattatgttgtggtagcacaaaatggactaagacattatttgtttggctttgccacttactggctgtattactttgcaagttttttagatgtgtgatgcctagtttcctcatggatatactggggatcataatagtatctaattataggtttattgtgataattagatgagcttcatcagttcctggcacataactgctcagtgaatttcagctgttatgatttagttagtacttattagattgtcaacatgttcactgatatgtttatgaactattatttctttctcctggttcagttaccttcttcctgaagtaggactcatagtagttcctttaatagagttctgtgagtaataaactatcagttttatttgaaaacacgtttactttgttccatctttgaatgatgttagttgaatgtgaaattgtagatagcagttatttttttcccagaatttggaagatattattttattttttctggctcttatagttgttcttgaggaatctagttgtatcagtgatgatctgcattttcaccatgatttgtttagggacactttaaaaaaatatttccttgctcttacttttttttcttcttcaatctgagaactgggagctcttatgtttttttttttaattcagtaatgtcataagctattattgcctcaaatattgccttcctgcattctattctgtccttctgtaatccatacagaataaatctatcattttgtctcccatgtctctcaatctcactctcaggttttccatctcttcaacttgctttacaactttctgtgtgattttctcaggattcatcctttcaatttatttctctttggttgtgtttttaattctatttaatccttccatttagttttttagcctgatgcttggcatctggagaagacaagaacaggaaaatcaggacaatgacctgactgtgtcacccattggcatgaaataatgaggaaggggtgaggagaactatgaaaagcatgaatggcatgttcagtgatcctcaatcagtttaccaacaagttttcttggtattttaaccttttgtgtgtgttttcaaaggcgttgtaaaaaacaaaacaacatataaatttgttaaataataataatgtatctccagattttgcttatcacaaaaatttataacaaccatactttaatttaaatgaccagtgttactgtatcaaattggtattctttcaactaagagaaaagaaattaaatttgccaatttagtttatttggggtaccatctcacccataaagatataatttttctatgttttttagaatacttgaaactggttcatagagtccctttcgtgatcataggtttgtaaacactggcataacattactgattggagctctagaaagcgggaagtcattcttgcctaccatcttttattcagcatttagctactggctgatctagaaactgcatctacagccactgctcattaccttcttgacccaagttgcagcatctacagaagatggagatgcagtttgtaagtggtccaggaatgagtgttggttagcttttagaggatgttgcttggactagcacaaggagtatcatacaaaactctcttgttgccacccttgacaaatgaccctaattttcatatcggattagaaaattcgattggaccatcaaagcaaatgtgttcttttatggtttattagtgattcttcccagctttggtaagtgcaatttatataatcagctctcaaagattttcactatgggtttttatttattcttgcagaatagtgccttagaaaattttatacggatttttttttgcaactattaagcagttttcccttattcccactctctcaaaccccaatgcccagcatgaagaagaaacaaatctctattttcaaatctaagccactcatgacacacccagctgggcttactctgaaattggatttccattgaaggacagtgggcagaacactaatcacttgggggcctggggaaacagtgggagggtgaatcaggaagccatcaggagatgcagccctcttgctgctttatgtagttagagagagagcatatttttagaatggactttgctaggaggataaataatacagttctattatttggacgtttgaatcacacacgtctagccctttaactcatctgatatacccctatgtactattatttttccatagggagaaaaaggcattaagtgagggataggtatattaatgaatatacttagagttactatattgaaatctggggaatatagatacagagaccaaaatggggagtggtgttgatcattgttggctagtggccctgaatggagcagggagtaggttcctgaatgggcacaggtaggaatcatgtgggaaatgggcacgtgtgcatctttcaaatccctccatagggctgctgcctactgcttgtattaaaaggcattttatgttgcatctacttgaagatgcctaaatatgctatactttcacctctcctcattcaacatatgtccatatgttatgtatacttccattgtcagatttgagctcttgaagcatgatttttaatctgtgcatgcccacatccagtgcaaagtaaaaaccaatagtgtctttcaggtttagaactgaccacagtcaagtactttaggacaggaaagtgagagggccagagggaagcttcgctttggggagtaaaagaaccaatctacagaggcccttggtctcccacagaaacacagaaatgataaggaagtataactatgactaaagagaaaggaaagaagagagagagaaagtgaagaaacacagccaagtagaagcagagcctgctcagggaagcatagatgggttagaggagggacatttgggatgcacatcagaaaatcagatgagaagtccgcgtttgtctgttttgtctggtcaccataattgtgctggctctgagtttcaacctttgttaatcatacagccttgtttaaatatggaatcatttttcttttgtccttccttgactccatcttaaacatcacattactgataactcagagaacttttaacctaggcaatcttcatgtgagttccattcagttccttttgatatacacatatttaaagtgacagttatttcctcttatggaagatagattttatttaataattttttcaagcggagagattagttgtggtcacagtagaaaatttttcataattctccaagtactataaaaagtaacttgatggcataaagtgaattcccatgatgagagtcatcctgtcactgtgaattgctgtgatcatctttaaagtgatatatctttccacactgtctgtcagcaactatgtagggtttgttttagattcaaaaatgtgtgagattagttgatctatatccaaagaattcagacactttttgttgtttttggatctagtcactgttcactagttcagttgtggggtagttttcttatgtttatctgtcctgaagttttatattcagaggcagtttttacatgctctttttttcttacccttcacttaatgaagcagggttataggagaaaaataaccttttatctttcctcagtgatattaacttcattgcatttaactttttaataaatcgtatgcctactaatttacagaagccttatttctaaaaaatgtaatatatatgacttaagactgatcaacatcttcccctttctactacatacatattcggagtttttattttgttttctttctgtatatttcagactgggaaaaaatgtactatttgtaagcagatgatttaatttcagtaaatgtttttttatttctctctccctttgatttattgcttggaaaccatgagaaacatccaagtgcagatgctgttttcccactctgacaaaacattgcttgttgacctcgcaaacttagaaagatttatctcctgtgattcaatggtggaagtaataatattagcagttaaaattttctaagacacgatcaggaaaaggagacttcggtcgttctgcttcttgttaagaacagctggcaatttaaaaagcagagacttgctaagggggaaggaggtaaagaagatcaaacagaaatgcctccccctttagtgaagtatgaactgagggtgctgcatagtagcaataaaatcagattcttaaatgctttcccttgtttagtgtgtatatgtgcttatttttatttagtcttcaaagatgactttccttatatatttattctcttcgcaggaaatacatcttgaccaaatattttttgccaaatacttgttgtatattaaagccagcttaaaatgtcatatttgctgtggctatgttgagactctgacaagattatctgcagtgtgagtgatgtctgcaagagtggcctctcaccatgccttctgcacattgattccactaatctgccaggaggcagaggtgattcctatcattctgagagcttcctatagaaggcagggcctctgcagtctctagaactgaggaactaaatgaaggccaccaaagtgaccattaagttccttaattgtgaggaagcatctttaagaggaaatgattctacagccagaaatatgcgtgaccagttctacaggatgtgatgtcatgtgactggtggagcttgtctttctatcaaaggcttgtacagaaaagggaaaagaaatgggcatgtttcaggtcagttctgaataatggaagaaagaatgaaaggaaggagaggggaggggaggggacaggagcggagggaaggggaggggaggggaggggacaggagcagagcggaggggaggggaggagaggggagtggaggagaggagaggagaggagcggagaggagaggagagaggagaggggcatgtgagctggatttcttcaaaccccaccaacctggacagtgagtcctggaatcaaaataatggtgagcctcagcatctaacatcaaacacccagacttccttctggtttaagaaattccaaaggctctcagctgtgataaaattaaaaggacatattcctatttgttctttttgttattggttctctgtctccccctgaacctttagccagaaatagagatgcaccctttcttcttcagtagctttgaggatcaaagaatcttagttgccagagctgggaggggaatctcaaagattgcctagtggaacaatatgattgttcatgtgaataaactgaaactcagagagaatgtggtctatgcaagacatggcccatagtctgtgtcaaaagccaggttttctgacttgtggcccagggctctctgtagtattctgggccagcaaaatcccgtgtctctccagacacatcttctcttgcaccaaatgggcctccttgctgtgtcctcctcaaaccaccctcactcccacctctgaacctttgctgatgttcacaccctgcacagagtgcccttctcctccaactcctctgctcagcacatcacatcccctaatgctcagcccgatctcatttccaaagttaaggctctgctactcttccagcccaaattgatgtctcctctccctagaccccttcaggtcttttttcattccctgtttcatgtttgattttaacttctcaaccagatgatactttcccaagcctatgtttttgtcttttccacagcagtcctcccagcacctactgccaggccaagtgcttttctctacttcagtcttcttctctgttaaatgtgaataataacacctgctctaaatctaagcctagtggactcccagcttgttgaagggcatgttgaatagtcttatgtactggaagtttgagcttttgggagggtaaaagaagggacagggatgcctaggcacacagaactcaaatgcagttatttgggttttcctctaacttagcctccactggtcaaatgtttttagcacctgcaccagcagccatttccatgtatcccttctccctggagacagtacaaacaagagataattcctatcattgttgggacagaagtctctcaaagcccttaccaatattatagttttgagattcacagtttcctctgaaacttcccctttaggagggatggaaaccacaggatgggcattctggtaaatgctcaacatagatacctatggactgggtagcaggtgacccctaggaaaacctcaaatatcctataaggtcctaataagggccagttattctaagcaaaggagcttctgtgagtcatagtgcaatccatagatatgcttgttagctccttatttaaacccttcctgaaacaacagccaagaaaggaaaggactcaaggtcacctctggaatcagaatctactcagtcttttcccatcctagtttgtattcaccatattcagccctcagccaacttgaggcagagtgccttggtagaaagtggttcttagagacaggcatccaggcaatgtagcaaagtagaaagagccctagactagaagtataaagacccaggtttgaggcctgactctgccacctgctgtctcaaaaactgcaataatataaagtctcttaccaattctagcttcagtcttctcctttgttaaatgtgaataacaataatgccttccctgccagtcatggtggctcacacctctaatcccccctactttgggagaccgaggtgggccaatcactcgaggccaggagttcaagactagtgtggccaacatggcaaaaccccatcctactaaacatacacaaattagctgggcgtggtggcaggtgcctcttgtcctggctactctagaggctgaggcacaagaatcacttgaacctgggaggcagagcttgcagtgagccaaaattgcaccactgcactccagcctgggagacagaacaagagtctgtcataataataataataataataataataataataataataataataataatgctttccctacatctagctataattatttctttaacatttccttccctgctacattgtcagctgcataagagcagggtctatgtgtatcttgtttaacactgtatccccagaaccctagtaggacatgtactgtattaactggttggttgactgagcaatagggagaagtttagagcaagtgcaagctattattatgatccttattatgtttgatgttgttgttatgtctccctagagtttggtggattttggtttggatttccattccactctccatcattgagaaggaactgagtcaaaagacccatagtggatcagcagagaccaaccactcaccatggtcataagtaatttcagagcccatagtatctctctgtagattcttccctagtctcagtacttggccacagagtggatggctttgatcttacacagattgattctatatcccttgatgggtgtgtggcagcaatcatcaacagcaaggtgaccttctctgcttatcatgactggccccttttcttctataattttcttctttggtttttgatgtatgagtatttttagtgacaaagataattaggtactttagtgacaaagataattccaatggtactgtactaaatgtggcttctgcctgaggatgcacttgtgtctgaggaggatctagactgtccaagtgagctcttattttaaagcccctcttacaggttggctcttaaggactgaggagaaagcagggcctttagcatcagacaggtctacttttggaagcccatgtagttgacaatctagctacatgggacaatgtagctacagggaaggaaatgttaaagaaataattatatgtgtgaagaatacctagatgtagggcagatattattattatcatttaacatgaggaaaacttagtctgagagaagcaagaagctttgctccaagtttttgagacagtgacacagataaggtgtctctccttattgtataatagggacaataataaagccatcttcaagggatgttgtgatgaatcagtcagaaaatgtatgtgaagttaatgagcaaagagtctggccatagtattaattagtattaatactattaataagtattcaataaaggagagtctcccactttctttccttccactctgttttccataaattaaccagagataaaagtggtggaattagacttcagtcctgtaatggtgcacctgaagtgcttcctctcaattcatatccatcttccagattgcttgttgtacccatattttctgttaacacaaattggagggagtatcatgactttcatttgttgacagatacacaaatgggcagaacacaatgatgaatgtctcaattcagacaggaattgaatgttgcctgtggggtaggctggctctgccacctgcactgacaatacatcatccctggaaattaacccatcttcaccatagccattgaaatggaaagaagtgcttgttcattaaaaacaccttcaaatggaaaggatgaaggtctagcgtagtatatatggtgcattaatatctataatcatgtttaatttgcattagtctaactctgccacttggaaactgtttttaagatattgtgttgcctgaatgggtttgtgtatgcattatttgcttcttgaataagagctgaacagaagctaatagctttatataaaatatagtgattaccaaattcaagagtcaatgtcctgtttcacattcattcttgctcacttttagtacaagcttatgcatcatcaggcatgttgtatacaaaaataatgatgtgggtcctggtctttataggtctaatgggtggtagttccatatttctgtaaattttaaaagcattattactcactaaatatggatcattttaaaataattagatatatgtatgaataggcttcatatcacaaagttttattttctttgttaaggatatgaatcctaatgtctttactattgaatctgctaattcaaataatatctatcagtaggtagatgagctaaacactaagcctgtatgtcaaattttatacacgatattatgcttagatgcatacatagcaaaaccaatatttacaatatattggtgtacaaacaatatattggtgtaaaaaaatgattagtgcttcatcaagttaatacattcaggtatcataattatgtattatttcatagtgtatcaacaaggagaagagaaactagttatttcaagcaggaagtgatttaatttagggaaatagattctataacagaaagaattaatgtttaccaaacactatattgttctcccgttctctcttgctgttaattgggaccctgtgatagtcctggctgaaggactgtgaaggggagggaagaattaatatcccagggcctaactggttaagagcttgtgtgcctctttcaaccctcactttccctggaataaaccttggagctatatgttgaaatagaaaataaaaatatggatgaatcttggtcgtctgagtcaccagatagaggagatctcttgccaatctgcacgggattttgcatgaacaaaaagtcaccttttactgggataagccacagaaatttcagagttttgtctattgagacagctagggttagttactgtaaaaatactagggcctggaaaaatgttggaaggattgagagagggaagatcaggttgcaactactagtatgcagaaaatcataaagcataggaactgcaggaaactgtcaccaatgatctcagctgtctacagcaccaaagtgagtggtcagtaggaagatacttggaagctgttagcaaaagctcacatctggggtctacccaagtccatgtgactgcctgtctcaaaagagtaataatagttctatttatcttttgtctttgaaaccttgcatgaatgagtctaattgtcttaatttaaaccataaccctgctggcagagattctaagaaatgtagttctcatgcttccaatccctataatactaaggagagcgtagaaggagaaaatggtgtcaaattgccaaaaaaaagaacctggcatatagaagtagcccaattattaggtgatgacatgccccagtttgtctgggacagtcccaatttattcctgttgacctagagtaatttttgatagtaccccgtttcaatctcaacatgttccctgcttggacactaaattatatggacatcgacctattaataacatgataaaaatactttatttcatcaaaaaacacttattcaggatatgctaagtgctaatcattgtgtgggacattggtcaacagaggcatttatgaccttggcattcatgaaacttagagtcgaatctagtgaatgatgggagcctaaacaaggcaatagctatgaggatggagcagaggaggcatactcgaaagaggttgaagaactaaatcatacaggtcttgataactagcatactggttaagacccttaggctcttacgtcagactatccaggtttgaacaccagctctatcacttgttgggtattttaacttgggaatttaccaactaatctctgcctcaacttacaactctgttaaatgggaattataataatacttataagattgttgtgaaaattaaatgagataaaaatttataaagtttataagagggcctaaaatatagtaaatgctcaagaaatatcattatagtgaagaaattgtggtggttgttgttttataatggctgaatatgagagaactgttaagaaaatcctaggtttctgacttgaatatcttgatggatggttatgtaaaataataaatgcagaagaagctgatttatgtgggggaaaatagtgcatatagtttgaatggattgctagaagagtaaacagaggaattggcattctaatttaagtgggggaagtaatgcatttggtttgattatgctgagtttgagggactggtgggaaatccaaatggcaaggtctgatagcagctgaatagttagaattggggctcagataaagatctgagctgaaatttagacttgtgaggtttttttttttttaaaaaaaaaacacttctattttaagtttaggtgtgcaagtacaggtttgttacacaggtaaacttgtgtcatgggggtttgttatacagattatttcatcacccaggtattaagcctagtacccattagttgtatttctggatcctctccctctttccaccatctcacaccagtcagaatggctgttattaaaaagtcaaaagatttgtgactttctagatggtagctgaagccaaggaaatttgggagatgaattagagaaggtattcagagtagaccagaactttaaagggcagaggaaaagaaacatatgagaaagacaagaaggaattgccagaaaaatagaagagaagcaggcaagtgatgtgaaggaaggcgaggaaggagagaaagccagaaagaacagggtggacgatggtgttaagtgtcaagcacaaatcaagaagatgagaacagaaatgatttccacagattcagcaattgagggcttttgctgattttagtaagaatagattcagtggagtagggaaggtggaagtcttctcaggtcaccaagggtagaggtaagaatgagaagagagaacatatagatcatgaaatattaatcttcagggtgcttggctgtgaaggaaaggaaagggtcaactggtggctagaggctttttaaaagcacagcctacaagatcctttggtcctagagttgcacaaaggatttgcagaccaggaaaggtttagataacatgaccaccaaagtcttccccatttcaaagtgtttattatttcatgattctctgcttaataagtaccaaggttcagcttttattttcacaggttgttacctgtaaagagggtacaaaatctgttttatcctaacaaatttaagttagaatttagtttgatcttacgagtctttagggaaatatattttaggagtcaaaatgtgtatctgtacatagtatatttatgaatattgttcttaatttttaattcagtacctttacaaattattttataattggttcctgttttcaaccagttgcttgtgcttatatatgcaatttgtctatttttttcatatctgttttcagcttctcccaaagaattatcattaggtcataacactgggggaggtttactgaatgatcattcttttcaaagactttaccatttcccccagagccttggttggtttattgactagagcaaagcagttagtttgctattagtggaataaggtaggcaaagcatctggaaatgttctaccaggaggagccagtggccttgttttcgaaaagtcccaggtctcccatcactccctccagtcttgctagggcatgaaagaatcagaatttataactgcatcataattctgtactacagcctttcatctgggatcttctgtttggaaagtctcttcaaatgttttcttagcctcaagggaaaaatttctcccagagatacctcaattttgatcaaaagcattcacaagtccacttttagttttttctctaccaattaaagtcctcttagcttggtagattaaagctcataaaactggttccactggtttattagaaaactcactttagctagaagagtcgaagttttgatatacacagaccctagagagctaggaaaatcttacttttctccaaaggattcaagtcctattatttaattttcatctgattttggccaagttcagatttttgctgactgtgtaacatagcctattcatttcagctacaaatagttctcttttgtttccatttacttagaaattaacaaaatattgccatcattttatgtgttttcataaatgtatttaaagccttttataattatgatatttaaatattctgtttttaaattccaaataacattagttgagagatgcatctttgacataaaaaaaaatttcaggagaaaaatttcttgtaaaagcttctcaatgagtgtatacattgatcataagaccattctaattctagaaacattaaatatgaaaaagtatacttttggaattgaaaagatatggcattaatggtcatttcacttgacttgaggcttcccatgtgtgggattcatcattacttcatatgcatctatctaatcttcatttatccattcagctcacagttattgagaacaatattaagtcttaagctcttttgctaagcaacggacaatgaacactccctggtgctagttagcatccgaatttgtaaagtgagccatttgttgtatgttttaaccttttaaaaaattcagcatttttctctaaatattttgaaatctaactcaagaaaaataaaaatcacccagtggctttttcacataattttaatcacctttattcttctgcttatcctgtctcctcagtcttacattcccctacactatgcagcaacctgagttgatagctatcataccacgccatgctactctcatcatcatacggtggcatgattaagacagagaagacttgaaaataagtatgcttaaaatcttcagaaaataaaatgtgaataacatccactaaaaaataaaaacaggagtttatgaaataacaattaagtggtaatcaaattagaacatgcagattcaaaagacaaccgattgaaatgattagaaataaaaatgtatagtcatttagaatttctagaaaaaaatctaaataaaaggaataaataaagagaatgctgtcaaagggagactttataaattggatcacggaaattagaaattaccaaactgtgcaaaacagagaaaagagaactgaaaatataaaagattttgtaatgcaagaagttctattatatataagtaaatagttccagtgggagaaaatagagaaaattgctgaacagtttctagaattaaggcaagatgtgagtattcatattccaaaaaggacaaatcatgccaagcaagatgaaaattttaaaacctctttctatatttacattataatgaagctaaagaacatcaagggcagaatatttgcttttctgaatggggagatatgaaatatcattgaagctttccttgattactagaggtttattcctgcattctgttgtgataacactttcttctatgttgatttagttatttgcctgctgtaacttctcatgcagtcattgtactggcctccagctcacttttgtttactgctgttctatgctatttgctggacaaaccaaaaaactgcctttgttaaaagacttacaataaacaacaatagcttattaaacgaagaattggctttaaagaaggtacatgatactagcgtagcaaaagctaacattaatcaggtgttttctatctactagacatttttacaagatttttctcacttaaccctcacaatgtccccatgaggctggtattactctatcacccccattttacagatgaggaacctgaggcttagttagagaaactgattcacttgcccaagatcatgtggctttagcaagtatgttaagtggtgcctcctagattttaacaaagtcaaattctaagcccaaaatttttaaatactcctttttcttatcctttttttttttttaacttttattttaaggtcagtggtacaggtgcaggtttgttacctaagtaaacctctgtcatggggtttgttgtacaggttatttcatcacccagctattaagcctagaacccattagttatttttccttgtcctctccctcttcccagccctcatcctccaaaaagccctagtgtattttgttcccctctacatgttcatgtgttctcatcatttagctcccacttataagtgagaagatgtagtatttgtttttctgtttctgtgttaatttgctaaggataatggcctccagctccttccatgtccctgcaaagaacatgatctcgttcttttttatggctgcctagtattccatggtgggtatgtaccacattttctttatcgagcctaacattgatgggcatttaagttgatcccatgtctttgctattgtgaatagtgctgcagtgaacatatgtgtatgtgtctttataatagaatgatttatattcttttgggtgtatacccagtaatgacattgcttggttgaatggcatttctgtctttaggtctttgagtaattgccatgctgtcttccacaatggctgaactaacttacactcccaccaaaagtgtataagtgttcctttttctccacaaccttatcagcatctgttatttttgactttttaataacagacattctgactggtgtgagatggtatctcattgcagttttgatttgcatttctctaatgatcagtgctgctgagcttttttttttttgtatgattgttggcttcatgtatgtcttcttttgagaagtgtctgttcatgtcctttgcccactttttaatagggttgtttgttttctttctgtaaatttaagttccttatagatgctggatattagacctttgtcagatgcaagtttgcaaaaattttctcccattctgcaggttgtctgtttactctgttgatagtttctttggctgtgcagaagctcttaagcttaattagatcccatttgtcaaattttgcttctgtggcagttgcttttcatgaatcttcatcatgaaatctttgcccttgcctctttccagaatagtattgcccaggttgtcttccagggtttttatagttttgggttttacattgaagtttttaatccatcttgagttaattttcatatacggtataaggaaggggtccagtttcagttttctgcatatggctagccagttattccagcaccatttattaaatagggaaacctttccccattgcttgtttttgtcagcttcgttgaagatcagatgattgtaggtgcatggccttatttctgggctctctattctgttccattgatctatgtgtctgtttttgtaccagtaccatgctgttttggttactgtagcctgtagcatagtttgaagtcaggtagcatgatgcctccagctttgttctttttgcttaggattgccttggctatttgggctcttttttggttccatgtgaattttaaaataaattgttttagttctgtgaagaatgtcaatggtagtttaataggcatagcattgaatctataaattactttgggcagtatggccattttaaagatattaattatttgtatccatgagcatggaatgtttttccatttgtttgtatcatctctgatctctttgaacagtggtttgtagttctccttgtagagatctttcagttccctagttagctgtattcctaggtattttattctttttgtggcaattgtgaatggaagtttatttatgatttggttctctgcttgcttattggtggtatataggaaggttagcgatttttacacattgattttgtatcctgagactttgctgaagttgcttatcagcttaagaagcttttgggctgagacaatggagttttctagatataggatcacgttatctgcaaataaagataatttgacttcctctctttctatttgaatacactttatttctttctactgcctgattgccctggcctgagcttccaatattatgttgaataggagtggtgagagagggaatccttgtctagtgaaatctgattttcaaggggaatgcttccagcttttacttattcagtatgatgttggctgtgggtttgccatatatggctcttattattttgagatatgttccttcaatacctagtttattgagattttttaacatgaatcgttgttgaattttatagaaagccctttctgcatctattgagattatcatgcggtttttgacgttagctctgtttatgtgatgaatcacatttcttgatttgcatatgttgaaccaaacttgcatcttggggttgaagcctacttgattgtggtggataaactttttgacgtgctactggattcagtttgatagtcttttgttgagaatttttgcatcaatgtttattaaggatactggcctgaagttttctttctttctttctttctttttttttttttttttttttttgtatttctgccaggctttgttatcaggataacactggcctatagaatgagttagtgagtagtccctcttcaattttttggaatagctccagtaagaatggtaccagctctttgtacatctggtagaattcagctgtgaatccatctggccttgagctttttttggttggtaggctatttattactacctcaatttcagaactcattattgttctattcagagatccagtttattcctggttcagtcttgggagggtgtatgtatccaggaatttattcatttcttctagattttttagtttatgcgcatagaaggttcataatattctctgatggttgtttgtatttctgtggagtcaggggtaatatcccccttatcgtttttgattatgtttatttgaaccttctctcttttctcctttgttagtctagctagcaatctattttattaatttcttcaaagaatcaactcttggacttgttgatctttttaatggctttttgtgtctctatctccttcaattcagctcagattttggttatttcttgtcttctgctacctttgggatttgcttgctcttggttctctagttcttgtagtggtgatgttaggttgttaacttgagatctttctatcttttggatgtgggcatttagtgctatagatctccctcttaacactgccttgtctgtgtcccagagattctggtacgttgcatctttgttcacattagtttcaaagaacttcttgatttctgccttaatttcattgtttacccaaaggtcattcaggagcaagttattcaatttccatgtaattgtatggttttgagtgaatttcttagtctttatttcaattttgattgtgttgtggtccaagagactgttaatatttccgttcttttacatttgctgaggagtgttttactttatgtgatttattttaaagaaagtgccatgtggcgatgagaagaatgtatattctgttatttttgggtggagagttctgtagatatctatttgatctaggtccatttgatccagggctgagttcagatcctgaatatctttgttaattttctgtcttagtgatctgtctaatattgtcagtggggtattaaactctccagctattattgtggtgcagtctaagtctccttgaagttctctaggaacttgctttatgaatctgggtactcctgtgttgggtgcatatatatttaggacagttagattttcttgttgtactgaacaatttactattatataatgcccttctgtgtctttttgtttatctttgttggtttaaagtctccttcgtcagaagttagaattgcaacccctgcttctttctgtttcctatttggtagattttcctccatccctttattttgagcctgtgtgtgtcattgcatgtgacattggtctcttaaagacagcataccaataggtcttggttctttatccatcttgtcactctgtgtcttctatttggggcatttaacccatttacatttaaggttagtatttatatctatggatttgatcctgtcatcatgttagctgattattttgcagacttgtttatgtggttgctttatagtgtcactggtctgtgtatttcagtgtgtttttgtagttctaaacccaaattcttaatgactactctatatcttttttagtggaaaaaaagactttatttcttaggaccccacacactataagcccctatatatttctcttgaagcctgaaagtcttgacttattcttcagctgtaatcagctgtggtgtactttggggacccatcactagatttgcactgtgaggttacctatgctccatttctccagtggcctggtgctatctgactcaatctggagtaatatgcatgctttgccaagtgaatttgatgactgaagggttccataagggtctaagataagcatagatgcatattggcatcatctgcttggaaggggcctttaaaatgtcaccattcctcactatgctacaccaaggaaggggggataattatcattgcttgtggtaggtgaggcaggatggtcagagcacgtactttgaacctcatcattctgctaagtactactatacgttatttttttgactatcattatcactgacatctaggatataagcacctgtctttactaatcagacttagtaagacattttggtatgtgttgagaaacagtaatattgaacatataaccttacagatggaattacattttggatttaactatcctgacatctttttctttaactctcctaattgatttccattatgttgaaatccaagtccatcctttgaaatgttagcgggaagactgaggattgaaatgtgtagatagaaaaatcacagaatttaacttaaagtacatgaaaaaattccaatgaaattataaccattaatatccttaatacataaaatattcatacaaatcaataataaagaatccccatgactgcaataaataaataagtaaaggtccaaaataaataatttgtaaaaaaaaaaaaaagtttaaaatgttaaatcccagtagcaatcaaatacatataattcaattcaaaacactgaaatgacacttgtagtcttttaaattagtgattttaaaaaaacaaaacaacaaaaaaacagaatattggtaagagagcaatgaaaaatgagttttcatacactgtgggaaaataatttggtaccaactatttaaaaagcaatttggcaatactgtatacatcaagagctacaaaattaccctttgactaattttacttctcataaattatcctgaaaaaaattcaaatatctggaaaagctttagttcaaagctaatcattacaatgttatttgtaatgttaaatatcagaaataaatgaaaattactaaaattgaaaaacagttaaagtttacttcatccttaaaaggaatatttcacagagaatacaaatagaaatacagagagactgtgaaatagcacagataaatgtctaagctttaatgtaaaatgaagaatatacatatgtaatggatcaactataagaaacttaaaaatatgattaagaaagaaagattaaacaaaaataccaaaatttcaacaaagattatctcttgttaatggggtttgactatttcttttctgtgtttcccaaatttttatgatgaatgtgatttattctattttaagagggaaagaaaatttttttatgaagaaaaattgaattaaaataaatttttatggggctgaagaaaaggcctctataaatgtgacttgattgggaagcttgtgaattttttctgtaggaactgagtatttatgatctttttttttttgagatggagtctcactctgttgcccaggctggagtgtggtggtgtgatctcggctcactgcaacctccgcctcccgggttcaagcggttcttctgcctcagcctcacaagtagctgggactacaggtgtgtgccaccacacctggctaatttttgtacttttagtagagacaggatttcaccatattggccaagatggtctcaatcgcctgacttcatgatctgcccacctcagcctcccaaaatgctgggattacaggcatgaggcaccgctcctggcctatgatcattttatatggactgatttaaaatctgttttgaagccaggtgcagtggctcacgcctgtaatcccagaactttgggaggctgaggtgggataattgcttgagcccaggagttcgagactacccaggacaacatagggaaattctgtctctataaaaaataaaaatacatttaaaaaatcaaataaaatctgttttgaatagccatcaaaaacaacttctcctacactaacatttaagagcgtgaaaggtggcaagaaaagttctatcatagcttagatcctaaactattctacgcaagtttttgatgggctctaacatgttaatagcatatatgtaacactaattacaaagaaacctcatttcttcattgaaaaggttatcagtttaatgcagtgaaatctgactatgtgagtgtgagtatatacagttgtgctaatatcagtttgtagtcgttcaaggctaatcttcccactccagaggaaatttttttatcatatatgcatacattgctgcactgaataatgggaacctaaaataaaaaagatcattgcctattttatatgctccataaaattcactgacagtaaccaccaacatcccaggtatcgtctgcagtttagaatcctgaatattttccccaaaaatgtccgataagggaagcaatttaagcaaggcagacagtgctgctaacagagaccatacagtttcagccagcgagtctgctgactgaaatgaagtccttggacctgtggtttttttgtggggttatttgctcttgtagaataaggctctcagaatttcaataaaagggtgaaaacagttttgaaactgagaagactgttacactgcctaagaggaatagaggtgtgattgagatgtggtgaaagaatctgaaagttgagttgtttttttttaagtctcttcccgtgtctatgtcctgccatttcttagatttatacaaacccgacccaaaaaagggtgtcaggggcttgaatccagcaggcactctcatacaggtctgttataccacttcaccttttatagtcagtcgacaggacagggggaattacttagtatacaaagaagtgcaagggaaataaaacctatgcaaatcacatttgtagccttctaaatatttgacctatatgaaaaattccagctttgatttcttagtccaaattgcaaatcagccaaacgtagctgattctgtcctatatgaattggttattactgtctttccctttcttagaacccctgggaacaaacaagaaaaagtaaggaaaacaaaatacttattaaaatgtaaatacagtggctggttccctgatatgttatgctgacaacccttgctggcaacccaggaggacccaggtgcaccaggaaccgacttatctggtcacagaacatcgggggctggaaattgacagcctctgaagggggccttttgttacttgacttctgtggcaggttgctggctcattctcctgcatggaagagttgaaactcgtctttcaactaaatggagtacatgagggcagagattcttttttggtttggcaacccaagtatattaggaaaaaataggcactgcaaaatagcaggaaagcatgaagaatgctttatgaagaaacataaaagaaaaccagaggaaagcatattcagcctcagtcattaaaaagcacactactgttcccagtcttgccttctccaaaagtttgtttgtttgaagtttcttctgcagaactctaagcaggtctccaatataccgacatctttaacagcattctggaatgagaggagtgtctattaagggagacatactcctctatttcatttggaattttacacaacagttttctgtgtggcttaatttttggcatcaaattgttttaacagaagctgtgcttttcagttagatctttatctttgagttctagtgtcctcccacgatgcccctaggagcctatcaaagcaggccaaccctgcagaaatgcctagaataaaataacatgcaaatgccactaagaacttgcttccctcctgactcatattttagtttctataaagtgtctgttttcaaaactgacagtgtctgtagcctgttaatggaagataatgatttgcacaccaaaatgggagtaatcacagggctatttgacactgtccttagaaaaattccttacttactcaaaagccaaagcaaagaactatttctaaaatgacaaatgtgtgtaaattttcaaagtggattgtgatttcacccaggaaaacacaggcagccagaacacagttatgctttagtgtatatggtgatctaattcttgaaataaaactttattctgggcaatagcatgcatttctagatgagaggagaaattgttattgctcataataaaggacgaaatgtttttcttatttgggaacttcagggggatgaagtaaggaagtgggctgcagaacactgggataaatcttatttatttaacatttaatgctatagtctgttaggaaacaaactcactgcggtataattatttaatactggacagtaaaatcatctgctaagattagattaagtagttgactcaaagtactccccaggttcaaggctcaaaaatgaataaatcaacatgcttactgtacagagcccttgaacattatgtgtgctgggatggtggcttcctgaactatcgcctcttgtttgggtctgttgtgaagtcaaggcttgaggacatgacctgacctctttatttaaaaaaaaaaatccatttaatatcagttatcacttgaagaatttaaagacagaattatttgctcagaaaaatttgatgctttgtgctattaaaccctcagtacacagaaatagatttaagcaacatggtggtgaatcaagccaaggagagctgggaagctggaattgatggctcagtattctctgtaataatgtgtcaatttatgcctggacattttaggatgtctgtttatacaaatgtgaacaaatgtacctttgacttgtagccagggtgaacccagtgccaaaagaatagctcttctcttagactgggtttctcatttttttcagttttgtgactggcctagggtgtattttccttattggagccttgtgttgttgtcaccttcatccatgccaggttctcataggactaatccccaaggaagtcatccccagtctactgggcacactgagggaatccacgtgtacaatggaggcttaagctgtgagctttgctatcaggagaacctggctttaagtcctgtttctgcccattattatatatgtgaccataagtgagttgcttaacctctctaagcctcagcttcctgatccatacaacaggaaaagtactagtacctgcatcctgtgttactgtgaggttcaaaaagtaaaggaactaatgcacataaagtgtttagcatattgcctggcacaggatagggactccataaatgccagctttctttatacaaagaaaaacgtctttgccctttagttaatgttctcctgtccatgtcaaggtcagcatgacaccatggtagtctgtctagcttgtatttgtgtctgctgctcacataattgtttcttcacttgctgacctggttggctgaagttttggccatgggccaccctgtctgtgccccctggctttggatcccatctcgtcctatccacaatgtcaggagcaaagccacttctttacatacgtggcagaatccagccagacactctgcatcagcaacgtctccacagccagttgcttggtcttcagcctgtcaggcgctgagcacttgttctccatctgaaccagctctgtgctggcctctagcaattataatgcacctgctgatgcctcagagagccaggccagactgacactttcctctcggtattctttaattctatgcttgaccagttccagcattctttcttcttggtcccagacactttccacctcatctcctacatgtcacatctgatttgtccttattgtagaaggtaggtgtaaggcctaaagagtgagtgtggtttgttgtcagctgctccaaatggggcagcattggcaggaggtgcaggaactgatagaataagatttctatatcttttcttgagtttgtgacagtgctgtttatggtcaccagtttttatttgaggaattatccatttatgcaaaaaatgttttttattctatatatcctttaaaaagacatacaggttgccctctggaaatgagtcttaagcatgtctatagtatagctatatcatccacatcttgagtcattttgctcagtggattttcttaattctcaattaatttgtattctgtcagacagtctagtgagggagtaacgagtggtaagttagaaggtgacaattttatccgaggtctgtgcatagggtacagtggaagaatggagacggtgatgcctcatggcctcagcttacagtgtgatttgtacattttctgtgatttctataagtaacaggctgacagtgttggatttgctgtgttgtgctttgtatctacctttgtactgcctcttttttcccctcccacgctgactttatctcattccttgttttccttgagaagattgcactggaaaacttgaagaggggttagaaggtggggccatagtagataccagtaggaagacttcagaacagaccctgtcccctgctgtgatgatgccttgtgacttaacactgatgaccttacatggaggatttagtgaaagttatattagaaagcaattcagttacttccagattgttattgaagtccagcctctgtggtctacctatgccattagtatttgtcctaggttatttttgctttcgtatgtcagagaatggtctcaacgtaagggggtctgagtcagggtggtctagttgaaaaggtatgggcattggagtaaaaatataaaaaatctggattcatatccagcctctagcactgaatagctctgtgacattgtgcaaattgcttacattcttttaacttttgtttccttatctgtaacttggggatccagatataataatactgtcaggtattatagaattattgtgaaaattaaatgagataatgtctggaaagaacttagcacagcgtctggcatagtgttaagtacccagtaaatcctgattctttctctcccccagcctcactgcctcaccagctgcccagctgtctctaaacacagcatcagtggaactgtaaatactttcacagttatgtaatcgctctccacaaattcactctttgatcacctttctgccctccctccagatctattcctaaactcaattttgactctccctctggtataatctccttctctctgcagagaacagtaagaccttaatgtttaaaaaaatcatttcttcttaaaacttaaaggccctaaaacatcattttgagtttttgtctccagcagggtttatttctgacaacaaaattaatatatttatatttaatatttggagcttttattttacaatcatcttgacagtaatatttttctgatatttgaaaagccccatgatttttctgtgcagagaatgcattttgttaatttatctaagtggctgctaggcttttaaggttttaggttcattttttatttttctggagctcagtcccctaaaatgcaaatgagtcttgagcagctcttccagaagataaattattcttcttttctgtctcctactgttcaaagttagtgataatttttagacccagcagttgaagattttgacattcctgttgatataaatgtggacattccaatgttgttcaacttctgactgtcttagggactgattgcttatctctatcagccaagaaaatgccctttgcattggtctcatctctcacccacaccaaccaaacacatatatgcaatctaatgtctataggtcacattcttgccactttatctctttaaaattggatagttttagatggaatttgcaggtgctaatatggaccactgggtaacagggatagatacagtagcattgttagattatattctctaagttgagatttttcacctaaaaagagacagaagaagatggaggttgcacagtactggtcagatcttcccatgcagtttatcttttggaagggcaacagtataaagcagttaagagcattaattggacattaggcagtcctaggtttgaatcctggctctgacacttattggctgtataatactggtcaagtgacttaatttctctacctctcagttttattatttgtgaaacaggatgacaatattacttgctttgcagaattaaatgaggtaatattttgaaaattatatgagctattatctaaaaacatttagcacagtgactggcacagcatagagtgcccagtcaatcttggtcccttctccccagttttgccctgaatgttggccagctttgctgcagatgctttctccactatgccattactctcatccaatcctttcctttattagctttcttccctagccctcacttcttctcttggacccagtgtgcgcgctctctctctccagaaaaataataattttaaaaaaatcagttcttcacatgaatgcaaaacacctactacaatgatgtgggtgatggtgatgatgataagaataatgtgggaactttttaccctttttgtcctctggattgtaagtttcatgagttcaaagataatgatttcttcagcaccaaatgccttggttcctggaccaggaatagttggtgaatggatgaatctgatattcagagttgcaatgattgcggcatttaatcttttttatttctgcacagttaatccaaatgagtatttattgatttgtatatatatttactacttctattgcaaaattttagtttcttcttttatgaaatagaattcttaaatgcatgcttgtgcatccaagaaggacagtgatgatgtgtttcaatgtattaaatgttgaaatttaaatgttggggcatgttcttgaaatggtgactacacaggggaaaaaaatttaatagattggttttaaggtttgaggacgggggtcctgggaaagtgctgagaatggaggcatagcattccttcccacactcagcacataactctgcatggatttggtttcatttcaaaaacggagtgttcacagactgaatacacctctgtacacttgaccctaggagggcagcagataaacttggggagtcttttttagacaatattcccctgaggttttaagtaaatttttacaagctcctagaaatacttttaagaatctatataaaatttctcccttaccttaacagcttttacttagaagatatatcaaaatgaccccaaaaagcaaaagctctataaggtcagctaatccattaccttagcaatgtgaggtgcataaaatgtgaaccactgaaatttcatgtaaacacctcgcagtttgctctaaattttcttttatctcaaggatgcaaatgtgtcttgtgcttcccataattgaagaatgaaaatgtttgagataaatagcccttcccctgagaggccaaatactttccttgaagaaatgccagtcctatgtccctgtgggtagggttcagtatttgtagagtcgccaattataatggcccagatctaataggaactcaaggattccagcctatttccacctaccccacctgcccaagaccagccttatttccaggctttactctcccttaggcatatgtggtggcaggcacctgtaaccccagctactcaagaggctgaggcaggagaatcgcttgaacctggggggcagaggttgcagaaagccgagaccatgccacagcactccaggctgggcaacagagcaagactccatctcaaaaaacaagtaataacaataataataataataatattaatgatttaatgttcaaaaatatcctatgtccaaaagttctttttataaatctgatccatatcgctattgttgcagcttaaaattctgttacacgtggtaatacatacattaacaaatacgtatagggctccttgatttaccaggggctgtgtgtgaaaactacattaatcataattaactgccaaatggttagaacagaaaataacagctttgaagtccagagaaaggagagagtggagcaggaggaattggagctggatcttgtaagatagttgagatatgcataagttgagagaaaaagaaaggacaaaccagatggcataaatggtgtgaggaaaatcacagaaatggaaagaaagtgaggaggccaatttacatggaaatgaggcttttggaaaagggagtagttggaggtaactcttggaggcagatcggaatctatctacatagggccttgaatgctatactaaagaggatggtctatcccatagaccagtggtgtccaaagttaggaagtgtgtaggaaaatacatttgtatatagaaaaagatgtattctttatatagaaaaagaaatatattttactaataatttcttgtattgacaatgttgtatatgtgtcatttatatgtaaatatgctatgtggtgatccacactcaaaattgttttattgatagagatacatgttcaaaagaggttggaggcagatgactgctataggtgataagggatgattaaaggttttcatgcagccagtgacatgttcaaagcagtattctaagaagatgaatctggcagcagttataccgagaggattggtggaagcagttagttggcgattgcaacaattcaaagggcttaaattatgatagccacagtaggaatgtaaaggagggggagagttccagggatgttcggataatcttattatttgcatggtgagattttcctttagcaagagtattcagcaatctctttgggggctgagaatagagcagtgctcaagaaggtgagtttttgtttgaaactgatttcaaaagtgggttagtggtcaggcgcagtggctcacacctgtaatcccagcaatttgggaggccgaggcgggcagatcacttgaggtcaggagttcaagacaagcctggcaaacatgacaaagccccatctctactaaaaatataaaactagctgggcatggtgacaaatgcctgtaatctctggaggcagaggcatgagaatcacttgaacccaggagtcggaggttgcagtgagctgagattgcgccactgtacaccaacctgggtgacagagggagactccatctcaaaaaaaaaaaaaaaaaaggattagtactaccccaaatgtactatggtctgaaaacctaaacttaaatgtgaccaataattaaaaattacattaattactggtcaaaaacaatataggattaatcctttaattgagtatagataacttcataactaattttatacacaaggaaaatctttgaaaatgtagataacatcttctccaccataatcataaaaaggagcatgataacagaagtagcttaataatggttcctgcattatattaaaaaaaacttatgcttcatatttgctgtttggtgttgaaaagggatcccagaaattttctcatctcagttgcttgttggagatgcattacttttttataatacatgattcaagtacaaacagttgtttttcctcacacagcttgatcttcacaaaaaataaaatttaaaaaaccattttggtaaatgtaaatttgtaaaaggaggttttggtacttgtacttgatttaccatcattttctttaaaattgtactgttgtttaacttctcaccagttgatgtttttgtaaggtagaactcttaacaaaagtgtgattcagagttcaaatctattattagccaggcttctcaatttctccttgcacataaaaacatggtaaataatgatagagaaaaagaaatagcatgtttgaaaatgccaactagatcaggcttgtgattcctacatgatactagcattatcttagacatgtgttgataaaagagccctactatcaggcaatttaaattaaaaaaaaaaacaaattcacatattttaactcttgccaggcatcggatataaacttaacaattatctcaatcaaggtaaaatagactatagattgtgtgtgcatatgtgtgaaaatgaacagaatatagtgtagaaaaatagatacaatatgacacataaaaaagaagataagattttaaagttctacattaagcaaaagtaacttttctcaggcattgctggtagaaatataaattggtaacctttctttagggcattggtggcatgtgtcaagagccttaagaatgtttatactgtttaaactcagttctatatttctatttttaagaacttgtcccaagaataaaatccttaaatgcccaataataagggagtagctaaaataagtgaagaaccatttttgaacattattgattataataaggaccatatgtgccctgactttaagtggaaagggcagtagaaaactactattgtttacatacatttataatttttgtacgtacatatttgtatacatacatttgtttacaaaaaatgtaaagaagtataacaatattcttacaagttgttttggtttctaattttttgtttctctcaattttaaattttaaaaaagatatgttgctatatattgtatttatattcagaaaaattatcaaaataattttaaaaataaaataattaaagagagctcccagagtttaaaatgtaaatacctatcatttaattcagttagctgatggaaaattttggtgaccattacatatttatttaatgacttagtcaacaagagctgttgatgtattaaattttgagtagacccagctgtgctacaaaagtaggtaatgtaatggcaactaaagcaaatgtcaaagctgaagcacatttaattatcttggctactggggtgttttaacctgtgttacttgtgctttggtctcacaaaaatggcatcttttaccaactttctaaactgagtaggcaatgcatgctttagattaaatgaaaaggtggtcccttttatttatatttatacaaatatattcattcagtcaatcaaataaacaaacatttattcagcaattgtcaaatgtcaggtattgggccagattatgaaaaagggaaatgagtatcagaaaattaatggtctaatgggaagatcaacatttaagggtggctgaaaatgaaaatagagttatgcatgcagttctagaggaacattgagaaaggggcagccaactctgcctttgagttaggggagccttcccagagaaagtattatagagataggctttgttcaatgaataggagtttcctagatggaaaaggtgaagaggtattctagataggaagaagagcatatacaaaatgtcaaaactctgagataacatggcctgttcagggactggtaggaaatatggtatagctagagcttaggatgagaagcagaagcagatcatgatggcagaccagaagcaagactagattgcagctgtcactcggatggacagaacagtgtgtggagacttgcattgtgaacttttactcaacaatgactgcaggaatacattaggaaagccaagagaacccatagaccctctgaaggaagcagattactcctgcaggacctgggagacaccccaaatactgtaagacaccccaaaaaactgtagaagtgggaaaaggagatcatctgcccctgaacatatatccccactggagagggaacctgaagttctagagtacgggagaagattccgaccttacatgcagctgagtcaatgtagagggccgagcaaaatatggggttagaggaagcaggagaaaagtccctgtgggctcgctggctcccctagcaagccacttctgcctcacctcacaggggtccttgaggaggggtgctagaggcactgggaaaaggccacagggagaaggaaacctccagctgaactttgtaacaatttgagctgatcaaaaagtctcctggccagaactggggggagggcatgaatccagtgtgcagactccacaggcaagggaagaaggaaagccctacttacttttgcagctgggaggcaagtagcctggggcaagttctcagccctgctcacccaccacctggaaacagacttggtgctgttgggaggggcacagtgagagtgagatcagccctttgggttgcctgggagctggatgaggcctgtgactgccggctttcccctacttccctgacaacctgcattacacagcagagagagccataatccttctaggaacataactccattgacctagaaacttcaaccccatcctccacagcagccatagcaagagtctgacatgcctagccctgcccccacctggtggtccttccctacataccctggtggctgaagacaaagggcatatactcttggcagttctagggacccacccaccacctgttcctccccatattaccacagatgatgctctcttgaatgtgccacctcccagcaggaggataaccagctcaaaaatagtgcactaatcaatcaaagctaaggtatcctcacagagtccatttcacctccttgccgcctccaccagagcagatgctaatatccatggctgagagacccatagacagttcatcacaggactctgtgcagatgaccccagtaccagcccagacctggtagacttgctgggaggctagatccagaagagagataacaatcactacagctcagctcttaggaagccacatccctaggaaaagggggagagtactacatcaaggaaacaccctgtgagacaaaaggaactgaacaccagcgttgagccttagaccttccctctgacagagctgacccaaatgagaaggaaccagaaaaccaactctggtaatataacaaaacagcgttctttaacatccccccaaaaaatcacactagctcaccaacaatggatccaaaccaagaagaaatccctgatctacctgaaaaagaattcagaaggttagttgttaagctaatcagggaggtaccagagagaaacaaagcccagtgtaaggaaatccaaaaaaatgatacaagaagtgaagggagaaatattcagtgaaatagatagcataaataaaaaacaatcaaaacttcaggaaacaatggacacacttatagaaatgcaaaatgctctggaaagtctcagcaatagaattgaacaagcaaaagaaagaacttcagagcttgaagacaaagttttcgaattaagcaaagacaaagaaaaaagaataagaaaatataaacaaagcctccaagaagtctgggattatgttaaactacaaaacctaagaataattggcattgctgaggaagaagagaaatctaaaagtttggaaaatatatttagaggaataattgaggaaaacttccccagccttggtaaagaactagtcatccaaatacaagaaactcaaagaacactgggaaattcatcacaaaaagatcaccacctaggcacattgtcctcaggttatctaaagttaagatgaaggaaagaatcttaacagctgtgaggcaaaaacaccaggtaaactataaaggaaaacctatcagattaacagcagatttctgagcagaaaccctgcaagctagaagggattggggccctatcttcagccccctcaaaacattttatcagccaagaattttgtacccggcgaaattaagcttcataaatgaaagaaagatacagcctttttcagacaaacaaatgctgagagaatttgccactaccaagccaccactacaagaaccgctaaaaggagctctaaatcttgaaacaaatcctggaaacacatcaaaacagaacctctttaaagcataaatcacacaaaaatacaatttaaaaacaaaaagcaaaaaaccaaagtatacaggcaacaaatagcatgatgaatggaatggtacctcacacctcaatactaatgatgaatgtaaatggcctaaatgctccacttaaaagatacagaaatgcagaatggataagaattcaccaaccatctgctgccttcagagacacacctaacacttaagtgctcacataaacttaaggtaaacggatagaaaaagagattccatgcaaatggacatgaaagtgagcaggagtagctattcttttatcagacaaaacaaactttaaggctctagcagttaaaaaagacagagggtcattatataatgataaaaggccttgtccaacaggaaaatatcacaattctaaatatatatgcacctaacactggagctcccaaatttataaaacaattagtaattgacctgagaagtaagatagacagcaccacagtaatagtgggggacttcagtactctactgacagcactagacagttcatcaacacagaaagtcaacaaagaaacaatggatttaaactacaccctggaataaatagacttaacagatatttacagaacattctacccaagaactgcagaatatacatattctattcatcagcacatggaactttctccaagatagaccatatgataggccacaaaacgagtcttgataaattcaagaaaattgaaattatatcaagtactctctcagaccacagtggaataaaactggaaatcaactccagaaggaaccttcaaaaccaggcaaatacatggaaattaaataaactgctcctgaatgatcattgggtcaaaattgaaatcaagatgaaaattaaaaaattctttgaactgagtgacagtagtgacataacctatcaaaacctctgggatacaacaaacgcggtgctaagaggaaagttcatagcattaaatgcctacatcaaaaagtctgaaagagcacaaattgagattctaaggtcacatctcaaggaactagagaaacaaaaacaaaccaaacccaaacccagcagaagaaaggaaataactaagatcagagcataactaaatgaaattgaaacaagaaaatacaaaagataaatgaaacaaaaagctggttttttggaaagatagataaaattgatagaccattagcaagattaaacaaggaaagaagagagaaaagcaacataagctcaattagaaatgaaagggacatattacaactgacaccacagaaatgcaaaaggtcattcaagggtactatgaacacctttatgtgcataaactagaaaacctacaggagatggatacattcctgaaaagatacaaccttcctagcttagatcggaaagaattagatattctgaacagaccaaaaacaagcagcaagattgaaatgataattaaaaaattaccaacaaaaaaagcccaacaccagatggattcacccagaattctaccagacattcaaagaagaattggtaccaattctattgacactattccacaagatagagaaaaagggaacagtccctaaatcattctataaagccagtaccaccctaataccaaaaccaggaaaggacataaccaaaaaagaaaactaaagaccaatatccctggtgaatatagatgctaaaatccttaataaaatactagctaaccaaatccaacaacgtatcaaaaagataatccaccatgatcaagtgggtttcataccagggacgcaggaatggtttaacatacacaagtcaataaatgtgatacaccacataagcagaatcaaaaacaaaaattacatgatcatctcaatagatgcagaaaaagcattccacaaaatctagcttccctttatgattaaaactctcagcaaaatcggcatataagggacatacctcaatgtaatgaaagccatctatgacaaacccacagccaacataatactgaatggggaaaagttgaaagcattccctctgagaactgggacaagacaaggatgcccactctcaccactcctcttcaacatagaactggaagtcctagccagagcagtcagacaagagaaagaaataaagggcatccaaattgggactcccgctgtctgctgatgatatgattgtttgcctagaaaaccctaaagactcctccagaaagctcctagaactgatacaagaattcagaaaagtttccggatacaaaattaacgtacagaaatcagtaggtcttctatataccaatagtgaccaaactgagaatcaaatcaagaactcaaccccttttaaaatagctgcaaaaagataatataataaaatacttaggaatatacctaaccaaggatgtgaaagacttgaacaaggatacaaaacactgctgaaagaaatcatagacaacgcaaacaaatggaaacacatcccatgcttgtgaataggtagaatcaatattgtgaaaatgaccatactgccaaaagcaatctataaattcagtgcaattcctatcaaaataccaccatcattcttcacagaatttaaaagcaaacaaacaaacaaacaaaaccagtcctaaaatacatacagaaccaaaaaaagagcccacatagctgaagcgagactaagcaagaagaataaatctggaggtgtcacattacctgattacaaaccatattataaggccatagtcaccaaaacagcatggtactgacatgaaattaggcacatagaccaatggaacagaatagagaacccagaaataaacccaaatacttacagccaactgatcttcaacaaagccaacaaaaacgtaaagttgggaaaggacaccctattcaacaaatggtgctgggataattggcaagccacatgtaggagaatgaaactggatcctcatctctcaccttatacaaaaatcaactcaagatggatcaaggatttaaatctaagacctgaaactataaaaattccagaagataacattggaaaaacccttctagacattggcttaggcaaggatttcatgatcaacaacccaaaagtaaatgcaataaaaacaaagataaatactgggatttaattaaacttaagagattttgcgtggcaaaaggaacagtcagcagagttaacagacaacccagagtgggagaacatcttcacaatctatacatctgacaaaggactaatatccagaatctacagtgaactcaaacaaatcagcaagaaaataaacaatcccatcaaaaagtgggctaaagacatgaatagacaattctcaaaagaagatatacaaatggccaacaaacatatgaaaaaatgctcaacatcactaatgatcagggaaatgcaaatcaaaaccacaatgcgatactaccttactcccgcaagaatgaccataatcaaaaaatcaaaaaataattgatgttggcagggatgcagtgaatagggaacacttctgcactgctggtgggaatgtaaactagtacaaccactatggaaaacagtggggagattccttaaagaactaaaagtagaactaccatttgatccagcaatcccaccactggctacgtacccagtggaaaagaagtcattaaatgaaaaagatacttgcacacacgtttatagcagcacaatttgcaattccaaaaacatatatatatactgtatatagtatatatatacagtatatatatactatatatagtatatatatacagtatatatacagtatatatactgtatatatagaaactgtagtgtatatatatacactatgtatatactatatatatacacactatatatatatactatatatgttactcaaccataaaaacgaatgaattaatggcattcgcagtgacctggatgagactggagactattattctaagtgaagtaattcaggaatggaaaaacaaacattgtatgttctcactcatatgtgggagccaagctatgaggatgcaaaggcataagaaagacacaatggactttggggactcagagggaaagggtgggaaggagttgagggataaaagaccacaaattgggtgcagtgtatactgctcaggtgatgggtgcaccaaaatctcacaaatcaccaccaaagaacttactcatgtaaccaaacaccacctgtaccccaataacctatggaaataaaaaaataaaaaatataataagcagaagcagaggatgagagtggaaaactgggctaggccagaaatggcctttatgcacttggagtcataatgtttctgcttcaccaatgattaacagtgattttcctggctaatagaatcttaatcattataatgaggtaggactgttgcctttgaattatggaaattatagctgttaagacctgttccacaaacacaggttatacatattatcacatctctttaatcttctttacagttaatcacccaagtctccacagggcttattagcaggaaggctattatctcctcttgagatccctcccactgcccctgaattgtccatgaatcctgactttactcaggccaaatgggtcagtcctcctgcagaagcccatagctggatctgtctgtgactgctgccctctctggtgtctgctatatggcaccatttgcacatccgtgtcacagggtacccattttgggtgacaaggttacaactctctttgtttacatttccatcctcagccattgttccctaaatcataaccactgtgccaggctggctggtctggaggcgcttctggagttggcctcatgctagtctgaaattagtccttctcctagaatctgaggccattttgttgagcccagatcaacagcccagattccgcccttctttaggatcactttatttccatggcttccaggaccttccctgctccgggaccttagtcagtgtcatcctgacccaatagatctctcatccccggcctccagttcgaggaaacggggatgaagacactagggcttccctccagaaggccctgggctcctttttccacacagattctcctcctgccaagtgtgcagattgtttctcggggtggctcaaaaggtagcagtttgcaagatggagtttaaaaaacagtttgttgccctgccctaatgctcccccaaaatgcctaattgctttatatttacataactaagaaagacaccaagggattcttccaaaaacaaagatcttcttcaaggtgatcttctgttctgcctttaaagagaagtagttgcagtttacttcactaaaataattaatttttgtctaaccatgtccctattttatcagtgataatgtgctcataaattatacgacagattatgtaatttgcccaaagcagaaagaggtctcagaccccaaacccatgcatttaaccactctgctttactacctcttgtcattcaattcacatgctaccatgtcattatttacttttatgtctcggatactgtactcttattagttaagtttattgcaggaatataaatctctttaagtgtaggcactctcttctgggctgttgctgaaagagagtgggacaacaggtgtatttgtgaactagtagaaaatgagtatatttactgcagaaggaagttgtgttttctctgcaaagttagatcacagaagggagaatgatacttatctatagttctggagggttgaaaccgaatagtaaatgggtgttaggatcaatacatattgttaagaaacagtgttctataaatttcatgatttaggaaagctgtctacaaagctggattaatctttttctgctgagggccaagtttactttgctctgcccctctctgtgcaagtgtaagacagtcaactgacctttcagattatcagcttaatgatagttctctctcagaattctttaaatttaagaataatgaaaaaaaagtccaaagagatctttttcatcatttctcttctccctattattattactctcctcaatgaaatgaaaatgaaatgcctgtgtatcctatttcataaaccaaaaccaagttctgacacattattggaagtttatgttgctttagaggaaaaccatgttggctataaactgttgcattatctggaaatcatactgtagattccaggaggtcaaggcgtctctggcaacttctatatatttataggagaaccgactgcctctcctctaacaaaacctcaatgagacctgactcctagccagctaagactcggcatggtcctccctgcgtcttcaaattctaggactttccctcatgtgcttgccttggactggagctgcaagctaccaagccagtgccagactgggggccaggcttacagcagagcttccacttaccccaaatctgccacagaattaattccctacgtttgacctcatattactttgttttgttactatcattgttactgctttagtattgttgttgtcgttgctttcctgtatatatttaagacttgtggcttttaaaactagtttggatttaagatacacaataagttctatcatttgaaaatgataaatatagatgtccttacatcaattgtcttcagatttcggatatatttagccttttgactttatccaaaaactaaacattctgattggccctcattttaaaagggaagaacctgtttctatttatttagatttgtatatgctctatattgggatgagggagctttttgtactgaaagaagttatgtattttcctacaggttagataaaatctgtgttttcccttggctaggtttatgcatgctgtataaacaaaggtgttctggggctcctaaggaagcggtctgaggaccatgtgtctcacctagttctcccacatgctctccctggtgactgttggcactgaccagaaaggtctagagtggtggagagagaagctaataaacaattcttgaaaacctactatgtgccaggactatgcttgatatacatttgctttgttttatttaactttcataacaatcccagcaggcaattaccattttccttattatatagatgaagagattaggtattataattaatctaatctcacagagccagaagtggcagagccaggagtaaaacacagctcagactccacagccaatgcctttctgtaccctacaccgtccatcatggatttaggtagcctggggacctgaactccccactaggtttaaggtctaattcttgaatgaaacctcacgcatttctcttaggttcagggacaatcagattgtcagagtagaaagagactttggattcaacatttgctaacccactggcttcctaacttcttcctaaggccttcactctgtgaagtaggtgctagggttccctgctaatgagtactaagcttctcaagggcttgagcaggcttgttagtctttttagggccagctgtgcaccaactatgctgttgttgtgttgaggccttagcattcctcacttcaaatcaattacttctttattaccttaatacatcactggccatgtggctgatttggaatgtaaaggagactaaccctgtaggataataactttcacttggcacacaaaatctatacggatattcagagcatttgcttttaaaaaatgaatattctgtagcctgtgctgcctgtttattcttatttagagaatttcgtcattttaataatttggtaatattttactggtaggtgcggagatatgtaaaaaaaagtgtatttttttcttttcttgtggatttaaaaaatgtttagaatttttatttgcagcctataaacaataatagtactttatcctttcttatttttgcctatattacaagcaagtaatttcatttaaattgactttaagcacattcctttgaaagaaaccgaagattgttatctttggcaatcctgattagatttcttcctcagacaacagtttattaagtttgtgctatgaatgtgggcaggtggtttgactcggtggagcaagtagtgggcactctagaattctttttctccaagtactcaaaggcctttggaagaatttcctctctgagcatttagatgttccttctactctgtgaggtgaaagtgtgttatgtggttttatttttcacttattgaatgccaattacatgccagccccagggttgtcttacatgtgttatcatatctcatttaatctgaaaaaggattatggcataggcacataatattatcttcatctttcagataaagaggcataagttcaggtaaatacatatcccagtagttacacagctagtgcctaatgatagcaggatttaccagatctgtctgcctttttcaaatataacaccttgcctgggaatgagctagcagaagacttttagaagatgagactggagaagtggcttcaaatttcattctaatcaagacactaagctttgcatttatttattccttcattaccatttattgggcacctaatgtgtgtcaaacaatctaggaattggcgacattacaatgaataaaaagcatagatccctgtcttccagaagtttacttctggttattggaggttttgagccaagaaatgacatgatctggcttagcttttacaaagaccctcctggctacagtgtgaagcatcacctgaagagaggtgagggcttcagcagcaagcccagttaggaggccactgcagcaatccagacaactgcggggcttggaccacagtagtggccaagatgagaatttggattttatatggacttagatggaaacaccaatgggattgctgaggaactgaatgtagaaattgcttgtccatgttttaactgcaactatggtcagcctgcatcctaaacctatgctttttaagttatgttaacatgctgaagtacaaagtgacttcacaactatattcaatttcatgaaaaactgtagctcctccttttcagctccttaggcttaggaaaggagagtgcctcttggagcctggaagaggcaggagagagctctgtgtcccagaagcatttgtcatccaggctgcagttagccagctggctccttcaaaagccacacacctgggtggcagcacatatgtggttatacctgagatatgtggtgtgtccatctcagagccactcaaagtccattttaacccttccctatggctccccatgaggaggtgggaaaacgaatcctcttaataagatttaagcacagcttcacatttttctgtctttgttatttctcagaaatgccattatcagtctgagtcagaacagatattaattcttggtcacaaagtagcacttttggcatactctcaccatttttttaacttcagaaacagcttccttgtaggtaactttcactgagctgacattgtcagccaaaaatggttctggagccacttcatctgccataaaatttaataagtccaggatacaaatttgtgtatcacaagtcaataaaattgccaccaagctgtttgtgtagtaataaggtcaataaatgtcatcctcattcaattaattttcattgaccttaaggaaatgaccttctatttccaagtaggagaagaaattggccatggagaagcataactgttgcatctgcttttcagttattacattactgaagatagcatgggcatctagctatgcttgtatattcagactaaaaagtaatctacatggcttatcctgaagtagacccaaatgatttaattacaattaagatcattgaaagaccccacaatatgcttggggtcatcctaactgcatcttccagatatgatctaatatctcactgatcttggccatccattgggttctgctgggcaggatatcaagttaaggatgtgatgagaggctctcactttctggcctgcaaactgcatttgtcacaacccctttctccattaacctggcctggagatcagccctgaagttgctcctttgctgtgctggccataccctgaaggagacaaccacaccagtgagagttgaatgcctctgatttcctccttcctccacaaggcagatgagggaccctgccatttttttataaaattcaaaatcaactaaagtatcacttttttattttattattttcccagggctgcgtccaaagaggactctgcggctggtgctctggactgcagaagaacaaggtggagttggtgccttccagtattatcagttacacaaggtaaaaacccagctgtggattgctaagcatttgtacatgtaatatacaaaaatccctctcattgtccatttaagacttcaataatactttctggtcaactggccctaggaaacacccttgtatgagccttctccctccagccctgtgaatgagaatgcactggtaaaccaatgatgctgtggtgtagagctgagggcttttcttcttctacaccacagtctgaggccaaagaaaaattccaattgccatgctgccatttttttcaagtctacctagttctgctgtattcatgtatgtcagagaaatagttataggcaaacattccctctccccaccgagcctatccccatacctcaatgcccgccatattcccagaagccttggcatttgagagccaggttccaagtcattgagtctgccaagagcattgccatgatggtggtggaaatggcagcagccacaggcctctgtcccaggaatgtggaggacagcttggtttgacaccagctgtcattacacaagtgtgaagcttgaagcaggaaggttattgtggatggtcatgattagaaatacaagaccacatggaagagaggggatagggagattaatatcaagagcaaattttgagacagcaaaatatacaagctgagaaatactctagatcaagtcaaatgttagttcaaagaggaactccaaaatcaacgcgcatatgctggcaagcagtgatggttgcccagagaggagcatttggtctgctgctgctgctggatggtttcccctgaatgtccagatgagaagaagcagatcttgcaagcttaaattatccaaatcggagaagggtttcttttgtgaattgtgtgtatgttatttttgaccttttttttttttcaaagtcagtctctattaccctatttcagtcagttagagtataatgagttcaaagtcatgaatttggtcactgaatacaattatttactgtacaaaggacaacttatgacctatgccctactctttcaccactttagttcttttggcctcaggtgatcctggggataacataattcaagacaagtgtcctttggttggtaggtcagtaacatcattttctatgtgttgtggtagaccacaacatcatataagggttgttctagattcagcaacattcaattaatattttctgaacatgtactatgttccatacactatgttatgcattaatgttagcatcaaaaagatctaccctgaccttacaaagcctacattctaaaggacactgacgattaacttgaattataaggtgttaagtctttctgggaaagaaattacatctaagctgagacctgaagactgagtggaagtaagctaaggaaaatggagagggagggaggaggtgggtactgcaccttggcagagggacctgtgtgtgcaaaggcaggagatgagacagaggaaagcacaccagagaaatggaaaggaattcagagtggctgctgcatagaatgcaagatgcacagtggtaggagggtggaacagagacgtaaacaagagcctgaacaagaagaacatatgaatcatatttagacgtgcggactttatcctcgaggcaagagagtaacttatttttaagaagaagctctaaaattctatacatattggactttatataaaaaaaagaatagttaaaagaactattcttttttttttttttttgagatggagtctcactttgttgcccaggctggagtggagtggcaccatcttggctcactgcaacctccgcctcctgggttcaagtgattctcctgcctcagcctcccaagtagctgggactccaggcgtgtgccaccacgcccagctaattttttgtacttttagtggagatggggtttcaccgtgttagccaggacagtctcgatctcctgaccttgtgatctgcccgcctcggcctcccaaagtgctgggattacaggtgtgagccaccgtgccctcttttattctcagtaatacactctactccaagaaaaatattggatttaaattgcaattgatctggctaaaaattttatcatcactgaaattcctagaatgtgaaaaaagaaggtttatttttctgtaatgtgagtttcactgtagcctatcaaagcacatggatgaaatcggaaatgcctaaaattctgaggttggcagaaatacacacactcaaaggacatgcaatcacataaacagaactactttatcttgacagcatccaggctgcctccatacaaatgtagcttcatgttggtggctagtctgcattgcattttcagagatagaaagaagaaattccagaaagggaaaacattggcattttgttttacagtaactctttacctcgcctttaaaaagacattgtgcatgctttacatgatacagccaatttcaaaggacttattctggattcttatgattagcatattgatattgacattactaagactataatcatttcaaaagtggctgagtttaacttaaaagttaatataataagcaagtcacaaaccacaagggtaaattagattgtctttagacttctctgtggcattactgaatgccagcagacagtccaacaatatccagttcactccagtcacaacagagagatcatctgttccaaataaggttatgctaactgctgaaacaaataataggtcaaatttcaatgacctaacataacccagaaatatattccttgctcacttaacatccaatctacagtagggctctgctttatacaggtattcagtgatccaagctgacataccctttaaaaacatggctttaatatgcctttgagtattgacatccagctggcaggcagggggatagtaggaggtttttatgggacagttctagaagtggctgacgtcatttctactcacactccattggcaagaactagtcatgtagtccaactgtgtgagaggctagggcatacaggcactggctgagcagccacttcccaacaacagctctatactgtaggctgggagcattctatagctatattctctatctttggcagaaagctgacccactctagggtcttcctttcacttcgttctggctttctaaacactttagctgcacaagaggccaactgccctgaggtctttacctcccatggtgctcaaagttgagatcagctctgtgagctgcctaaaagtactcatcttcaccactaccaggatgcctttgtctagcaacacacaaaaagaaaaggagtcacagtctttgaccagaaggaccttacattttacttcaaaaataactttaaatgcacacataagaaagttagtataacaaaccatatataatgaagttttaaataatgtactaaaagtattttatttttatggatgatgctatcattgacaaagtgccaaatggtgtaaaggctgaacagagtaaatggaaaggatttagaaaagggagaaatcactatggcatgttagtcgtgaggaaggaggcaacacctaatccttgcagagcaagtggatttcagccagtgatcaagaggggagagaagggacagcagctcccctttagatggatgataatggagtctcgaggtctgcctttggcattggtgtgggtgataccaaataagaacagaacttttatggcgggggtggggagatctattttagtgattgtagaaataaaaggtgtgaactttttaaatgactctgctaacatttttatgatacagttatggttattagtgatctatgtcaggaatcagaaaattatagctgatggaccaaatccagcctgccacttgtttatgtacagacttcaagctaagaagttttttcatatgtttagctgattatgctacagagattgtatgtggcccacaaaacttaaaatattaactatctgggtctttacagaaaaagcttacctacttctggtctataatgataaaagtcataaaatatcatcacattatttgtatacaatgatctctttctcgtttgtatgacctaaaatataattttgtaaattttgtttcgagcctaatattagcctatgtaagtatattgtaggaagatattattgtaatgataaaagcttgcatgcacaatctttttttttttttgcattcttatctggcagtctttaataataaagttggctaaacctacatggcactagctagggagaaaaacaatacgtagattattatttcttctttttgtttttctgaatgtaacattctttcttccccctcacaaagtcttttcaacagcgaaagttctacaaaggctattttaataataaatcagtttgtggaataatgaattattaatattcattatcctttccttagtaaatatatctttgtttacactgtactctaattaatatatgcagaaaatataaaatagttattttaaattgtgggtaaaatgtattgctgaactaattttcaaaattgtagttggattaaaagctacctttacttcataattatgctttcttatgacatatcagctcaattattataatacgtgctagaatttactaaatttactaaacaatttattaaattataaaggatgtgaggctatttatagcttgtgtatacattttgaaattcatatgcaactttattataatgtctaaaacacttcaaggaaacaaactttggcaaaaatggtctataagcattttagtagcagttactaagtaaataactcaaacaggaagtgttgaatatctcactgtagtactatacactagaatataaatcattcctgagatccattcagcatgcctctaacagttcatagcggaaagtcccataaaagatttctcttcttaagaaaatgcaagttcacatgtttcaataagttgttaaattttctctccttattttaaagtccttttcaccatgtctttgattgtcttggtattagcacataagcttgagaatgacttatatggacagtatattgtttgtgctttatttagaagcttcttttagaagcaactcatttttcttgctgttttattgaagtttaattagcatttggtaaatgcacatatcttaagtacacagcaaaataaatttggaaaatgtatacccctatgtaatcatcccccagatcaaggtatatagcattcctattaccctagtaagtttccttatgtccccttcaaatcaacttctgactctaccaaagacaactactatgctcctttgtaactccagattggttatgtctgttcttaaacttcatataaatggaaccatacagtacataatcctgagtctgacgtctttcactaaacagtatggttttgcagtttatccatgttgttgcattaacagtagtttgtccctttctattttttttttttttttcgagatggagtcgtgctctgtcccccaggctggaatgcagtgtggcacgatctcagctcactgcaacctccgcctcccgggttcaagcgattcttctgcctcagcctcccaagtagctgagactacaggcgtgtgccaccacacccggctaatttttgtatttttagtagagacagggtttcaccatgttggtcaagatggtctcgatctctcgacctcgtgatccacctgcctcggcctcctaaagtgctgggattacaggtgtgagccaccacgcccagccatccctttctattactgggtagttttctattgtgtgaatataccacagtctctttattctccagaacgaatgaagcaagaatattctgttgatggacatgtgagttgtttccagttttagctattataaatgaagttaccatgaacatttatgtacaaatctctgggtggacctatgcatttattttcttttctgggagtataattgctgggtcatatgataggtgatgtttaactttaccagaaactgctgaagaggtgggaagttgtaccattttacatttccaccaacaacatgtgggagtcctagttgctccctatctttcccagtatgtggtatcattagcctttttatttttagccattcttataggtgttatgtgtttatatttttcaaagtacagttctgaagagttacaagaaaaatcctgactcctctcctaatggccactattcttttgccctccctgcttcttcttgccttaagactttttgtttgtttgtttgtttgtattgttttgttttcttttgtatttgagacagagtctcgctctgtcgcccaggctggagtgcagtggcgcgatctcggctcactgcaacctccgcctccagggttcacgccattctcctgccttagcctcctgagtagctgggactacaggcgcccgccaccacacccggctaattttttgtatttttagtagagaccgggtttcaccgtgttagccaagatggtctctatctcctgacctcatgatccgcccaccacggcctcccaaagtgctgggattacaggcgtgagccaccatgcccggccgccttaagactatcttcatttcggtgttctgctttatgatttcagggagaccaaaggcctttttaccctgcatgaggtttgtggggctgttcatggttggagggaccttatttcaatttagagaaacatcttggcaagaggaggacatagaaatgccgtcctgctcataaccacggccgactcccaagaacacatgggggctgttgaaactcaactggagcccaaaggggaggacgattccctcaaagggcatgaggaggaagatttctcttttatgcccagaaaagaggttattctagggagaggggaaaagtccagaaaatgcctttatgttattctttattgataaattacattttttaaaaatatgaactctattggttaaatttaactggcattcacttaaaaggaaactttaccacatagagaagcatgttattgcactctagtgaataagagtttcattataggagtggaatttgactttgaaatttgaaaatatagatgagtttattgaattttcaaatcagtgaataaagtgagggttgtccaggtaccatttgcctaatctgcttttcatgggaataatgttgctgtcttctcttctcttctcttggaaggagaacaggatgtcatttctcatgtcctgaaatggacaaaggagaaaaaacatacctagcttcaactggatttctggcatttgttaatcttttccattttaaggaaaaatatgatctggcataattataatgagtaaggtaatctggccttgagaaagcctcattacacaaggtaatcaaataaaatagattgatatgtcttattctggcatgaaaaatattttaaccttttcctgatttattgcacaaacttctggcaattgaattacagggataatgaacactgttgtgttctggtagtcattaataagggcaatattttaaataggctttattaaatgagggatgggatgtatggtcattccaaatacacgaatttatctgaactctagccaactctaaaactgaaaaagcaaaattgaatattttgtcacaatttcctgttttgtcatactgaggaacaaaaattcctctttatgtatagaaatacactaaagtgttagcttcttttagcagtgaagttcttgccagcttcccaacctgcattaggtttcatgtttcactctaaaataaaagaatatgttagaaatgcttttgagacttcttcgtgctatctgggcaaatgtgtttctttggcatttttattttactaactctatttcctctatatgatgctaatttagatagagtgacactgctagagtaagggtattatactcatgttgagctctggttatacaaataatagagctgatgtactcattcagcataattgtgtccggactatgtctccagcacagcctttcttatatctttaatgttctgtgcagtatagacgtactaatcagaggtgattgtctcaatcattactgctgggcctttatgcatcctgtatttttctttcagtgcctagatattgcattagtctctcaagcacatcacaaaactggtttaaatttcatttgtctcagtgttttcttggtctggagcctttgtagttcctatattcacatgatttatactgcacacctgggagctcttaagggtcttattagaatttgtggattttatttttgtaaaaaaaggaaaggattgtcttttgagtttgctttctcctgtgtagaattccattatgactaggggacttctgaatcttatgtacatatggtaattatatatcaatgtatgccagtctaggcagagctatcaaaatatcccctttgatactaggagaatcatataccaccttgcgaataaacatgagtaggtttcaactcatctctttgctttatcgctctttagaagggatccttcttaactggcttttattatatttttctatataagagaaaacagtttaaagtaaaaagactatgacaactagaatggaattttttcatgtttctgggagagcaagaccttgcctaccattctgagataattttgtttaattcaatgccttatggtttcagattatagtgaagtttgacttgagtgttggttttagcccagtacctttaaagaaaagagaaatatcccaacttttctgctaccattactaacctaagtaaaacaattgccttttaaagttactcctaagaatgttgtgccaaaactttgaggtttcttgtcaattatttggctggcatttattctcccctcctgaaaccgtgaagaatggcttcagcttgtatctagtctgttttaccagcttacaggagagtgccttctggcacaaatagtttctgcctcagtgcctccctactcctaaccaggtcatgacctgacccagaaggacccataggatatctagtgcatgaacttcctgaggaaatcaagttggcacaccaggatgcacaaatctgaactgaggcatcatgccttgggctcacaagtgaactgcatgggtcagaggctttgggactaaattatctcattacatgtactggggccttactaagttacagagtcagcaaaccacttttcaatcaccagcactattttatttggcctgaagttgtcttctgcccttttgttttctaaatcaggggttggcaaactttttttttttaacagtccagataggaaagattttaggactgcaggtcatatggtttctctactcaactctcattgtaggcagtcatgggcaaaactagacaaatgagtatggctgtattccaaaaaaaccgtatttacaaaaaaaaaaaaaaaaaaaaaaaagaataaaggcaggtcagatagtttactgacgcctgttctaaactgttacaaggcagaagtttagaaaactttcttctgaagccttttcttatatcacggtcacagcttttagtgaaagagatttgtagcacatagtggaattctaacgtttagagattatgtcttggtaggctaataataggactgttggtaagcttagcatttacaaggttgcagttgtttccctgtaggtatttggccaacagaggccaacagaacacaccatcaccagatcagtctagtgccttacttatatcccactgagccacacaacaggcataattaccttgttggaggaagaagttaatgtacttcccgagtatttctaaaagcaagaacagaaccctttataaagatagctaaatgtgtactggaaaatatattttaaaggatatctattttaaatgtttacacatatagaagggtcttttagagaaatgaacattccaatacattttggcaatttcactgtttaaccacatcctagttttgtccattggtttgcttacactatttcttttttattttttttaatatttcctttcctttttaatattaaacaattgtgattcttttttttttgagtgacttcttttattattattattattatactttaagtttagggtacatgtgcacaatgtgcaggttagttacatatgtacacatgtgccatgctggtgtgctgcacccattaactcgtcatttagcattaggtatatctcctaatgctatccctccccactccccccaccccacaacagtccccagagtgtgatgttccccttcctgtgtccatgtgttctcattgttcaattcccacctatgagtaagaacatgtggtgtttggttttttgtccttgcgatagtttactgagaatgatgatttccagcttcatccatgtccctacaaaggacatgaactcatcatttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttgtagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccactgatggtgagcattttttcatgtgtctgttttctgcataaatgtcttcttttgagaagtgtctgttcatgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcctatttgtcaattttggcttttgttgccatcgcttttggtgttttagacatgaaggccttgcccatgcctatgtcctgaatggtaatgcctaggttttcttctagggttgttatggttttagttctaacgtttaagtctttaatccatcttgaattaatttttgtataaggtgtaaggaaaggatccagtttcagctttctacatatggctagccagttttcccagcaccatttattaaatagggaatcctttccccattgcttgtttttctcaggtttgtcaaagatcagatagttgaagatacgtggcattatttctgagggctctgttctgttccattgatctatatctctgttttggtaccagtaccatgctgtttgggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctataaattgccttgggcagtatggacattttcatgatattgattcttcctacccatgagcatgggatgttcttccatttctttgtatcctcttttatttcattgagcaggggtttgtagttctccttgaagaggtccttcacatcccttgtaagttggattcctaggtattttattctctttaaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatatcacctgcaaacagggacaatttgacttcctcttttcctaattgaataccctttattttcttcccctgtctaattgccctggccagaacttccaacactatgctgaataggagtggtgagagagggcatccctgtcttgtgccagttttcaaagggaatgcttccagtttttgcccattcagtatgatattggctgtgggtttgtcatagattgctcttattattttgagttacgtcccctcaatacctaatttattgagagtttttagcatggagggttgttgaattttgtcaaaggccttttctgcgtctattgagataatcatgtggtttttgtctttggttctgtttatatgctggattacatttatagatttgcgtatattgaaccagccttgcatcccagggatgaagcccacttgatcatggtggataagctttttgatgtgctgctggattcagtttgccagtattttattgaggatttttgcatcaatgttcatcaaggatattagtctaaaattctcttttttggatgtgtctctgccaggctttggtatcaggatgatgctggcctcataaaatgagttagggaggattccctctttttctattgattggaatagtttcagaaggaatggtaccagttcctccttgtacctctggtagaattcagctgtgaatccatctggtcctggactctttttggttggtaagctattgattactgccacaatttcagagcctgttattggtctattcagagattcaacttcttcctggtttagtcttgggagggtgtatgtgtcgaggaatttatccatttcttctagattttctagtttatttgcgtaaaggtgtttgtagtattctctgatggtagtttgtatttctgtgggatcggtggtgatatcccctttatcattttttattgtgtctatttgattcttctctcttttcttctttattagtcttgctagcagtctatcaattttgttgatcctttcaaaaaaccagctcctggattcattaattttttgaagggttttttgtgtctctatttccttcagttctcctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttggatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttccagtttgattgcactgtggtctgagagacagtttgttataatttctgttcttttacatttgctgaggagagctttacttccaactatgtggtcaatttttgaatcggtgtggtgtggtgctgaaaaaaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtctcccattattaatgtgtgggagtctaagtctctttgtaagtcactcagggcttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccagtttgccagtctgtgtcttttaattggagaatttagtccatttacatttaaagataatattgttatgtgtcaatttgatcctgtcattatgatgttagctggttattttgatcgttagttgatgcagtttcttcctagcctcgatggtctttacaatttggcatgattttgcagtggctgctaccggttgttcctttccatgtttagtgcttccttcaggagctcttttagggcaggcctggtggtgacaaaatctctcatttgcttgtctgtaaagtattttatttctccttaacttatgaagcttagtttggctggatatgaaattctggtttgaaaattctttcctttaagaatgttgaatattggcccccactctcttctggcttgtagagtttctgccgagagatccgctgttagtcttatgggcttccctttgtgggtaacccgacctttctctctggctgcccttaacattttttccttcatttcaactttggtgaatttgacaattatatgtcttggagttgctcttctcaaggagtatctttgtggcgttctctatatttcctgaatctgaatgttggcctgccttgctagattggggaagttctcctggataatatcctgcagagtgttttccaacttggttccattctgcctgtcactttcaggtacaccaatcagacgtagatttggtcttttcacatagtcccctatttcttggaggctttgtttgtttctttttattcttttttctctaaaaatcccttctcgcttcatttcattcatttcatcttccatcactgataccctttcttccagttgattgcatcggctcctgaggcttctgcattcttcacgtagttcttgagccttggctttcagctccatcagctcctttaagcacttctctgtattggtcattctagttatacattcgtctaaatttttttcaaagtttttagcttctttgcctttggtttgaatttcctcctgtagctcggagtagtttgattgtctgaagccttcttctctcaacttgtcaaagtcattctccatccagctttgttccgttgctggtgaggaactgccttcctttggaggacgagaggtgctttgctttttagagtttccagtttttctgctctgttttttccccatctttgtggttttatctacttttgttctttgatgatggtgatgtacagatgggtttttggtgtggatgtcctttctgtttgttagttttccttctaacagacaggaccctcagctgcaggtctgttggagtttgctagaggtccactcccgaccctgtttgcctgggtatcagcagcggtggctgcagaacagcggattttcgtgaactgcgaatgctgctgtctgatccttcctctggaatttttgtctcagaggagtacccggctgtgtgaggtgtcagtctgcccctactggggggtgcctcccagttaggctgctggggggtcaggggtcagggacccacttgaggaggcagtctgcccattctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcagggctccttgagctgtggtgggctccacccagttcgagcttcccggctgctttttttacctaagcaagcctgggcaatggtgggcgcccctcccccagcctcgctgccgccttgcagtttgatctcagactgctgtgctagcaatcagtgagactccgtgggcatagtaccttccaagccatgtgcgggatataatctcctggtgcgccattttttaagcccgtcggaaaagcgcagcattagagtgggagtgacccgattttccaggtgccgtctgtcacccctttctttgactaggaaagggaactccctgaccccttgtgcttcccgagtgaggcaatgcctcgccctccttcagctcgcgcacgacgcactgcacccactgtcctgcgcccactgtctggcactccctagtgagatgaacctggtacctcagatggaaatgcagaaatcacctgtcttctgcgtcgctcatgctgggagctgtagaccagagctgttcctattcagccatcttggctcagtatttcttttttaaacctgaattattttctgggagagaggctcttcccaagtgacccaaagatcattaggtctttgggtattcagtagcccttctggaagttcatcttctacttctggttactgtgattttctgtgcttccacgacactaacacgtaaacatcaaagagtggtctctctaagacagcttgaggagtgcacgagcagaagtactggcagggctgttcataaagccaatgccagaaagcagctcctcgctggcacatccactttgtactttgagacgcagtatccagaagccaggatgggcaatacccaaactatgttactttaagggctgaagatcaggcagggaactgagccccagaattgttagacattgttgtgagtgcaaagtgagcacttttgtctttctttctgctactcatcttacttgatcattcctgagtatattaaccaaatcctgtggtgtcttaaagataccatgtgtgccctgagaggctggtctcggtctagctttctgatttccttatcaattgggtcacatctgtattttctgctgactcacttatgtgtgtaaaaaacacaaaggcatacttttttttttcctaagcagatcggaacttctattccttttttttttttccagaagacctctctcgtgtactctcatcaaatgcttgtcctacatttgtaattattcattctagaagctgaggttgcccctagcaaccagcagttttgtctaaactgttttggtttcagggttgtcttaaaggagagtttctcaaaatccatttccaaagagcttttataccccacacagcaaaacatgtataaacaacaattcaaatttagggagcttaacaaggcctttcaacaaaggtttaaagtggtttcatcatatgatttatttaagattaaacagaatttctgttactagttaaaacgggagtgtaatttgcttttatggattcctatagtttcatttaataaaactcatccaatcagatgcactccctcccctgtgaaatcagaggcagtgccatatttgtaaatgtgtttcaggcaactctccaggtagtaactgagggctggaagaacgtacagcatccacctgccctcactgccatagctggcagtgttttttcccctccaaagctctggaaaatactttattataactcacagagccaaatgagaggcaatcaaactgttttgtcatttgaattaggaaaggtcaaagggaaaggaacataatagtagacagacagaaaagtgctttgtgaaaattacccattttttccacgtaaggaaaagtaatttgttttttttcagtgctagagatttttgttttgatagatttacagagagaaaagaaaccaccaagaattttgaaaggtcccatttcccaaacaaatatgtaacaagttcttaccatttaaaagatggcattataatctcttgcatctatgtgatcatttataaattacgctttcgtggacatcaagtcattgatgatagtaatgaccctggtggttgccagaccatgtactgttttccttatttcacacatgaagaaacagaggctcaaagaagtgaagaatgtacccaagtttgcatagcacagcccataaggtgcagagcctgaacttggacttcagccatgacttctatgaccacatacttctctgtcaccatcttaaatgtagatatctactaatttgtcataaactgaaggacatacatagcagcatatttaggaatgctggataatcagtaacatataaatagatgaaaggagaagttgcttcaaggtgcttagtttaaaacacatatagcatggtatcaattctatacaatggccaaaggatattgtgtaaccatgcagacatcagttgtcactagtaattctcaatgttttatattcacactttcttggtataaaaataaatatttgtatttgttcacgaagttaattctataaatcctgctacaatgagttttaaaaaaataaccaacaacacttcacttcagtcatctgtgtaattttcctttagtttggggcattttctaggtaaagttttagctaaacaatacagaaaaattaaaaagttcagagatcttttaatgatatgaaaaactgtttctaataataataaatgttaaaatcatttcactattcaaaagactgcgttcagagcggaggcaccctaacatactactctaggacatttctcactgccttcatcttcaaataaaagtgagaatagaaccctaacctttgagagatggaaataatgcatgtatatgtctgtttttatatctttcccatgtgtatagagcttagacactctatatgtgaagaccctccaaaaatcaagtctggctttcttctttcaggataaccattcccgaaacaccaaggacagggatacatcagaatggacccctacctgtgctatatttaaagatctccaaggatagagattttacgtatgtcagtattttttaacactatcagacaatgagaatattcctggccaggtccacttagtgatttcttcattgaaggatacaatttagaagattggaggagcaattataaaagaaagtaatacaatttagaagattgggggagcaattataaaggaaagtagctgtaggtctccaaaagttaaagtcccttaatcccagttgccttagtagttcttgcatgaaagcactaaggaaggatcaatgactgggagatgggatgaattctgaattgcaaaagagacatttaaatattacttgcaaactaaactcaaagcacaaataatttaacactgttttgttttagtttctaaaaaagtggactctaattcattctttccttgttcaggagataaaactatttgtaacctttaacatgttcttttcttcacagttgagagctcagtttgttaatactttctttcccaaactgttttctgaatgtattggaaaactgcacctgccagaatggattggtgtttgttcttcttcaatgaaaggtggctgtgatcaggagctgccccttttagagagcttaagctgccaaagcctaatacaacagaggtggaacggaaaatgagaatgaaggacatattcaaaaatttaacaaattgttggtgcctcaggcatgaagcccattggtttccaaagaatttggcagaaagatttctatcttctcatcttgtaggcaattaccttaatatggcacacttttgtgatggctttcattgaaaggctctgtttaaacatctttttctgaatcaccaagataagaatggagcaaatgaagggaaaaaaaatattcacttgtacacaaagctgctaccttcaattctctgaaattgtagttaatgcctaattatactgacattcctattgtacaaaagtgttgagaatgcaaatataatttcccagctaattatttcattacatggaagtgacatgagtgaagtaataaattagcatcgtctttataagaaccagcaattctggactttataatattgaaattttcaagtggagtgaagtgcttttttcttatgactactctgattaggtgaaaaatgccttttaaatttatgtgtataatacacctccttccttcagcagatattttaccattaatataggacagtgatatttatgtgagtacattattactgagaaggagacccaaaggatgtcaaagggcagagctgccagctgcgacagtctggcttgtactgcttttcttaaatgtggttcaaagcaatcagattatgaattgcagtgaaataaacttacttttatttttaaaatacaaccaccattaacagctccccagttagaacaactgaatgtcaaataattgcattctcaaatttaaactagaaaatagtagagcttgaggaaggggagtggaaactcaatagtgacacattgagatgggttagaaggtattcagttctccatttctttgatttaaggatcgtcaattgttagtggtgcgattaaaattaatacaaattttcaggaaaaataaaactacattaaatgcacaggggtttttaaactgacaatatcatacagtgcccaacacttttgtttttagaatcaatccatgtctaaaataccttcaatccagagtctgcagatgtctctgaaccctttggtcattagcagtgaagcattggcattaaggtgccaggccactttgtgtcacccatgctccttgttttgacaaggtgctaaaggtgtacccttgtggttggcagcctattacaaggcatattgaacacgtttttcctctgtactttcaatttggccaagttttttacacttaatttttaattttaatatttctgtaagccatatagcttctcctgaaactctaagggagcttttggcaaattgcttagtacctgagtgggaggcctccatgattcatggctggctacaccagtctttgctcaccttgaacactctagagtctattctgaagatttggcgatttctattgtttttcattgttttgcctcacacatgaaaatcaatcttctgtgtacatcaaaatataatgaagaattttaatcaataattatggactgtaatttaaaatttaatgatctgtgttgataccagtgtaaataagtgaagtgtaaaatacattatccagggccctttctgtgtgatgaagtttgcatgtggacaaacaatgacaatgaatatatgaatacaatacaatgaatatgtttgtttatttgcctagaatttggtaactttcttatggaatgcatcaataacaagatacattccaatttccaaaatgctaaaaaaggagaatactgtgattcttacatttagggaaatatggtattttatcttttgaattttatactggcagaaacaggagatgcaaaaaatcagaaaaacaagccagacgtggtggtgcacatctgtaatcccagctacttgggaggctgaggcagaaggattgcgtgagcccagggtttgtgatcagcctgagcaacgtagcaagaccccatttcaaaaaaattagaaaaattgtgcttaagtagccttttggtcctgatttgcttgagagtccagcttgtacccattgtcctgacataatcattaatagaatcccttttcactctcaaaagtttcctggcctacatagcaacttaagtaatggttactctacttattagtcacttttgttggtaataacaatgcctcgagagaacagaatagcttggtatattatagcccttcaaataaatatattaaatttatataatcctcagaacaaccctattaaatagccctttctttttgatgaggatatgaagctcagtgagattaatggttgccagggtcatttagctattatgtgacagaaccagtactccaacccacaggtccagggcaaattaattccattgagtttaataataataacactatgaatgatcatcataatcaccattactaccttactaataaagctaccatttgcccaacagaggttcttgaccattgctgtgccacaggccactttggtaatctggtgaaacctatggacctcttttcaaataatatttttgaatgcataaaataaaatgcatagtattacaaggatatgaattttattaaaatatagttaccaaaaattttaagctaaatttgcaatatagttatatatgtggttttccaaatgaattaaacaagatcttgaaggattatttaattatgactatgatatcaaagtaatgatgaacataaagaatacttagagatttctgcaacaagtctaatgtgatatgaaaagatctatgatttctaccagcaacaaagtgacaggttttgctaatactactgaagtttgttgcttacattcataagtaaagaaaattctaaattttacatagaggttagtaaaaataaagatgtaattttttcccattcaagttcacagagctcatccaagtgtatcaacccccaagggaccccgattaggacttgctgccttggaataaacctgcaaaacaactattattcccattttacaaatgagtaaactgaggctcagagtaattaagtaacttgcctaatattatttaccttatggctgagaagtgcatcaaatggcattggcacttgtacatcacctccttttgctccccagtggcaagcactatagaggtgggtattgtagtgtccacccctctctgagactgacaaccttttcagcatggttgccctagtcacttgcacatcctttaaacaccaatgatgcccttgatggagaacacagatatccaaagagaaactggaggagaggtctgagtgtctgactaatgctttttattcaaccctccttgaggatttctagtgttcagtatcccgtcagtggtcctcacatggctccccagaatgatcattattcccgacatatttgctgctattttctaccatagctattttcctcttctacctttaggtgattattgctgctacttattactattctcagatgaaggaaattgtttttcttcacctcccttagttcaatacaggtacctatttggattttttcagtaattgctataattccttagcctctctttatctaaactatacccattaaattatgttaactcttctcaaagctaaattgcctcatctgtttattattttcctcatcttgcctgaatattttaaaacttacaaaatatgtgaagcgattgttaaaaatctaagtagtcccaggacacatttattagttactgtaattgagtcttactgattacacatgcattataagcctcatgatgtgctaactttagcacaacaaagatacagttttaaaatattatatatttaatattttttaaattctatgttgtcagttcagttactgttgctcatctccttctcctcctgagtaatggccaagttattttggtgagtctaacatatgggagtctcatctttgatagcaaaatgatgatgacatatagtctactgagaatatattcagccctgttttcacctgagaaggaggagattttgccacctagcctccaaaataagagcatcttattccattattgaagggacctttgaagtttcacttgtattttgataatttatggccacttcttaaaaaatcactatcactctatatatcctcctggaaagcatttgttttagcacttataatggatgttgtaaacatttgtatattattaagtgctttataacatacacagtaaagattcagctaataactttaattgtggaactgtaggttttcttgagaacatttttttaaaaaggaaaacagattctgaaaaactgatgttattttatcaccaacatgagtaaccacatcatcatcatcaacataatcattatcttcaccaccaccaccatcatccaaaatggcatctagttacatgctcgcatgggttcacatatacaaatatacacacatatgtgtttaaacacacacatacatgcatatatttattcattcagtcagcacatgtttactgagagcctactaagtgccaggcagtgttttgaggtctgccctcatcttgcttccattctagtgaatcaagactgataataaattggataaataagtaaaattgtatgttagatgaaaataactgctaaggagaaaaataaaacagggagcagagatagagtacatgaggagggggctgttttaatttttgatagaggggaacaaggcagactttatggaggtggtaatatttggttaagacctgaaaggatgaagaggagagccacgtggatacctggaggagagcattctagcgaagatggagagttgttccaaaggtgctgctggaggccatgcttgacattcaggggatagggaggaagccaatgtgcttgaaatggagcagtgaaaggaaagcagtaggacaagaagtcaatataaagaagcccaggcagagtcaagccccatgggccattttctctgagtgaggttggaactatgggaggcttttgagcataggagaaacatgatctgaatcaactttctaaaataatcattctggctgcttggttgagaacagactaaaggggaaccagaatggaagaaagataatagcctaggcaagacaagagtgtagtttggaacaagatgatagctgtggaaggcatagcaagttgtcaggctgcagataatattttaaggaaggagcgaacagaatctgatggtggattgcatatggagtatgagagaaatagaggagtcaagcataaactgacagtttggggcccaaacaactgaaatgaggggagttaggcagggggaaaagggggagataaggagtatgggtttgaacctgttaagtttgagatatcagactttcatgtggagaggtcaagtaggcagtttggtaaaaagtatagagttcaatgaattgacatttctcaaaagaagatatacaaatggccaacaaacatatgaaaaaatgttcaacatcactaatcatcagggaaatgcaaataaaaaccacaatgagataccaccttacccctgggagaatggccattattaaaaaatcagaaaacaatagatgttgtcgtggatgtggtgaaaagggaactcatacactgctggtgggaacgtaaattagtatagcctctatggaaaacagtatggagattcctcaaagaactaaaagtatatctaccattctatccagcaatcccactactaggtatctgcccaaaggaaaagaagtcattatatcaaaaagacacctgcacatgtacatttatcacagcatggttcacaattgcaaagatatggaataaacctaactgtccatcaatagataagtggataaagaaaatgtgttacatacataccacggaataccactcagccataaaagagtgaaataatatcttctgcagcaacttggatggaactggaggccattattctaagtgaagtaattcaggaatggaaaaccaaataccacatgtcctcacttataagttggagctaagccatgggtatgcaaagacaaacagggtggtataatggacactggagacttagaaagggggagaatggcaggtgaatgaaggatgaaaaactacctattgggtataatgtatactattcgggttacgggtgcactaaaatcccaggcttcactgctatacagtgcatccatgtgaccaaaaaaccactgtacccctaaagttattgaaataacaaaatgttttaagtatagagttcaggggggaagtctacagatagccataggcatggagttttcttcatataaatgctccatctgaatggaaaataatagttaccctctcacaacacccctgtccccctgtccaatggaagctcagcttctatgttttcaatgctgtgattgttggttttgctctccagggaatatagtgcccttagaggctctgtctcttcatcttgaagatcccctggtcctagggtctggattctccacaagcctcctttatcacatcatcatgatcctcactggaatcagtctctctgaactgttttcttcctcctcctgatgtctcactcccctctctcctttctccagggctattgttgccaccagttcctaaagccattggttgcaccacctttccttcaataagtcagctgatgtaattggatagagatggttttgtggctaactttttcagccttttgaggttcaagtccatattctgtagacaacttgaggcttctttagtcataaagccaaataaataataactcaactctcaccttcagattctccctgaccaagatcatttctcccattttctaaataggctgaaggaaggcaagggctgaaacggagacaggatgctactgcagtactccacgtgaaggctggtggtcgcttggactgagtcagaacagggaaactgatgggaagttgtcggagagtaagtctatgttgaaaatagagccaacaagatttgttgatagattgcattttgggtgtacaagcaagagaggagttccagaagaaaccaactctaccagcaccttgattttagccctgtaaggcttatttcagacttacaacctccagaactgttagagaataaatttttaggccgggcacagtggctcatgcctataatcctagcactttaggaggccaaagtgggtggatcacctgagcccaaaagttcaagaccagcctgggcaacctggcgagacttttcctctataaaaacacaaaaaaattagctgggcgtggtggtgcacctgtagtcccagctactcaggagactgaggtgggaggattgcttgagcctgggaagccaaagctgcagtgagccaagatcatgccactgcactccaggcttggtgacagagtgagaccctatctcaaaacacacacacacacacacacacacacacacaaattgtgttgttcaagtcagtgactttgtggtaatttgtgacagcagcaataggaaactaatacacaattagacatctaagtggaggtactgagtagctgtgggatatgagtgtagaattcaggagatgcatgaaaatatgaatttggaactcatcaccatacagatttatttaaaaccatgagcctaaataagggttccaacacagtaagtgtgatagagaaaagaagaggcctttagtctgtttctgagcaccccaatttctattggtcaggaggatgagaaaaccagccaagaaaaatgagaaggatcatccagtaaagcataaaaagagccaagagtctgaggttccagaagccaaggcaagaatgcatttccaggagtaaacaaatgtcaagtgcagctccatcacaggtttgaaatttggtgctcactaatggtttccactttaaattttttgctaatgcctacaaaaattctaggagggacaaccaatgtttgagagtgagatactctacagaacatgcttatatttatccttttagagattgcctaagctctgatcctctcttggaaagctacattctggacattagttggatgcttagaataaagtcatctgttcatttgacaagtattttcaagtgcccgttagctaggttctgagaatatgctgatgaactaacaagatccctgctctcatgggaacactttcagtctagggtatttgctgaggccaaacatcacctcttttatcaagcttttgccaacatttttcagtagttgctttcccttctttgtacatattcatagaactcatcacatttaatgtattagccagttattgcctctgctggtaaactctcccctcctttaggaaagcaaccctatcttagtcatcttcatatatagataccctcatatgtaggttggaaatatgatttattattaaaaccaggaaatgtctgcaagagaaaggaggctctgttaattaacaccaagacaggggatgtaaactgggacttcctagggcaaacaaaaatgtatagtcaccctatcactcaagtttacgtcaaaataactgttgaataaatacattttgcttcctgaaaaaacacatttactgaaatgtgacttaatattttgcttttggctttaattgaggatcaatatgtaagaaatagtgttaggaaaagtgtttctgcatcttttgtaaaactgttattggagactgtgtccattattttgtccagcgttcctcatataaagagccatgtaattactccccttagaactgagcgctagaaaaaaatattgcttttttcaaggagatggtggtgcactttctcttcctagataatgagagctcagtaatacatcaatcacgctctcacattggcagccacaagctagagctaaattatatcctcaagttgcttttaaggctgtgtcaaaatgttccaaattgtgacttttcctttgccttaaacatttattgttcacctactatgtgcttagttctgttatttaatctagagatatggcagagatccacacacgtgattcctgtgttcatggcattttcttggttctagcacatttacctactcttttagtacagtatttggacattttcttgtagagagccttaaatttttgcaggagcaaggcaggcatttaaaaaaaattgaatgaagtgcaataggccaacaaattagggaggggtatggacggtagtcacagaaggcttgggcagaagtagggcatgaagtcacttgagcagaccaaggagccctgaagttcatattttggtacttttgtttttcataaggtttcaaacctgctaattttcttttgaaaaagaagaaggaaaggcccgcctaagaaaatataattatttctaaagttgtggttagcatctttactaatatttgtaaagagtacttgatcaaataaggcatatggggatactgtcacaatccagaaatgctgaaagtgcttgtctgtaggctagagaaagaaaaacccacaaattgggttttaatatgatacaccctatacaccctaggattgagtaaatatttgggttctagagtatagcgtagtctatttttgcaggacaagaaaatgatgagtactatttttttaaaaaataacctgtctacttatgggtagatgaacttagcggtccattataaccttagaaagggacttgaagaagctgctgcagtcttcccaaccaagagaaggacattagaggtcaaccagaaagcactatcttggctggaacaacaatgccatcaaaaacaagaaacacatctttatgtgttggtttatttagcatgtcacagtgttaagggaaaatggtcaaatgaaggaaaggttcttcaggcaggcaatttagttgttaccttttgaacctggagaagaatagtagtgtggtgggtataacaggaaagactgacagataacctgttagaagaggggactgagagggatagagaatgaaaaaggcagggaagtctgctcctacaaacccagctatgttggcactttctcttctacaactgcatactgaaatgaacgtgaaaccagtagcatgaaacacttgaccaatacatagcattaaaggaatcaaaatttaattgtgagctcttgagtcccactacttctattattattatattgcttccacatgaaagaataaaattagaagctgaaatagatatcaatttgctatgtaagcctttttttaagtcatatctaccgaatatcctggatattgcattttttaaaaaagcatatcaaatgcagtcagatttgctatataatacaaataaaattactctttttagctaatgtttatgccacatttttagccttctggctcactgttatgaccgtagtgtcatttatgcagggttcgtgtgtttttggtaagcttaagagttatccacggaccttaacaagcacaagaggagaattcactaagatctagagtgcttcaaatgacattgcaaacattggactgcctgaaaacataggtttgtctcagaacagaatacctctgtgcacacacacagaatgataggtctggaaagggatctccagtggctactcattctgttcctgtctccaggtacgatggtggctaaaccatagtaggagtgcagtgacaagatggttagatccacagaggctcctgcatgtgttaggtttcccgctctgtctgcaattttggtactaatgtaacttacccaagactgcccatttccccaagctgcagccagttgagctatcaaataaaataatttatgttatcatccctttcctggctctcccttgggtgcccaaagctgttcaaaactgagtgctggagactgaaagtaaaggtcaaaaggaaaagtctgaacttcagggtagatctgaccagaaaataaaggctgtctttctaccttgcacagcagaggaaccttctttacctatcatccaatcatgttagttgtttgagctgaagctctgtaaagaaatcaccttcatccacagaaactgggaattccagggtcactggcagaactgcaaaacaggattgcagcaactcagcacacacattgtaagatgatttgcttttgagaacttgttttgagcctaccacctgaccaaacagcatcaccaccattatctgtaaaatatttacatttacagggcaagaaagagttactaaaattgattgccctgtgtcagtgtggagtttacttctttgaagaataaattgaggaggctacatgattaattcaaatagttaggagtctcttttctttccacttgatcttgagacttcaatgtcactttaagtcaaattcaaagacatgttgagaaacatgagaaaatacgtttatttcatttatttttccatggtggtctcataagttattttttctaggttatgagaagataaaaaacttttaaacaaagaagccaaatttggagagaaaggagctattattgaacttgggtctatgtttctgaaaagtagcctagaattttataaaagcaaaaaacaaaaacatcatccttgtgtttatattaggaagtattttaaaacatgcaatatgtattttaaacacttttcttttgaatcttgcgttgcacccaaagaatgctaatggtaaccaaattgttctttggcagagtagcctgacccttaaaaaaaggaacagaagtgttacagcatgtgattgtagcacaagacaattatgaatcctcaaccctgagcagatattaactaatcctatgatctgaccataagaggttaccttggagcattcctctacattgcattatgtatattacatggtaatgaatgacagttttcatggctcctaataatgagcagcttctctttatttagagaacaaaatagggggtttacagataatatctgagtttatcattgagctgctcagcctcctcttctatgtgcctcagcttgtctcaatcagtgctggttatctcagcaataaagcattcagcctctagaagttggtttcttcctacaccctataaacaagaggatgaatatcttgttacatgtgctaaaatgagttgggtgaaatgagcattactctgctccctgtcactagctataatcagcttttcaaatctatactgagtgtgtccccacacatagcacactaaggaataaggatgttcgtgacaatatattcctgagaagcagcagttctaacatcccagtgacagctattcattccagtttctttgtgcagagacattgtcccaactccttcaccatgtgctaacaattagataatgactccataaatgtagagaaaaagcagtgtcatggacggtgggtagtttgttttcttagttctttattgaaaacatatggagatgtttatatataaatagaaaacaataaaacgctgccatcatgtaagcagcaacttaaaaagttctacacgaatagaaatcaaacatttctatacctatgccagaattctggtttactgatatctacacatcctgtcttatttggcttgaaaagatgttttattattttaggctttttatttatagttggaagcaaattgtggagcaagagatttttgtttttgttttcatttctttcttggcttaaacaaattacttttttagcaggaacaacaacttctgtccaagtataccttgtgttatgatcatgaaaaaaagtttttaatgtatacatttaactacggtctttgtatttctgaattaaaagtgaggacttgtggcctgacagaagtgactttcaggagacccagcagtggagaggttgagagcactgcttaggaggtagaagcaattcctctgggttggaattctggctgcaccacttaactagctaggtaaccgtgggaaagttagtcaacctgactaaacctcagttacttcatctgtcagatgagaaatataagagcacttaaagaatgatcatgcacactcatgggatgagctgtaagacgttacacatagtgtctggctcgtaggaaacatcacagaaatgctgcctagcatcgttgtaatcagctaacagaagggcttatattgagaccatccttgaaaatctgagaagtgttgatgctcagtgccaagaacagtaacaacagtaatgctactgtttaccaagtgctagttatgccctagcctttacaatgtactgtttttgacaattccatgagctgggtaccattatcatccccattacagctaaagattggttgatgtgagggtcaaacccagtctggatcattcagaagcccacactcttgatctctctgctaaaatggctgccacatatatagcctagggcacctttgaaaccttctttatttacactattctctatgttcctgtcaacatcctgtgacattgcacaatggcattcacaaactgtgaagtcccctgtccctaggacatctgttcatttgtagttaaagaggaccaggaaacacttaatgaacacattattagaagccctggttttcaattcatgcaaccatttttgctttggtttaaaggccttttctttaaaggtgcttgaagcttcatatggacaggctcattattcaagcttttgtcccaacctacagatgcagaagccaaggaccaaagtaacatgacttggggacagagggagaggccattcacctgccttggtagcccagtgtatcagttgctgaatcaggaatacaacagactgagcccagggcagtgtccaactcatcaggctgctcattaatgttgggtctaacagccaaactgctaactagctccactttttaaaaacttctattttaagttcaggggtacatgtgcaggtttgttacatagggaaacttgcctcctgagagtttgttgtacagattattttctctcccaggtgttaagcctagtacccattagttatttttcctgatcttctccctccttccaccatccaccctctggtaggttccagtgtgtgttgttcctctctatctgtccatgtgttctcaccatttaactcccacttataagtgagaacatgtggtatttggttttccatttctgacttagtttgctaaggataatggcctccagctccatccatgtccctgcaaaggacatgatctcattatttttgtggttgcatagtatttcctggtatatatgtaccacatttcctttatccagtctatcactgatgagcatttaggttgattccatgtctctgttattgtgaatagtgctgcagtaaacatacacatgcatgtgtctttataatatagaatgatttctatttccccttaactggtatatacccagtaatgggcttgctgggttgaatggtaattctgtctctaggtctttgaggagtcgccacactgctttccacaatggttgaactaatttacactcccatcaacattgtataagtgttcccttttctcctcaacctcaccagcatgtactttttttagtttttaatagttgccattctgactggtgtgagatggtatctcattgtggttttgatttgcatttctctaatggtcagtaatattgagctttttttcatatgcttgttggccacacgtatgtcttcttttgagaagcctctgttcatgtcctttgcccactttttaatggggttgtttttctcttgtaaatttgtttaagttccttatagatgctgtatattagacctttgtcagatgcatagcttgcaaaacttttctcctgttctgcaggttgtctgtttactctgttgatagtttcttttgctgtacagaaactcttaattaggttccatctgtcaacttttgcttttgttgcgattgcttttggcatctttgtcatgaaaactttgctagttcctatgtccagaatggtatgcctaggttgtcttctgggtttttatagttttgggcttcacatttaagtctttaatcaatctttagttgatttttgtatggtgtaaagaaggggtcaagtttcaacttctgcatgtggctagtcagttatcccatcatcctttattaaatggggaaccgtttccccattgctttttttttgtcagctttgtcaaagatcagatatttgtaggtgttcagccttatttctgggctccctactctgttccattggtcttgtgtctatttttgtaccaataccatgctgttttgattaccgtaatcctgtagtataatttgaagttgggtaacgtgatgcctccagctttgttcttcttgcttaggattgccttggctatttgggctattttggggttccatatgaatttaaaatagtttttctagttctgtgaagaatgtcattggtagtttaataggaagagcattgaatctgtaaattgctttgggcagtatgaccattttaatgatattgattcttcctatcatgtagctccaattttaacctacacagtacatgactagaagcactttgcctgattttcttgttggaagaatgggatctgcctgcaatatggaaaccctcacaaacaagatgactcaattctgttttcatttgcaagatatattgtgaatgttcttttctcctttttgcaggagagggaaagggtttagggttgtgggtgtggcagggcatagaagggaagaggcttaggactgccaaattacatgtcaacctgctgacttagcatcagtgtactagttaaatgagccctgaatgtaagacattaatgcaaatattttgcatattattaactctaatgatgctaccataatgcagtatcctcagctgaaagctgaggtggcattttttattataaatgccctgggtctttcactgaaaatcaccatgaagacaagtcccttagaagtgagagcagaaatatgaacagagttctgcatcgttaaccttctcatcattaacaataacaaaaaatattggtgtcccagggccctgcattcagtaaatgccggcaacatctttctttagaaactatcactgctcttgcccttataactacaatatacttccaaagcaaaaggttaggcaatcattgtaaaatggaatctgttttagaaaaaaatactatgcaatccccaaattgttatgtaggtggaaaatcattctaaatgcagaacaagtattgcttaccctccagtgccatgctagtgatggtagtgtggagtcttggaaagcagagggtttcagagccagcgctaccatttgccagctgtatgacattgagcaaatcgcttgacctccctgattgtcagatcctttcctataaaacagcaacattaataatactgctttgtctattttatgagttgccaaagaacaccaaaggagattgcaaatgtgaaagctctctggacgcaatgtacaaatgttattattgattttttactaggtgagtaatgaggaatgagtagcagtgtttgtccaaggatagcttgggaataagtcaaccaaggtggcagttggtaggtcttgaagatgtggttggctcctgggaaacagatgagctggccagtttgaaggatcttaaagttgcaagttttcgggctgggtagcaatttaactgtgcaacctgtcaagagcctattatattctaaatttgtgccgtgacaatattggctacatgaaataactgtgtgctttcttaccagactttatttggaaagagtttatgaactagtggcctggcagcgttgcctggaattaacagtgctgtggttttacaccagggagagaagtgtttcatgccttgttctattacctccctccctggagattcaacagatggaacaacaacaaaatcagaaccccaagacaaacctgtcagcttgatgcctttaagcttcggcagaactcacaattaagataagatagaatatccatttagaggaaagaggtgcaaagaaataagttcacagagcataccttcttttgtctgagcatggctaatactatctggagatccctgccacataggaggaattgtatactggaacacagtgaacacttaagaaaattagttgaaagaatattattgctagtagaaataactgaacatctttaatatggggctttatatttcccttcattatatttttttaatcctttcaagccaactcttgagtttggcaaatcctaggctgagtaattgtgcatctcagaatggttagataatatgcagagcagaccttaagtcaggcacagcaacatgtgttttggcacagccgtaaggaggtaaagtatttggtaattgttgtttgatagttcccaaggagaaagcactgaagcaacagataagaaccaaacaattttctcttgtgtttaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggtaagaccaaaagatgaagttgtgttccttatatattgccaacaatttaaaataaaatttctgttttaatagagcacaatgaatactagtaggccaggttgtccacggaaaccttaagcttttgttcaaggtataatctgatgatttctaaaactgggataatagtcctcaccttgtatttgtttacccatctgtatccctccactctttctaaattataagctcctcactcccagagattctgatttagtcattctggaattgggcctaaaaatccattgttttgttttgttttttaaggaggtatctttggtgattatagcacaaatgatctcataaccaaaatttgagaaatagagtagaaggcaaatattactactaatatccttctagttctagtcctgtgctagaaaaacttccttgatccaaataattccctattaaaacactgtggtatctgaaattttaccattagagatagattccttgagggtggggtactttcttttaatcatgttttaccttaatgcaaagactcctgtgcaagaggttgagcataaactaatttaccctgggcagtgatttatcatgtgaatatcctgaagagaagtcctaagtccctggggttcagggatgaaattatgaaatgggagcggacatgaggaggttacttacagaaatacaagctggaacagctggaacagtctttttttttttttttttttttttttttttagacagggtctcactctgtcacctgggctggagtgcagtgacatgatcacagctcactgtaacctccacctcctggccttaagcaatcttcctgtctcagcctcccgagtagctgggattatgagtgtgcaccaccatgcctggctaacttttgtattttttacagagacagagtttcgccatgttgcccaggctggtctccaactcctgggctcaagtgatctgcctgccttggcttcccaaaatgctgggattataggcatgagcgaccatgcctggcctctagaacagtcttaaagaagacaaatgtatactacttcacaaagttacctaagcctggccattgaaaaagtttactgatattgtttgtgacccgaggttgcttcctcaacaccattatatccataatccaaaaaagttaaaggatccatctgcaaattgttctgtatttgtactatacacataggatgcctaacatttgaacagttttaacattgctgtattcagaaatatttctgtggctacaaacatttcagaggtactaaaacagtgtctctggacctactccactccagatttttttttccaggctgcaaagtagattttaccaatagtaacatactacatagatttaagatttttaaaaagcttattcttgcaatactgcagatttttaaggcatattttaagttttaaggtttataataatctttcataactaaaaataaaaggagcttttctgtactctaatagaaagaccaaaattattttcctttgttctttgttctgtgtatgttaacatattttgaaatctcttaaagcaacatttccatttacaatgctgtacttctctggacagatccaatactatctacatatgtgtcattgataaacatgatctaagtgtaggggagagagtctgccctttaaattatatagaatcatttgtatgaaattctagattttttctgagcctgaaatatttcaacaagaacttcttaaaaattgagaaaccctgaataagctgctgtgtggtagctgtgaggaaaagactggtagactgtgggtgaatgagagtgcagacggggggtggttcaaggtgaggtaaggagctgaaacctaagacagaattgggaacaaaaacttgtccctccccatcccaggtatttcttttttgttgtgtttgatcattgagacttggctctagcttttttccttcacatgtacgtgttgtataagaatggttctgtttggagtgatcaggttaatttgattcttttcacctaaaataagaaagcattttctgtctttgccatggtttaagatgaggtcagatttgatttctacctaatagaatggagtggggagactgagcccattatggttgtataagaattaataagaggccgggtgcagtggctcatgcctgtaatcccagcattttgggaggccgaggtgggtaaatcacttgaagtcaggggttcgagaccagcctgaccaacatggtgaaaccccagctctactaaaaaaatacaaagttagccggatgtggtggtgcaagcctgtaatcccagctaactgggaggctgaggcaggagaattgcttgaacccaggaggcggcagttgcagtgagctgagatcatgccactgcactccagcctgagctacaagagtgaaactccatctgaaaacaaacaaacaaacaaaaaagaattaataagagttaaaatgtgttgaactcctaatgtgtaggaagtacctaggctttttgcagacactgttttatccatacaaccatcctatgaaggaggtacaattatcatgatccctattttgcagatgaagaaacagactcataagggttaaatgacttgcccaagactatactgcccttagggcaggagtcaccctgagaacaggccattttggcttcaaggctggtggcccttttctcacaatatgcaacaacactgaggggtctggaatgctgagaagcctccaaatctccggcagtgtctaaaatgtttatcttactcagctcttgcttatgcaaaggatttcagtccattcctgctccacagtgatttacccctgggagaaaggagtttgttattgtaaataactacttatatcttctcacattctttgttctactcccttctttaactctgaaagatcagaaaggtttacataaagtcagtagctcatttagatgactctaaatgtttccttgaatgctgttttatttcctttagagcattagaagacagaaccaaattactgctgtcttccttttattacttttgagttatcctttgatatttcaaatttgggctattcctggaagaaacaatggtactggttataactcttgtcacctattgaaaatttcaggtacctcactgtgtgcagtggcttacccctgtaatcccagcactttgggaggctgcaaggtgggagaattgcttgaggccaggagtttaagatcagcctgggcaacacagcaagacccccatctgtctctaaaaaaaaaaaaaaaagaaaaggatgaagaaccatatttgggttcttcatcttttttctaaaagatgaaaatgaatttgtctgaaaaagaaaaaagtaaaaatatatcagttgtgtaccctatatttgtgaaggcctgacaaattatagcttaaagctaagggtaggattctaaatactaattaagttatcatttaaataactgctcacctaacttctaaaaaattaatgctaaataatatttctaaactccatccttttttctttctttttttctttcacggattcaataaacatttattgagtccctaccatgttctaggcctattaaatttctataatttgaggtgactgtatgatgactagaccccaatattccatgtatactatttaccaaaatactgatagaactgtatatctatcacacagatagaattaaaattcaacattgctttcattaattatagaagacaaaaggatcaatttataatacggccatctttgggagagaaaagatgatatcctttacccatctagatgatatctataatggacagaataactgtcaacattaatataaggctttggggaaaaaagattttctttaaaagtatcttggatgtactttccgcataaactctttgttctagatcttcagattccagccttctcccatgtccacctccttccatattcctattctttctctctaaatcctcagtgctctttaaggctcattctgtattcactggtgttcatgaatccttcctgagtccgtagtgctctattgcttttccaaatttctaacgcgcttcaagtctttgtcccacaacctggcatgtgaattacaaactatgatattgttcttggaacactaggggcttatgtgcatcctgctgcctatatgcagtgatcagttctttgaggttaaggtcaataatttctcattctttgcctgttccagagctgtcggtttaattttaggagacatttaaattcttataaatctgacttagcagaaacaaaaacattgaaataattattgtctagacaagcttttagatacttcagtttaagaatatgaagaaaataaaggatactaagagccaaaaatgtataaaaaatattgggagaatgatataaattgggaagcctagagcaataaggattatttctcttaaaggagcaaagactgagagaagatgtatctttcaatactttagtgattctcacacataaaatggtgaattgctcttccctgacaatttgaaagacaatacatgacttaaagtgacctaagagggatttaagctagtctctagtcactccagataatagagaggctttaaatctcaagtttttgcctgattctcctatatgagctccaggttaggatgaaaggagtctatttcattctgagtatgtcaccaatgaggtataatccatggttcttagatgtccctaagtgcatccttcttgaatatatttcttctttagaaactctttcacaaaatatacattaatgaaagaaaattaaataccctcttactgtgacctgagagaatgagcccactcttactctatatctgccaagaagagtttactcctctgcttcagaatctgaaattcaactttttgttgttgttgtttttagtgtggtggcttgtggtagacggtgtattgcaaggagttagaggacttgagtgtatattctgacttcaaaacttctaactatgtaggcaaacagtgtaatttttctaagcctcatttatttgttattaagcatccttattaatcaactattgtatggtactggagaatcagtagtaagaaaagacagataagatccatgctctcacagacaacacagactagtaatgagacctggttatttcatctgcaaaataagtctggtaacctatgagtcattatttctaccaggcctccacttgtgttctcctcctcctctgtcccctatctcattagcaggcactataattcagaaacctcaaaagcacccaggacataaagccaaatgtttacaagtcctgtttactccaaatccctgctatttcttaaacccattccctcctctccaccccacagaccttgtctcaccaaaactcactgattcctacagcagcctcctagtaatatcccaacctgtgtttttaatcttctttcacctaattggctcactgcttctagaatgaactttctaaagtgaaaatcagtatatcaacctggatgcttttggctgcaaaatgaaacagaagacccagtcagaatggcagtaaggggatgatgtttttaaattcgcttaaaaagaactttgcagcaggtgttacagagtgcataatttggccatttgaccacttcagggacgttggttctttacatctttccatgttgccattctcagcatgtagacttttgtcaggcctgtctctttgtggtcccaggatggctgcagttgctctaagcagcacattctcatacattgtgcagtagtggaagagagaatgtctgtaacagatatcccttttgaagagtgaggaaatgttttctagaagccctaaaacaagtttcttaaactccatattattggccaaaattgtgacatatgtctgtggctaaatcatgcagaggcgatagagtggaattacctagattggcttatactgatcaaattttacttcctaggcatagggtggggcccagtattcactgaaaaacaacttcttgagaagctgtttgagaaaaattgggattctttagggaaaagatgatgatatctattgggtaaataattaaaagtagctgcaatatctgatcatccctgctccttgcttccaatcctccagcatctccctgctgtctccagagtatgtatgaataaagtgttcaccaagtatggcattcaaggccccaaatctcagaaatcaccgctaaataacttactcatgtaaccaaacaccacctgttcctcaataacgtatggaaacaaacaaatgaaaacggtaatttaaaaaaaagaaatcggggcatccaaatcggtaaagaggaagtcaaactgtcgctgtttgctgatgatatgaccgtatacctagaaaaccctaaagactcctccactcctttctatccatctctcagtcatacaagtctaattgaagttccaggcacaccctgctgctctcatacttccttgccactggacctgccctattctgtctttttcaccagttaatttctactcactcatgatgcagctccttgttctcctccttctcaaaccttctgcaatctgctacagtctgagtaaatgtcccctgggtacactcgtacaatgccctgtgttcacctctcctcttagtacttatcttgttctcctaattgtgatcaattgtgaattcctcagaattctcagtgcctacaagtgcctggccctcgacaaaatgtccatgactcaaatgctgaataagcaggatccatgtctgtaggaagagtaagataatgccaatgaggtttattaactataatgcaagacacaactgtaagttatgattaatttagtaacgacatcactcattgagctgtcctctttcattgcatattgtgttgttttaaaaatcatattttagtttatgtcatcttttctataatagttcagactccacgttgaagtaccaaatacacagattactcagaatttcacgtattttccatcttgcttatttctgcccaatacctcatatggcattaagaagaactaaattaaaactttccatttctacatttgcaaaggcctttcctctaaaatgttctaagaaaggagacctcaggacacaagtagaaatggtactgtaaagtaaattgaaggttcagcctctggacccaggactcctgcgttttccaatcaccagatggaatagcgcagcccagcggctctatatcccctgttgtccctaatttaatggtgcctcccttatggtgaaaacactgtacagtgatgtttgaagggattgatgctccatggtaagcagacttcgccctactgggaacatgaaaaggaacctctctgatttgtggctgtaatcctcaagccctcgtttaaatagccagggcagtttcatttaatcaacaagcatgtgttgagtgcctgctgtaaaccaaacgctgagacactgaggagagaggatgaaaaagactcaacaggtctctgatcttgtggagtttacattgtgatggaggggtgggacactgggaagatacagactataactaagaaatagattaagaatagagaaaaacagtagacattgataaaggctatacagagaattatagtaggtggttacctcttacctctttaattcagatgagtcaaagctcttgctattcactgactgctatttgcttgacagcagtgtatgacatcctcatcaatattgcattcctggaaattgttcatcagaacatcttataagcttcttctgctcttccctcttgcagtagatctgcttcagctcaaacagaaaccactgggtatcttgcccaaagcagacctggctcatgccttctaggataattaccaagtaggagaagagcaaattgttataccattgggcagttagtcatgcactgctttatgaagtctcttctattgttgccttgaactgttttttaaagcacacactttaactttaaagttaatatactttgtactttatctccttaactggattgaggatgaagagactattttcttcttgttcatatacccacgacacccattattacttggcatataaaatgtatccagtaaatgtttactgattagatgtattgatttaaagatgaaaataagctaaggaacaataaaaggaagtttttggtatagtaccaagataaataacacatgcagaataactgcaggggcacataggtcagaagacaagaaagacgtggaagagaggagcttgagctggacattgaaagatatgtagtataagaatggacaggccaggcacggtggcccacgcctgtaatcccaggactttgggaggctaaggcaggcagatcacctgaggtcaggagttcaagaccagcctgaccaacatggtgaaaccccctctctactaaaaatacaaaattagccagatgtagtagcgggtgcctgtaatcctagctacccgggaggctgaggcaggagaatcgcttgaatccgggaggcagaggttgcagtgagccaagattgtgccactgcactacagcctgggtgacaagagtgagactctgtctcaaaaaaaagaatggacagaagagggtagagaaggacattcctgatgagataataatatgaaaaaggcaggtgtccctgtggggccggaaaggaaagtgacaccactttcctaattcatcttgcagggcagtgggcaatgagaataggtgagtacctctaggccagatgaaaaagagtcataaatgtcaggtgaaaactctcatagctgatgcgaagataccggaacgctttacaaggagagggattaatcaaagcagtgttttagaatgtaaatccctaaagcttgtgcatgcctagagcatccaggtcacactcaagtagaaggctcaaagtaagaacacttaaagggaacgaggagcttgaggaagtagcaaagggttgaaaacaattgctttagaaaatcagataatgacattatgatgttgctccattgtatgtactataatgacccataaaacactattacttaagtctctgtaccattttccgtgccttctaatgacatagcctagaaaagttttccttttctatcttccccttttagggtctcaagattagctcttctgagttccccttcttatccataggactttccatccatttcactttacaagttctctaatttatttcttatgttacactttaatcaatgggtagctacagtgtatataaattatggaggatacaaaaatgagatatggacccttctctcctggagctcacaattgaaaactgattttggttagcttaataatcgtgaagataagaataaagacttcatcacagaaaactaaataaagctacattaaaatttctaagaaaaatatctaaaattacttgaaaagccagtggagtataaagaagaaggatttcaaaatatgttttctccttgtcagccatgtgagatttttctctctctgctttaaataattaggaaatgtagaatttattttgacttgttttaatatatgaagtgattttaaagtgtgattttttaaaaatgctattaccaaaactttcaaatgtatacaaaactaaaataatatcatgaacccccatgcacccaccactcagcttaaggagtttttcactcatggtcagtcctatttcagccacacagcagctactctcctacacccagtttattttgaagcagatctccaaaatcacatcatttcatttataaatattttaatttgtatttctaaaaggtaaggacttggttttatttgtttttgtttttgttgtttgtttgtttgttttttgttttttgagatggaatcttgctctgttgctcaggctggagtgcagtagcacgatctcagctcactgcaacctccgcctcccgggttcaagtgatcctcctgcctcagcctcctgagtacgtgggattacaggcacacaccaccatgccaggctaatttttgtatttttagtagagatggggttttaccatgttggtcaggctggtctcgaacacctgacgtcgtgatcctcctgcctcagcctcccaaagtgctgggattacagtcatgagccactgagccctgccaaggactcatttttatttatataactacaatactattattctacctaaaatattttacagtgatttcttaatatcatatccaatatatggccagttttcaaatattcccaattgtcttcatacttctttaaaaatagttttctaatgtaaaccaggattccaataaggttcaaacaatgcagttggctgatatatcccaagtttcttgtaatctgtaggttctacttccatcttttttcttcttaccacttatgtgttacagatgccaagtatttgtcctaactccatttccacggcatcatttgtcatgttcccctatcccttgtatttcctgtggattgagttaaatctagaggcttgccctaagtttgattttttttagcgggggagagggagtgggctaaaatgctttctagatgttgctgcttgttttcataggcataatgtctaattatctccctttttatgacattagcagcctagatacatttgaagttgacccttgaacaacagggagtttaggggtgctgagccctgcacacaaaaatctgcatataacttttgactccccaaaaacttaactactaatgagctactgttgatcagaagtctttatgataacatagtcaattaacacatattttgtaaatgtattatatactgtattcttataataaagtaagctagagaagagaaaactgttaagaaaagcataaggaagagatacatttatagtaccgtactctatttatcaataccatctgtttacaagatgaattttctgaaatggcaaccacggtggcacacctcaatctgtggtacatatcaagcaattcaactttttcttgtaaagtcacgacttttccctgcttcttgggagcacttccaacatcactagttgcacattgtatgagtcctatggtgttagtcaaggtctacagtattacactaaatgtgatgaaaagtatgtgagagccatcacttcttcctgtgatatgcaatttactggagagatgaactgctcacatagaggtgattagcatccgcagcattttaccagatactggcaacacttgagctcaccacaatagcaacaggaggtagctatgaaattactacagtagtacagtatgtactacagataatgttctgcagttatgatttaatactacatctttacatttgtttacatttctctcatctgcaaagggagccatgtacaatctgtgtttatgtgcatatgttttgacaaattttaactttttataatagatctgtgtatactttgtggtagtaaatgctaaaataaactagcatccacatatatttatgcattcataacatacctttttcttaattattttgatatttccagactatgtggttcattgtagaatttttttaaattgtcacaaatctccaaaaaatttgtggaaaaaaatatttgaaaaagtggatccacacacttcaaactcatgttgttcaaaggccaactagatttaatttcagtatattctgaatggtacagtctaatcatgtaattccttctttattaatttaaataaatctatgcaaacagaactttccccttatcagctattcagttactctgagatacttttgtataagaaggtaggataaatgcctcattctttctctttatttacctatttttaaaccatcagtttgtttactagtatcacccaaagatgatttatttattttttgtgtcattattaactgatggatttaaaaatatttgatgtgtttcattccattgtagtagctattttattgatgctcaaattgtcccatctttggccaattgaaacatctttaaactggttctgagtccttttgacatgaccctcatagttgttgatatcatcctggctttctgataggacaaattgtttcaggctatcttgtacatgtcctgccctagatctgaaatcagctatctcttcaaagaatccaatttattttcctaggtcatagtatttagaggccacagtctgaacagtaagtgtgtgtgttgctactggattgttcattgtttctaggtcttttcagcagacaggactaggaaacactttttttctccaacatgaaattatattactaattatatgatatttccaatttaagttgaggactataaaattgcactttacctcactgatgttacatctgcattttctttttcccctgcctacaatcctggctctcagtggaacaacataatcactcatttgctttatcccacaatacacacccagtagtctcagaaaaacagtatcaacacgatcaccaacagtataactattgaaaagagttttctgtagttctttttgtttttagtatgtatattctactagagatgtacaaatttctgttaacctatgatgcatattactctaaatatgatatcatttccatttctctctctctctctctctctctctctctctctctctctctctccctctctccttttttagagatgggatctcacccaggctggagtgcaaaagtacattcatagctcactgcaacctcaaactcctgtgctcaagcaatcttcccacctcagcctcccgagtagctaggactacaggctggcgccattgtgcccagctaatttttttaaaatttttatttttagagatgaggtctcactatgttgcttaggctggtcttgaattcctgggctcaagcagtcctcccacctcggctgcccaaagtgctgagattataggcaggagccactgcacctggccatttttattatttttgttttaaaacctccactattgatttctaaaatgtttaaatgcttattttctaatttttctttataatgtggggaagagaatatgagtaggaatcattatatgatttatgaattaccttggagtgtcatagttagatcctcaggatactattgcctgttctttcttcttagacctgactcaatttcacaatttcattcactcattcatttaagaaacccaagtaaatgctatgaagcaattggaaaagaggcttaaggagagaatttaacatatatttgttgtttactatgtgtcaaaattatgatagatgctttacttatctcataatttcataagaacattttgaagtataaattattattatgtgaccaattttcaaatgaggcagttgggaatcagggagtttcctttgcccaaagtcataaagatattaagtagagaagctagaattaacatatacagtctgttttactcccgtgtcacatataagatgcagtccctgtccttaaggagttaatggagggttgagacccaagaagaacagagtacaataggagttcaggccaaaagaaaggtattaaactgccggggcctcacaaagaggtggcatttcacctgattatcaggaaataataaaatgtgctggatgtagagggaatgcatcccatgtcaaaaattggagatgagcaacattctgtaggtaagaaaatgtgaggggtatttaaaatgataaccagtcgggttggaccaaagtttagttaatatagggaaatagaaaactaaaagcgttgcctggaatctcagttgggatctgaaggtcattctgaggattcaggacagctagaaacttttgaaggtttgagcaggagtgaaatatgctagggcacaatcctagccactgggcaggctccggctaacccagatccttctccttggaaggactccagacaaaacccaccctcatagatccacaagtcttgctgattgactgcatgtcttctagcaatttcctagaaaagttgcattttcttcgatgttttgctactggaagttttgccaaattaagtcttccagttgaagagagatggagtagccccacatagcattgcattgcgattggcagtggttttctgaagtctcagatgtgagcaaataaagtctgactctaattagacatacttaatctgctcgttgaaacttggagtcaaataagtcttagagtgacatttcagtcttagagtaacatttcactgatttcttataagagctttgctaaaaaatatgcttatcaatttaatcaattataggattctagaaatcacaggaaaaacatcacaattaaagagattttggtaaaactgagttaaaattgggtaggactttttactataaaaataagttatatctaatgttatacaataaactgcctagtttggataatttcattagcttaaactcttccctttgctcagtattaaagttcagaagtggccacctaacctaacattcttacatatccccctcatggggacttttaacacagtgaattaagtgtcccctttattccatttttttataagaatgtatgagattgcataattcatgataactaaacttacttttaaaatatgacatttgctgtcttaattctttccagttcataatctataaatcaaatatggtcgagctctgtgaaatctattagttatgcatcttttgagacctgagtgatccgttgcctatcataggacgagatatgaagtgtgtcctcagtattcttagtacccacccttctttccttccttccttccttctttccttccttccttccttctatacatgtattttttgtaatagcttgaatagtttactgtcatgtaagagaatagtatcttatgtagaaacatagcgtggacttcaccaatactcatttttggaagtttaaacctaagagaaaaatgtttgctggatacatctttataaaatctacatttttacagaaatagttcattgattattataaatatcatgtttgaaaaacttttaaaaatgaagttacacacagatattgtttaatacctttagcactatactgcgaagtgcactgcagaaataaagccattgtttatttagatgggtcagtgattccagactcactactcctcacacaagattttatctgagataccctgatcattgtagtcatttggcttgtgagcttcagttgcccccccatacgcttaaatttttcattttgtgctagtgtagaccaagtcaaagcccacataaacccaatatatgtgttaaggttagagttgtgcttcacactcttgactgtactttaaaatcacctggggagcttttaaaattatctcagtgctggggccccactcccagagagtcagagctaattggtcaggctgcaaggccacaacagttgcacaaatgcaggtggcacctcttaccaagaacctcttcatctccctggccttccaacttcctggagcacaactccactgttttccatgtgaatagcacccctgtacttgtgcaaacttggaagccctagcgatagtggctgagcacccatgttttcagaaggcccccaggtgttctaatatgcagccagaattgagaaccactgacatataactttgacattaggtgtatggattaaggagctgtgtagaaatagattcaagatctagctctactactttttagctgtgtgaccttaggaaagtcatttcactccttggaacctcaatttcttcctaaataaaatagtaatactaatacctacctcatgagattatataaaagaaaaataagatggtcaaagtgaaatgcttggcacaaagttaacacttaataagccacttttattattttagctattaaagcaagatttctatattagtctagattcctacagtactaagttacagaggtctatctcagatgatctgaaacaaaaatggggaaattaagcaagccacggaaggatagagtttgatttggcctcagattttggcatttgaatgctgttaggacacatattctctctctctttctctctctggggcttattccagcttctcttttcatggtgcttgcattctctcagcccaacttccccccttggggtaaaccatgaccatgggcagctcaagacatatcttttcagcctctttagcacagaacaggcaaaaaattcatcctatctgacccggttggaaaagttacagtgacccagcctggctccatccctgtggtcaagagctgtagtcattaaaacggggagaaggagtgctgtgcaggtaaatacaataaccagctttgtttcattgttgagacctgattcaaaataaataaaatacataaaactcctgccattctaggatctattggcagacaaggaaagtcagcagtaagatcccaagagcaagaacttccctgaaattaaaacacctagtctctccactctccatgatctatgcacaataatcaccccttaaggtgaatttaagatcacagaagtgtgccttatcccctctggtccagtttatttgagacgctcaaactcacaggcaaatgaggagttgaatcacttcataccaagctcccagcaatctgcattattgaatacctgaagtgttctgtcctcccactcccaccccatggtatttccttacccatacaagtgagaagactaggcagagttatttatttatgtaagtgttatttataggaacactctctacagctactctaacgtgtatgttatccaagaataaggcaatgaggtaaaacaaccacaaaaggcccagaaacatcctttaacatttggattgttctaaccacttacctgacacttgtggtggagaggcaacaagtgtcatgaaagagcaacaagattcatcacttatagcagtgtgcttttgacaagttacttaacttcctggagcttcagtttcctgatctgtaaaatgagggcaataatatttcaaaggactattgtgagaattgaatgtatttgataagtgataatgtatttgaatgtcaattacactctgtacagttgacattaaataagtggttttccaaggggggtgaataattttatatttaaagcattattgaaaaagctttgctatgaacatgttctcatgtatttggacccagtagagaggatgactgggcatgtactcgactatcctaagaaacattgcaaaagaggcacaagtactattggtactcaccagccattgggttcttagcatacttactttgtggttacaaaaaagagtgatggagctactagcatacactataaccaccctgctactatactggttcagtgtccttgtttaggaaagcagcctgactcatttcactgtaacatggtacaacactgcagagaataatgccaagaagaaaaatgtcaaatattaataacattactagctcttctatttcaaagaatgcctctagggattttgaggtctctttatagttcctattcagccaaagtaaattgattgattataggtgataagagtcggtggaggattatatgagtgaatgtataaaagcacctggccaaaggcacagaatagcacttggactgactctcacaggcgacatcaagttctagtttgtctgctatggactgactgggtattcttcactgtaaaggagcctcatccctaatggtgatgtgaagatagtatgtatcccaaaatatacatagggtatgcattttctgtgacctggaaatgggacaagtacctctgtaagcctcacttattttattttttttcacactgccatgagaaagtaaatgtaagcctcttttagcattaaaactctataacccaaaccccacatttttccagaagtgaaaattgcttacaatgtaaaagatgaacattttgaatgaaggagcagtctactcataaacttttaggagcaagagatgaaatagcacaaaactgcctatatcaaagaaacacgaataaagttcagacgtggattttaagttgttcaaaagattggtacttcaacctactaaaatactggggacaaactgatgagaatatcttggaagtgaaggaacatatttccttaattttcaacatgtagtcttggaaccagttttatttcaaattttttctaatataaatatataaatatctgatttatacagtttatgtatcccgtggcaatgtgatcttttgcttcttttattttcttcctacccctcccccatctttttcttgagggaatcaggaaaaggtgtcctatttctcaactgttgaatctatttatgaaaattagaactaaacagtttagcacaattaagcagaatgccacattcatcaaatcttcatttttctaagacttcaattctgtcagtcactagaaagcatgtgctaagtggaagctgtgtttccggtcttttggcatcccacatctgttgacaattacagaggcacatacagtgccattcatagaatggcatgtgtctccctatgccttggttcacaggccctcggggacatttacaaagtgtgtactttttaactgtcctagaactaaggagtttaattttgcctgagaatgtgtttatgtgccttgtaaaggagctagtcattcccttttgctttcctttattatgatgtgtgtatactctgtgtgtgtgtgtgtgtgtgtgtgtctctctgtgtgtatgtacaccaaagaagaaccacaccaggaattgagcataaaggctttctcttacccatctacacacctttcttgtaagttgctgcttttattttttatttattcttttgttaatagtgtatttcttggcttctgctggattttttttctgtttctaaacactatttagttctgatttcatatccttatgttcttcagtcaagactggggtcagacttctttatattatatatgtaattattacaataaaagtcaccatgtgtggtggcccacacctgtaataccagcaatttgagaggctgatgagggaagattgcctgagcctaggagttcaagaccagcctgggcaacatagcaagaccctgtctctacataaaatttaaaaattagccaggcgcagtggtgcattcctgtagttctaactacttgggaggctgagggaggaggatcacttgatcccagaaggtggaggctacagtgagccatgatcatgccactgcactccagcctggatgacaaagtgaaaccctggctctaaaaaaaaaaaaccaaaaacaagtccctggaccctctctggagctatgccctctttcttttggatctcttcctgacccataagcaaaccatattcttcaggaagtatctagtacctagaaaactgaagctgaatctacatgtcatctatccaggaacttcatctcgctagtcttaacacctcagatatttggcaatacccagaatattgaccatttttcctattttcatccaaatatttaatattgggtatgcatgaccatagtaacattaatttttttcatttaaaagataggtactgcctttggacattgtaagcatctcttgttaataccatgaatagttaaataaattctagtataggagccacctagaggagttgtttaacggctgaaagaagaattaggtgaaaaagaagttgagactgaggctaaagccaattgtggtttcatccacagtggttaatggtgtttcttaatctttaaatatcaaatgtgttgtaatgcttaattatccttaatacataaaggaagtgacctacaaattctttactgtttattgaaaagtagcatatttggaggctttgacaattctacagaagagaggaagctgttaaattctaggctaccatgtccttcaaatgggaaaaaacaaaatgcctgagcatgtctcttctccagcattaaatttttcatcagtttcctattaaactcaaggatatgggaagggagcaattttaattgcttggcacttaaaaagcctcctccactgttcaatgagttagaaatattttgaaaatttgattgcatttagaaccacacaaatttacctgtaataaaatttttgctgcacgcttaaataatgtcttctagaaatgaacatttaaatgaactatagaatgctcagggggtaaagggaagctaatatttattgaagaccataaggtgccaaatacagtatattcattattttatttgctcttcttaacatccatgtgaatgggtattgctgtttctgttttacgaataagaattggggctaaaaccagctgagggggttacctaaatggtacaaggtgcagggcagatctgaaatctgctctgtttgattgcagagtctgttttccttctctgttgtctttacattctcaggattatgttgaaaacagcaaagagtgccatcttattagctcatataggctttacagtcagtgcagcctgattcaccaaagctacacacccaccctcacacacagaaaaccacttgggggctgacttacctggatttgtgtctaaattatcccatatatcaaataatactagatctcctcttcagtttctgctttgtagttagcttaaaatatctcaaaactcacattgtcccagaggaataccaagaatgtcatcttacgttaagtaagtatgtactgtactgtctcatattaattaaatttatggtacctaaatcaagaatccttcagattggcttttgaagtgcactctatctctgccatgggaagagcccattttgaggttttcctacacaaaagaaaagaaagccacctccaggtatccttagggtcctttcaactgatccccaaacagaggaatctagtttcaatggaagtttttaataaacctcattatttgacaattagtcaagtgtctggcattccttctttctttatttttccacttctgcttatgctttcaggctcctttgatgttgtttgcccctccggtggtggtaaatgaccacaatggctaataggctggcttccacaggtgcctgttaacaaccacttcataaatattcaacaggagcattctgtgcgaaagactggggaattaggtgacctgccaaatctttccacatccaatatctatgataatggatacacaaattacgcgggacagaaggaatggccttgcactgtgaaaaaccgaaggggaatcaatacagcctgtggctcccagctcaggcaggcagcctcgcccagtatacttctcccaggtgccgacttggggggtcaagggctttcccctctgcctaatgagcagttcttccatagcaagtcatcaccaccccagagtggtgggctcttatctgtattttaattttttgttataatggtaattagcattacatcttgaatagtaaattaagaaacccaaaacagaattttaaatttaaaaagcttttccattaggaatccagttgcattaattttgtggatggaaggtgagctaaattagccaagtttgtgcattcattacctcgttctaatcctcaacatcacaaatgcaaaagactgtcattagatttgagaactgacaagaactgggatttcacagtatgaatgttgaaagattaatttgaaaagatctcactaaaaaacacaaaaggttattgctaacatggaatattttatattcatagtctgtacctagttttaaaatgcctatttacagttatctggcttaaaaataaatggtacatttacagtacttgatcaaattggaatatttctaggtatcttgttttgatgatagagaagtgtaggtatccaatattatatgataatattggaaatgctttttttatcaagagatatttgactttcaattattatatccaaagagaggttaaaaataaagagaaacaagaaagagaatgggctttttcacccttttacttcatagtatgttgtcaaaaaagaaagttattcttttgcaatatttcaccctttgtgtttgccctgaaaatattaatggtgaagtagaaatcacagtgatgaaagcagtgtcatacatttcatgaaagtacagttaattttcaccaaatgagttgccaagctggtagtgggtaaaaatgtaaatgttcatctttgatcaattgaattttaatgttgtgaatagctgtatgccttgatttatacatctgtagcacattttaaacatctgtgttcaagatgaccatttgggaaaagattcattggcttcacttagttcatgttgtttggttctatatactatattcaagtcccaaatgagacttttctaaaaagaaattttacacaaattgcttactttattatagactgcgcaacctagaatggcattttaaaaaccagcatgggtgatttcaccatgagttttcaaaggttatacaattgttgaagaatgaaaatgtatccgtttcaacagtgaaaatgagaataattgatatttaaatgctacagtagctgaggctaatgtttctcttaggagctctgttaccacaggaccctcactctctgtgttgtctttattagtttctaggagatttttgcatttagaacctatagcctagcttttaaaaaatgctactttaaggtcatagactggagtgtagcattatttttcatcaaacttgattaattttaaccataggtagctcaaaagaacagctcaattaaaactaccacatatacaggaagaaaagaaatagattgcctgtagcttagctctaaaataggaagtccaagctatactcgaaataacttttacaggtgacccttctatttttaagacaattataagctgggcatggtggctcatacctgtaatcccagcactttggaaggccaaggcgggtggatcacctgaggttgggagtttgagacgaacctgaccaacatggagaaaccccatctctaccaaaaatacaaaattagccaggtgtggtggcacacgcctgtagtcccagctactcaggaggctgagacaagagaatcacctgaacccgggaggcggaggttgtggtgagccgagatcgtgccattacactccagcctgggcaacaagagcaaagctcagtctcaaaaaaaaaaaaaaaagagaaaagaaaagaaaagaaaattatagtattaccatttctaaaatgtctaggcagccattgctattaagaaagttgcattgcttctatttaccttacaatgtgtttgcatctttcctaaaagcacaggcctagaagtaattccaatgatccagggggtagtccatagtctccccttcgagaccagagctacagctgcagattttgctaacatcagaatagtccgctagttcttcttcattttctattagtacaggaatccccccatgggcttaaaagcagcagctttgttataagaggatcttttaaaaaaaattactcttgagatccctttctgctggagatatatttattttgtagtcaataaaaacttacaggaccccttctgaaagttttgcttggtaactcataatttaaacatctgtcattttttcctttttaacactaccctttatgtgtattgaactcaacctaggatggggtagggagtactgatcctttctttaattttgagtggccttttggaaacacttacccctggaccagtagtattcaatgtggttaacaatctcctgtacagcttattacaagcgcaaagactcctgagcccaataccccaaaatactaatgtagtaagtgtggggtgagactcagaattttcatttttcttaagttcccctgcgggctaagaagggcatctgggaaccatcctttgaggagtaagatggtctctgagtccttgtttatctgtttacacagaaactacctattgtaaccacctaagaattatgtgatctaggcagtgttttcccaggtatactaatgttaacagttgcagaagcaaaaggataacactgaggttacttcacacgaatggatgtttgatggattctgagagttccctggagtagggagacctgggtgagttccagggccctgatgctgatgctctggcattgtgcaacttaaatgactcagttttctagtgtgtgagtggagataatcatctttccctcctacccacataattccaatgctctgacaaatgtcgaggcactacctgtaaaaataatctaatttctacatgatggtgtagttatataagtaaaagttttccagaacaaaataccaattgaaaacctagcattttttaatgttttataatttccccccattttagatgatagcttgtaaaactacttcctcacagactttccccataactttctactttacctttaacctgtgctaattcatttctataaagacattgagataccagattacatgtcatgtttctaaaccactctctaactggtgtccttggaaatttcacatttcccacactcagaacctaggagatcaaccatatttgactcaccgaaaataataaccagtctgggatatggtatgggaaaaaaattaggttaaaccacaaaactcttcccaataatgagtcagtgtgtgagtgcctctgtgtaagacctcatttaagagcagcaggagctgagtgggggacagttctcaagcggttctttggaattagcatttttgcaaggaagctttcttacccaccccaactagagaaacctctcattgttttacccacctcatcctctccaaacattatgatgcaacttcacatcataacaggatgctgcaagagtccatgcccctttaacttctgctttgtctaagaccaagaacacatctatggctggacaaattgggtttatcattcattgcagtgagggagaactcatgtcatggggacccacgatgcatctcaataaaagggtgttagaagggcttggaggaggattgagattttgtgtagaggagagtttggtaagagtccaagaaagtggcgttcgctctagactgggcgctgttgggaagtggggaccatcctatgactgtgtatcttaataaactgtgtctacagggacagaagcccagaaggagactaaagctttaattagtaaagatgcagccatcacttatatttctcagaagaggggatgtctgatattttgtggtttgccagtgactttgttttttctgggcttaaatgaaattatgaactggctagttttgactgacttcagtacagtcacagagtgaccttgtctgttgctggcgttccatgagattagttatttgttcatgaggagaacagatggcatggtttctttaacagcactgatacctacttgtaattgtcaggccagttcccagatgtcagaggctacttcttttttagatcagatacctttgtagcataaaatcagttttagggcagtatgatttttcatggtgaacattttaggttctctttgtaggtgctggtttttaaattaatctttagttttgccattgtccatttatgatcagttgatctgatttcaaaatgcaaatccctagcatttaggaacttatacattgggaacatttagggatttaggaaaagtgggaagagtgaagaaaggtttctcccatgaagcagtgggtcagtagggaaattataaggaagaccaaagagaatgaaatggttaccaaagtgtactaatgtgagagatacaaagatggatggatagatggatggatggatggatggatggatggcagagagagagagagagaggatgaaaatgtcatgctcatctgaacctcattcttatcaccccagggaaactgcagttatcctaaatgcctctggtaccaataactgacaaaacacatgattcctaccatttagttattcgtctgtttgtatgtatgtacatacgtacatatgcattgcatctgtttgacacataatactgaaaccgtatactgctaaaattatgataaagagcagctaatgttccaataggcttttcttgcttcatagctaaggggaaaatgtatgggatgaaaactccagtagaaaactgtgtgcggcatttagttttaacacccactacctttgaaatctgtcaaaaatccattgtccgctgtggttagcctcagaatcataaggtttaaaggctataaaatgttcagtttcatataaacatagaatggattcaggatttgaggtgatgcattccttttccaataggtacttctgcataactacccagtagagaaggatcctttcacaaaaggtgtgggaaaactatactacaagcctgcagtaaccaaaatggcatgttacgggtacaaaaacagacacataggccaatggaacaggttagagaagccagaaataaagccacacacctacaaccatctgatctttggcaaagccaacagtaaaaaacaatggggaaaggactcccaattcaataaatgctgctgggataactgactagccatatgcagaagattgaaactggactccttcctctcaccatacataaaaatcaacccaagattgattaaagacttaagtgtaaaacctaaaattataaaaatcctacaagaaaaccttggaaataacattctggacattggccctggcaaagacttcatgatgaagactccaaaagcaattgtaacaaaaacaaaaatcgacaagtgggacctaattaaagagtttctgcacagtaaaagaaactgtcaacagagtaaatagacaacctacagaatggaagaaaatatttgcaaactacgtatctgacaaaggtctaatatctagaatctataaggaacttaagcaattcaacaaactaaaaacaaacaatcccattaaaaagtgggcaaaagacatgaacagacacttctcaaacgaagacagacaagcagccaacaaacatatgaaaaaatgctcaacatcattaatcatcagagaaatgcaaatcaaaaccacaatgagataccgtctcacaccagtcagagtggctattactacaatgtcaaaaaataacagatgctggcaaagttgcagagaaaaaagaatacttacacactgctggtgggaatgtaaattagttcagccactgtggaaagtacttttggagatttttcaaagaacttaaaacaggacctaccacttgacccagcaaatgctgtgtgtatactcagaggaacataaattgttctaccataaagacacatgctcacatattttcatcgcagcactattcacaatagcaaaacatggaattaacccaaatgcctttcaatggtagagtggataaagaaaatacattcattacctgggtgacaaaataatttataaaccaaaccccaatgacacacaatttacccatgtaacaaacctgcatatataccccctaaaccaaaaataaaagttggatagaaaaaagaaagaggtgtgagaaaagaccccactgtgacacataagtggcatagataacagtggagattcactcacatttgttgagtattacctagacagtggagattcactcacatttgatgcgtattacctagacaaggaggacaatggcccctcttcctttctgtattctttgtaaagggtaggccttctgagaggttaaaccaccaatcagaatttgaaatctttaaagtaatcaatttatccgctattcatttgccttctactttaaatctaaagttttgtcacagccaatatttatagtctctgacatcactgggatcagaatggaaatactaaaatctgttttgtggtatcctaaattcactgaattagtatttattgtaggactcccatagggtgtgagtctttacaaataaaggtagggaatgccctttatttgtaagggcaaataagttcctccttctcttgtcaaggggatgtgaaaacctccttgcacattttttcttttctttttttctctttgcagaatgagtgttctgagaagaacaaaactcttttctgacaactcttataaaacacttttgtgtttgattctccaacgactaagatttggacacacaattctccattcatttctcaagtgtcaagaaagaattgagtttaaaggctccaattcccttgcaggttacactgtctatctagatgaattagtattcagcacagctttgggaaaatctcaaatgatttgcaggtttgcaaattgttcaaactcataatgaaatttcaggctgaggaaatcactaaacagttcatggcatgagtttttccctctgagatctggacatcttagatcaattcactcctctaccttcgctgccccatccatgccagacagcccagggctgcttgagaaagtcacacacacctgtcaccactgaggttattctcctatccccatgtcctcccctgctcagcaaaccagcccactctccatccattttcattctttattttctgttcctatagcatgtgttcctcttcttatccagggctatgttctgagtccggtccccctctatgccctcaagcaactcaaactggcaattatttatatcctattgcttcaattctctctcttctctaaacttttcccatcagaatataaatatttcaagtattcgccattaaaatatatatatatatacagctttacccaactttatgaacctccagctctttcttttctttgcagccaagctttttgtcctctcactcattcctccttccagtgcatcctgaattccacttggaactgtccaccaggattaccttcccaaggacacaaaggtcctccttttggccaaattgaactggtgcattctagtccttttcttgtttgatttttctgaagcattgacatagttgaccaccacttacatcttgaaactctgtatgtccttagcttctcttaactcctcttttcattcctttttcgcttcccttccttgtgccagtcccttacgtgttagtatatgctaggatctcatccttggactctatttattcaggtcactgttcctggaagataactctatagattctcaaatctatatctacagattttggaagccatgtggccaatgttaccacttgggtatcctgtaggtatttaaattcaacatgtctgaagccaaacttctatctcacccttaccacaacccatctctaggaatagaaattatcgtccaagtcgctcaaacctgaaaacttggcattgacttagacttattttcctcattcactctcccttattcagtcaatccttaagataatgccatttctaccctttaaatgtagcctctcctttattcattgtactgctgccttagttaaggcactcaaaattcctcattactgcattgctcccagttgtcttcccaaaatgtggcttcccattctttcaaggccaactcttgagcatgacatattggtatataaaggcctacatgacttgacacttgccaaactctccagcctggtctctcatgggtttttcatgtggacttaactctggccatagcatcctgctggaaattatttaaaaacaccaaattatttcacaattccttatttcatatgctattattccctttgctacttatcttttaaggcttagcacagagagcgtcttaacacatattactcaagagatgttagcaatcactattgttgtttttgttgtcatgtctccctttagtatctaaggctgtttggtactcctcctctgttttcatagtaaacttaaaacatagccttaatcatactatatcatagttggctacttgtttttcttgtcaccaaattctgaattttacttttctcacttacattgccttcctggaacctaaaagcatttgggcttgttatttctgtttaaaataacaaagaccatcaacaaatttccagtgaaattatagttgtggtggggatgatgatgatgatgatgatgatgatagctacatttattgaactctatgtcctaggcacttgctaaatgtttttaaatgttttccattataatcttattaatgatttcatttaatgggtaaggaaactaacactgagagaggtaagtaccttggccaattcatataagttatgagtggtagagccaggatttaagcacatagagtagtattccagagaccaaaaaataaagaaatcattatctatgtcctgatactaaccttatccttattactttatgagaaagagagcctggaaagtcaattcaaaatatttgttacatgtctactttatgttggattgaattaggtctttgaataaaacagctcttctttgaactttatctcctagaaagggaaataagatatgaacctccctaaataactaggcaaaatattataaatgctaaaacgtacaactactataaaaatggaaagagagaaagtttaaactggttgaggaaaactcaggaaagtcatcttggagaaggcggcatttgatatgtgcctgaacagttgagtcctaatgcgtgaagatggcagaggattgaagagtgcatgagatttgaagggtacttgtaaggaatggaacaaccacctcttattactctgctttatggcaaaggagtaagatgaaggcaagaggccttcatagagctttctccctgcagagaggggaagagtatagtccctcatgactcagaatctcttggttgctgccatgcaggcatctatggaatcacaaaagcaaggcccaggaaactttaaactaacctatgcttcccgcccagaattcagtctatttccatattagtgggtgccttctgtccgtacctatttctgtgtgcaatgtgttgagtcttttgagtggtggcttaacagcccaggagagaattgagctatactgaggcttcatatatgaacacagtatggttctattcttgaaaaggtttccagcgtccttttccaaaactatagagttgtgctgctcctgtctagaaagcagctcagtgaacttgaccttgacccttctgctgtatgaacttctcagaagattgcagatacttttattcaataagtctattccccctttttttgtttagtcaagtaggtaactattttgtgggtatattttctaaggtcaaattcctaatgataatagacaacctgaagttgatagtggccaactccgtgacattgctacttgataaatataccaatcttaggatctcttcttttttttgagtacacaaaaatcattttgaaatgcctgacttgctagttttttgatgccttacatatggaatatgcttaataaattacatttgttatttactatatgtgactcaatatatacatatgcaagtacgtatgtgattgtaacccccattctttagtcctactctctgtcaagaataagaagcttaaaggtccctataaccaacacagaattcaatggcctctgtcgtgtaagtaatgctggcagctacaacaagcaatcccatctcagtggcttaacaaaacaaacatttagttcttgctcatgttataggccagtggggaacagtttgtgggaggggtttggggaggaatattgtgcgccatgcaggtattcaggtatccagacttctatctactgacctggctgtgccctaaggtctcagagccttgaagttctccactggaacctctgcaactggttgcccagacaaggagagagagagagagagaaagaaagaacatgtaaatttacaagagaggtttctggaagtaccacacatgacttctgcccaaattccattggctagaacaagttacatgttacatggccctaactaagtgcaaggggagccaggaaatgttgccttcctatgtatccagaagaaaaataaaatgatttgttgaacatacagcattgtctctatcacagcctttatccccttcattattccactcatttctagtattttgaaagtttcaaggtctcccccaaccctcagatgtcaagagggcctcctagtagattgatggagagagttggggatacataaagaatgcagtcttcccaactttacactactctctttttcctggatcatggctttctgcagctgcttctcatttagttcagtccaaaaacattaattgaaatcccaccatgaaccaagcactgttgtaggatctggggagtcaatgatgcacaagacagtctctgccctcaagatgctgagtctagtggggtcctctactactgtggcatgttctttcatcaactccaaagggctttctccagtgcttttccccctcccaaacttctgggttcttcagagagaggtcatactccccttccaactctagacagcaactctcagcagaagccctgctggtccttacaggaatagtctgtgtttccaaaaaccttctttgaacaccctagaattaattttgagggataagtctagaaaacataacccagagccatattcctgcttattattaaggtcctctttagattatgtcctcaagcatggcacacattcactgatgttctctggcacaaggaaaactctcatcctctctgagtggattggttgtcttaatggtcacagtacaggtcatcatacacctctggaggaagtctgttctccagtattgagaaaaattagcagtagaatcaaattccccttcacaggggaatttattcaattgggtcctggaaacagccattgatatcccatgattcccaaacagagacatgcaaatagaattctacaatagcctgaggttgtatgtgtgtgtgttcactcacacccccacacacacatacataaacacacagatatgtgtataaaattaaatttagaaagccattttgtagaagagactgacttaggcctgttaaataaaagtttaatttaacaaagcaacccggtatttttttcaccaagtttttaaagcattcaagatgctaaattttccaagatgagttttctggaagaagtcccaaaactcccttctctctctttttttttttttttttttttttttttgtgatgaagtctcactccgttgcccactaccaggctggagtgcagtggcacgatctcagctcactgcaacatccacctcccagattcaagggatcctcctgcctctgcctcctgagtaactgggactacaggctcacaccaccaaacctggctaatttttgtatttttagtagaaacagggtttcaccatgttggccaggctggtctcgaactcctgacctcaggcgatccatccaccttggcctcccaaaatgctgggattacaggcgtgagccaccatgcctggccccaaaactccctttctgatcacatcctatcaggcttagaaggggcaggtattttcttttggtgggttcaactccacctttgttcattttgattataggaaaaattcttaagatatgtgtgttttttttttttctgactacgtggtttctcctagtgctaaattctcaccatgcttgaaatattgtagagcaaagcagctctagttatcctcaagaaaaggatcaaagaagggaaaatatattaatgagcacaataattcaaaacctcttaaaatgctgttcccaagtgtgctgggactttctggtcatgtctctgcgaaatggatattttggatcttgctttagcatacacaggaaaccaatctccaggcagttcttccttataatttctttacaagtttccccttaaagaattcctaatgtactttcctcaatagtaacatagatttttctagagttagaaaattatgagaaaatagagtgagcggctatctcaagtgtgtttacttgtctagtcccctgatattaactagctatgtacctctaacaccaaggcaaccacattattgatttaatgataagctgtacagcagtgaaatcacattgtttcttcatagacacagagaaagcagaagcatagctactgttgtcaaggaggttaaaatttagatgtgaacactaaaagtgggaaccccaactggaacataagttccacgagaggcagccttattcactgctgaatctctagtgtcttgagtagtatctggaatatgatacagttctccagaattatttgttgaacgaatggagatccaacagcatagagcaatatatcaccaagtattaaaactgtaagaatggcaggagttcactgagaaaagtgaagactttatgaagacagtggagttgagcagagccatagagctatagacttccaataggtggaggagagaggagcgggcaaaccaggcaaagagagatgagagaagtaacacaggaggtaatgagcatgttgcagtgggaaagtgggcttggctctggtcagaggaatcatgcaatggattaatagaatccaggcaggtcagggatagggataaggacttagacatctatctggttttgtgtcctagcttcgtcatttattcaatagctgaataaatcaccccttttagtctcatttaatatctaaatttgagaataatacatagaacatatatttttaaaattcaagaagaatttataggttaaaaatggtaaacttgaagagcttttttaaaacatggtattatcattgttattatttatgacaacagtgttctggttgaccttttgattgtggttttcttagtgggaaaatagctcatataatggcccccgaatgtatgcctgggaagaaatatgttaaaaaatgaaatctagtgattgattgtttattggataatttcaaaatagtacaagggaaaaaattattttagtactcctaagtattagaaataattttacagttcaatttgtgtgattaaattattgtatattatatacagtcatttcacaaaattgttatgcgggaagtaaagatccgttcagtcactgagttagcaaaggaacttgattagaataatactcaaccacgtttgtattgtcaggaaatgttagagaaagctttagtgttgttaatgactcttggcatatataatactcctcgtccttaaagaacttgacaaacattgatttaagcctcttttcaaatatattccaaaactaaagtcattgtttctgagtatgccataaaagataaagtacgatttggtggttctcacattaaaaaaactgttgaagaagcagaagtgaaaactgcatattcatagagtaatgatagtttgggagatgatagtgttggcttaaaacaaattgggtggtatgttctgcccacaattgatcaaattgtggtcaattatatagacagattcagcaaatatatagtatttctgccgtactatatatatatatatgatatactatatatgtagaagatatactatctctctctctctctgtttctctccttagagactctgagtctaaagcagacatcactaatcaatcacagattctttccaactgagtctttttttcttttttctttttttttttttttttttgccttttgaccaggaaaaggaatccaactgagttttgatttggccattatgtctctttgagatatagggctctaagtagccaataccagagatcagagttggcacaggcaaaatggaacctacttactatcctagaatcaaggatagttctacgaaagtttcaaagagcctcccttatcattaatggctgcaaatatataagggcatataattaataatacataaatgcaggacttaaatgacagtaatatctcaatctcccttcccacgtgttgctttcttcattcatttggcccttcatttttattcattagattggtggctctctctctctctctctctctctctctccctccctccctctctctctctctctctctctctctcctgatagctcaccttatgttaagtgctaaagagaaaagatataagacctgcttgctgctctgaaagagcatgcaatatggtacagttagggagataagatctagctgtgagaagcagtcacacatcctgcttctttttaaaatgaatgtgattacttgagttgtttgtttgttttgaaaataaaaatgcactcaaactgaaaaaaaggaaaacggatgtatttcttcctgggtttgcaaagccacttctgatttcaaagaaagctgctcgataatttcttacgggctcaactctgaaagaagctcttagaaaccaaagtacctaattactaagtcacccccatccaaccatcactactgtttgagttaaactgcctttttccagaagtagagagaggaataggggagaggttctgtgatgggaaaagaatgaggaccagagtgattgtatatgttgctgtttctcgctattcaacaggcaattgaaggcggctgctttacaacattggcaatagtgccttttcacttaccttcttttactcgcagtttcaaggattcagatttggtgttttgattaggaacatggtccaaaaggcctgagttcaggtatcagctgtgcgatttcagccaagttcttaacctatctacatgtcagtaaaatgacattactgacatttttcatctgtaaaatgagattaaaaacagtgtcactgagggaattatggtgcactaaaccacccagcactacacccagactttgcatgggctgaaaaaatcttgtctagtattatcactggtgatgcttagttgactatattagtttccttttgccactgtaagaaatcaccacaaagttaagatgacttaaaacaacaacaacaaaaaagtgtctttttttacgttctagaggtcaaaagtcagaaatctgcttcactgggctaaagttagggtgttagtagagatggttctttacagagtgtctgaggggagaatctatttccttgccttctagtgccttggggccccttcttccatcttcaaagtatatcactccaatcatctctgcttccaccattgcgttgtcctcttctccaactacctcctggtttcctcttgtagggatcattatggttacattggacccacccagataactcaggataatcaaccatcttaaaatccttaatttaagcacacctgcaaagttcctttttgccatataaggaaaaggtgacactcacgggccctaggaattaggatgtggccagccatctttggggatcattattcaacttaaccacattgactaatcagattattcaacatcattgagacagtctgcttcatagtgctataacgcagagtggtgactgtgaaccttgaggccatgagggtttgagatgctaatcaaacaaatcactttagaaaactagtattttttaaactctagtgttatttctgtaacacccatctatccttccactcctgtcttatctctacttgctcagaaagaaagatgaaatctgataaagcagaacagaagagcataatcctaaaactcagatagacctgagttcatgttccaactgcaacctgatggctagctgggttaccttgggaaaattacatgattgcattgggtgcattcctcaaaagcattccctgagacaaagatttgaggtaggactttatctgaaagatgatcccaggaaagatggatggaaagtgaggaaatgagtcagagaatggaaagaagctaataaacagtatattatcaagcaggttactcctgtgggccactgggtgacctgtgggaagtcacaggcagacagtgtagaacatcagaggtatcctagctgtggaaaagaagctttcatcattggctgaggactgatccctggcacattatcttccgcacttccaggctgctcctgaagcaggctgagaaagccctggggagactgcataggatggcctacctctagtgagaaacactgagtgccacactggttgtaaatggggtactagaaaggcctctctgaacttcaaggatgatagtactcagcttgcagggattttctgagaattagggattttctgagaatcacatgctaaagcacctactagtatgcatggcacataataatcgctcaacaagtggtagcttctaaataatgatcatatcaaaggtttgcctttggtttctgcttatgaaattagtttgcacatgagaagatcactcgacatttttgtgcccagtcgttttttaatctctaaaatcagggaggagagtaaactaaaccatcccaaagtgtattcttaggactaataatctaagtcgtcatggcttagtttctcatgtcctttggcactataatttcgctctggcttctatgctgatgattgtaaactgacctcagctgatttggtcatgtatgactcttaggatctttttggtaaatcatagtagcctctgatgaagttttgaggtaagagttgcctgctcaactggcaacttcactactaggttataatgaacagaaattccagacaaatactgtcacaataaaacatccatcaagtaaacatttattagcaagtaaacacacagttacacacacacaatttatatgacctgttttgtaaacttgagcatgtgtcagctgttatttttagctcctctgacccccatcttgcacaaaatattccctgaaggccatcacaaagattccacagtcaggaatttgtcactctttggctagcatcagggatctagaatccctcagtgttcctggctgggcataggactatttagagatttagtctaggtcatcatccctgagggtgaagtctacaggactaattggattcttgtgcccttgtgaagcaggtgtgggaagtgtttctaaaatatttctgccgatccacatgtaaggaatacttttaatttcactgagagtcttttcctaacattcactggcctacataacaaactaccaatttcatcaacagaaaatctgtttctgactttcagtatgttaattagcaaagcattgcttgtgggttgagatacaggtaacaaaaacttgtggtagctaattgaaaagaccaccccggcattgtgccttcttgattagcatgcagacagctctcgggttatagcttaacctaagtaatggtcacgtggtatcacacagcacatgctgaagtttggggatttttttagattatagtaaaatagacataaaattccactcagcccttgacaaccaacattctaccttctgcctctgaatttgacaactctggatacctcatctaagtggaataatacaatatttgtccttttgtgactggcttatttcacttagcataatgtcttcaaggtttatccaggttgtagcatgtgtcagaatttcatctctttttaaggctaaataatattccattgtatgtgtataccatgttttgtctggttttttattcagcagtggacatttgagtcgtttctaccttttggttattgtgaataatgttgctataaacattggtatacaaataaatgccaaaagcattttgacataaattacagatataacaatctgctccttttactaggaacctaaggaacatgcaaactattgcttaatccttagtattgttgcagtttagtaaaacacttgtagcttcttagtaccttagtatatctaaaagcattggtcacgtggatcttcaaaataagattttagaaggaaacagttttaaactctttatttgttatcataagcctgatttcatatttcattccccaaacagcttttaaaaatatcatttaccctatagtcatttaatttcctatacagtactttcattctgcaaaaatcagttacatttctacagctatttggtaattctgctttgtttctaggatgcagttgcataaaacattatattctgtgacctcaacctcttcatctgtgaatgctgaaatgtgccttcatcttcctttccattgggaggtcccgatactttacagaattttaataacttccctctgtaagaccatgaatgtggatagtatctgctctgaattctgatgatggccacgaatgaatcaagtggattacataccagcagagattggagggcttggattctgtgcaggatggattgtttgtttccttaatttatatgtgagaatgaatgtgtttgtaaaatcaggaaaacccaggaccaggcactgttcttacctacaggtatgctgtcagaaagcccctgcccagacttctggatatttccttaacatgcttggaaagaagtgtgtttcctgagtgatgagttcccgggttctgaccctatctttgcaagtgatagactgcaagttcttagaaaagttgaccttggactttgatcacacatctgttaacacatttttattgagcacctactatgtgtcaggcactctgccaggtgcttaggatacctcagtgaggaaacagtgctccctgctcttgcggcacggcgtctagagctgctccttgggagccactggccacatgtggctaataaaatatgtttaagtttaggaaaattaggtaaaatttaaaattaaattcttcagttgcactagccacatttcaagtactagacatccaaatggagatgtcaggtagagagtatgatgctaagaaagaggtgaaggctacagaaatcatttgagaatcaatagcaggagagccttgggccagatggatcgcaagtgagtgagcatagagaagagaagagccctggcagttccatcattaagagcttggggataaagagagagaatcagcaaagagccgagaaagagaggccagtataggaagaaaacgaaagagagtggaatactagaagccagtgaaaaagcgtattgggatagagggagtgattctcgtgtcacatgctgcaggaatataaagtaaaatgaggatagaaaacaaatcattggatttaatatattggtgaccttgacaagaacaattctattagaaggtgaagagcaaaagccaaacaggaaagaacagaagggaaggaatgggagctactgactctaatagcagaaatttgctacaaaggatctttttttcaaaaaggcttaataggtagtgcactaacatttatgggatccaggccaaaatggaggcctatatacaatatttgtaaataggtaaaagttatttatcaagctaacaaactattaaacaaatatgtgctttgcattatattgacaaatataacttcataagaatctggaaaagcagattccaatttagaattattggactttggagttctgttctataacttggtggcacagggaaagggcctgaggcccacatgccttggcttccaaaccccagcaccatcccatactctgaagggtgtgcttgtgaggggcctgcatgccctggcctgcatatcccagccctgtccacacttcttcaaacaacgatcccctgaatatctcttgagtccaggagtgtgtaaatcagcaagtccaccctaaggaagatggacccagagaagaggactatgaacaccctgtaaggggctaaggaccatgtgggcagagaattctgaggtgcagagtacccatgatctagatggcaggaagcatcagctctgactaagcacttctccttggcctagcaaatgctcacccagagagagatgtatggctggagaagggccagaatacagaccttaaggcacagagccaagggcagctctctgaggtggtggggaaatggggcaaagaaaaagatttttaagataagagaaataacatgtttgctcatgagaacaatccagtagagtgggaaatagatgatgtggaaaagaaaaggatagccaaagccattatctgagtaggcaaaagggaagaggctgtggtgtgcaagtgtagaaatgggctttggatataagcttgaacagttcctctacagcagcaaataagaaggcagagcatgtggatgctgatgcaggtgaggaagtggatgtggtggtgggacgatgtggaagttcccttctgattaatcagcacatgtttctggaagatttctgattaagaatgccttgccagtgctgtttcaggtcaaagttgattatttttgttaatttaatttctatgtaagtctcactaataatgcactgtttttaagtatataaagtactaatattccatgttgtatagctctttcactggcatagtttctccatgaggaaactgaggcacagagagacaatcatttgtcaagggacacataacaactctgctgccattttctcctgacttatgatataacaggcagctcctactggccttttgaatgtttttcttgatttaggagtctgggggttcccaaataagagattttatttttaaagacttgatgggattatgtcaattttaaaaatcaataaaagaactagaaagatgaataagaagaatataactcctttcttctcataaattttatttttaagtgtcaaaacacgcaatttcttttcagatactgaaacctgtgatattatgtgccctttgcctactgcaatcgctttctgaatagtcaagtgattcagcgattacctctgtgcacccaaatcctacctgattggaaggaagtcaccggggaggggatggtgagatgacgcactaaagtaaaactccttgtttgtaaaaggtgaataaaaaccacttttgtgttactcatagagactgaattgagatcaactttaaaacatattttgaagaatttccagcttcatagaattaaagtggttaattatagacaataacataagagaaagagaagcttgttgagtgaggattctccaccacattttctcaaggacttcaacctttggctcactcttcctccatacccatattctgccatgatccttagtgactccaacgtccaacacaaaatgtcaccaccgttcagctcatccctcagcatagcttgtaactcatcagcattcagagatgctctccttcaaatatcttgagcattaaatttaccttagttgatccacattgcctcatacttaccaactttcttgtacatcctgaacctacttctcttcttcctgacttccagacccttgacccttccccacccttcactggccctgctccatcccattcctgcttctagccataatccatttcaagggtgttcttaatagctacggtgcactttcattctccatgctctgctagtttcccacattggcaatgatctccactgttggtctatgccatacaactcagaattgcttcattcatctcaggcaaaccccctttcagattctctatagtgctgtgttctgaacccttaacatgctcttgagaccacagttctacctttcactgaaggtcttttctccactatgttgagacattggaggatgtctgtcaggggttctcattcttttcttcccctcacccttcacagctttacccagccctccatcttccttcctgacccagaaggttcccctcctttctaagggtgagccatcaaggtctaccagaaccttgctctgtgaacgatctcctctcttcaatgtctcttcctcagtgattccccctttggcctgcaaacatgctacacacaaatgatttttttttcagttatctagacttttcagactccttgaatgattattccccttctctttcttggtgaatcctatggaatatgtactcagcgcttttggctcctactgccttacccgctgttttatgacctccgcctccctttctggctttacctccattccccacatgactcgtcctcaggccaatgcacatccccagctccctaccttctatctccatttcttcctccttctttgccttccccccaaaaaattctttaagggttattctccatggagccttcttgaggcagcacttctacaaatccatgctatctttctacccaactcttatttttttctatttttactgagatacaattgacatatggtaaaatgcacccagcttgatgagtttggataattatgtaacctgggtgaccaccacccaaataaagacagaacatttccagcaccccagacattttcccagttctacttttcagtcaactgccaacttcaccaagagacaacactattctgatttctattaccagatattagtttttcctgtgcttgaacttcatataaatggactcacacacgggtatgtatcatatttagcactgcatactgtttctgagattcatccacgctgttgcatttatcaataattcattctttttgattgctgagtactattccattatataaatacaccacagtttgtttatccattttcctgttaaatgcatatttaactttttttcagtttttggcatttatgagtagagctactatgtacgtacttatacaagtgtgcaagttttattttctttcttggaaaaatatctaggagtgggattgccaggtcacaggttaaatatatgtttaactttctaagaagctgtcaaactattttccaaagtggtttttaccccttttcattcttcacatcccaccagcagtgtgcatggagtctggttgctccacatccatcccctacttctgtgtcctccttcttggctttttttggcatcactgcctatattcttagagcatcttatctcatctcccctccacttgagcttctgagggactgcagttgtgccttcatcatctctgcacccccacactctagccttccttaaagctctaaatttgtacagaataggataatatggaatccagcgaaggagccagggattcgggagttctgtacaaacaaccaagtggcccaaccaaatcaatatgatccgactcacccagcagtgtattacagtattgcagcttgaatgtggggctcctgcggccatttgtcacagtcttcaggaaaggctttttatcagattcatagtggcaagtgatacaaattattggatttcttttccaacataaaaaatagctatttgcagccttttgaagctgggtaaatgagccattgatcttacctgtggaacaccgcagggtatttttgtccatcctaactttcaatattctatgatgggagcccacccctccagccaagctggtctaatcattattccttgggtgtgcctgatctgtatcctcctccataccttttcccacaatgtagagaaaatttttagtggaaatgtcctcccttttcctcctcctagaagctgtcttcaaggcctggcacaaatgccagtacgtctatgaaggcttcccagctgcatcatcctgtagtaactcttctctcccatgaattattacaaccttcccaggatgagatgacggcctccctcatagcttcctggacttctaaatagaaagaggaatctgagaacagaagagagctccctaaatgacaagtgtaccccagatgtctgtggccatgtcccagagggccagctgcaatgcagggcctctcttttgatgtcccttgttcacaacgagccatttcacttctagtcaggactatctgcctcctaccatcatcttgaagcaataaattgcttcagactgtgtttcatcacttaccagtcagtcaagagcttgggttgcattcaagagcacatgttagagcattctgtctgctgagtgtgtgggaaggcacagagtaacatggccctgcctcatgtcgtcagtgcaggatgctcatttccaagggggacaagaaacattcagcttaaatttggtaaatatcttgaacaaaacaagaggagtctaaaaaccctccaggtttcttttctcttattctgtctcactctctgtcaaagcaaaccagcacctggtctgtttcttcatatgctctgggatatcttcctgaagaacagcctgaaaagcagagtcttctcttgccattgtccacactgatctccaggaaatccttcatctttaaccctggaaaatggcagctggagaaccaaggaataccaccctcccatgcttccttattttccctttccagctttggtactccactctgtcctcacctcccatttcctataaaatatgtttattcattaaaaagtatttaatgccttattttttattatttttattttttttttatttttttttttgctaagacactgtggtaagaattagaagtccaacaacagacaagatgaaaacagtgtctacttctggggcttatattttactaggagatatagacactcaacgagtcatctacaaaagagtatcctgactgccatcttagtaaaagtacaaggactgtgggcatatgagaggggcaaagaggccaagctcaggacatctgggaaggcctcagagaagaactgacccataagctgatgagagttacccagaagtcagctggaagccatgagggtggcatggcacagaggacatgggtgggggcacccagcaactgagagcatggcacaataaggaagcagtggcaggtatgagagggagtggtgaagacaaagctgaaaagggcagcaaggatattcccatcacaggcctttcttgtacgttctaagaaagagtagggacttatagcaaaggggagccatttataagctcacacaggggaatgagggcatcccttttgtgtttgcaaaggccgtgctgcagcagcactgacagcatggatcagagggcaacactggacaggcgggaagacagaggagacatgacaatggcttccatgaggggaggggcagtgctgatggcgtacatggaggcactagtgatgtcacggagaggaaggagtaaaggatggggctctggtttcaggcttgcgcctctgggataatcgtagcacacccacagaagttgggaagactagaagctgcagatctagggacagagggaagccatttcggggatagtttgctgtgtatctgggcctcaggagaggcctggaccattggggtcacaaatcatcaaaactttgctagtcatgctgccctgggagtgggttagacagcccaggagaagaggagggatgctaaggagcaggcaggtaaagagaagcccatggagaagactgcggggccatcagcgagtgggggcaaccaggagagaggctaccatgacagggcttggggaagagttttgcaaggaaggcagatgatcaagcaggtccagtgtcccagaaagacctttttttgtttttgagacaagtcctgtgctgtcgcccaggctggaacctcaagaggcttggctctgaagggaggagacagagagagcagcagcaggagaagggtgtggggtaaaagaatgggttggtttaagacaggaggaacataaacaggactttaatgtgttttagaatgaagaggatgagtgaatgaatgtttggtgagaagcaattacaggatataaagcaaataattagaatataggcacagtgtttactgacttaaacacttaacaacaaaattatatgatagtggactgaatcctcagtttgcaaaacagagaattcagttccatgtggtggaggcagcatagtgagcaggttctggagcaaacctctgtggtgcattcccagttgagggtggctaagggcaagtgacctaatctctctaccagaaatggagataatcacacccatctctcaggcaacaacaactgagctcagttagagcgcaacaaatgtcagctctaatcagctactgaaacctaacattaagggaataaaacgtatctggtggatactcacccagtctgctaaaggtacagaaaaatgtgttcatgtgctgttgatttctaaactgctgaaactcagaccagtcctcaagagctgggcctgttccaactgtggaaacacttagggtttgtattgtttggctacaacgtgggcagcagagtgtccatcacgaaggccatgtgtgcacagccaagaaaactcttttaggttcctacctgtctctttccagagccatccctctggatttcagatgagatttccctattaaggagggatgccaaatgctggggatttcataatactcccaaccccaggcaccagatttgtgtaattgcagtggtggagatttaattgtcctttgaagaggccccatactgtttgtctgtcaaattgtctgcatgttggtgcagttgaaattataggagaagaggaaaccaggggtatgtttcaaagtagttggcacgtggttggtgatccatagtgcaggtttcctttctggaaggtaacaggactgtgttctcataaggcagcatggcagggtggaagccatatgggatttgccctcgaatttcagcgctgccgttgagcagctgtatgaacttgagctatttgcatatcttcttgaacttttttgctcctctgtgaatgaagccattgcaccagcatgttttcaggattaagtgagacaatatgtggaagtgcctggcacacagtaggtgttcagtatttttttattttccattctctgtgtccttgttttgactaccaggtaactatgtttaccctcagagatctgatgtatttcttcatatcaagtatatatcaagaatttcatccctcatcctaatgcattaaactcactgcatggaagttataccattacctagactcaccacggtcttgtcagacaccagcagagttttgtgtggctgcaatagagatgttattgccagttgtcagtattgaaatgaggcactccttcatccttcagtgaaatctgtgcaggcattttcctttctctggttaaacattttatagtctcctttaaaaacaatgccctcatttcatttcctctctctggctggactcttctcctccctcctgctttcctaaaatccatcttgtttccctgtattgtttgctgaatgggcagtttaatgaatacagcatttccattttgaaatgtacagagcacaaggcagaaactgaatttcctcctggacagtttccatccacagtcctcatttccagttttctcccttcttttcttttctacaacacaactgaaatttgctgaaccagaaaggggaggaaggaggtgtgacaggagaggcaatatgccttctcattgtttcagcaaaagcttattagcatcctgctccctagaagagaccaagtgccctaaagatgccctgggtgcctcttctattgcacaaagctcaaggtccagagtatacagtgcatgacagaatctaattaccaagataattactgttacctgcactacctaactgttgtgttttgtaatcaaaagctatattggcaggggtgagtgtgagcctgctgaaaactcagggaaactgttgaaggtttatcaacccgaagcaattttactctagttagtgggcctgtgttgctcagttagcagaatgtttggggatcagaagaataccccagagcacttcagccattgcatagacattagttaccgggtaggaatatcctcagctgactcaggtattcatgttgttgaaaccagacttcatggcaatttgaaaacgtctgtgccatttttaaatttgttctcgaaatagttgatcagtacctgacttagccttcatttggcattcggtgaaggagaaattgatttcctttgggcatggctgtatgtacctgatgggtacagcgtgtgctaagctggatgtaggtatgtattcatactatcaccacctgcttcatattcattatggcacaaggttacaaattggctttctgtttcccatctcagccagctctagttaatttatgtctttacctctgtgcttcacacactaaagaaatggagtttctactttaaaaatcaggtgtattgaaaaaatggttataattgtttttttaaatttttaaagaaattccaagtggaaaacaaggaataagttgcaaaagagtatgaaaagtttggtaataaaggcaaggacacttaaaaggagggagtaaaataacaaagcaaaatgggtgaggctgacaggctataaattgaaaagggagaaggggtcaaggaaaatgcagacaggaagaaaagagacagaaaaagaaatgatagggccttgagtaatggactcagaaaaggaaataggaaaagttaagaccaaagtaagaattatggagacaaaagtcaaagacatccaggtctcaagaattacaggttattggtggcctgggaggtagtgaagaggggctaggcatatccctcatgaagttagatgtctgaattcctcaggacagtgtgacagtcagggagaatgtcccctgaatatgctaattcagactctaaaataagagccagccagattcattaccatggttggccagcctgtaatggcaacagaattcactgatgcatattaaactgaatttttctaaccaaggtcttaaataaacagacaccagctataactgaaaattagaataaggccttcagtggtgactatttctgtagggaaagtctgaaaacccttaacatggtttttttccaaatttttagaaatttgtggttcttaaggctgcttagtatgttagcaattgctccagtgcaggactgtgtggatccctctggtattttcttttaactttctgcaaggcagagagtgtggctgacctgtgatataaatgaaaccccgtggcaggaacattaactccatctacaacaaaggaacatgtagagatttggattctaatgaaaataatagaagctccttctcccaaagttgggaaatacagaggaggtcttctcagccagtccaaatttgcaaaaccagaatcatcacagaaaggtagataataggaggcctaagagaaagctcagttgtcctttggcctatggcctttgggcttgctgtagatcctctgttggcaactggatgctctgttgggtccaggaattgatgataaccagtagtttgtgggtagatttccatgttgagcactgccttcagctaagtgctttcagttgcctcttgttatggttggagctgaatgacctttgtttacgtgtgtttcaggctaactgatgaattacaagattttcaccaatgagtgggaaatgtagcgataattattcagactgatttatatttgtctttgggctggtttttcatgtatatttttagacattttaatatatttggatctgattttttataaaatcatgaggttctctttatgctcaagtgctgccaagaagttggacagccctcctgttcttctcccagttccccagtccctattccagatgaggggatgcagagttagttgtcaattcattcaacaaacatttattcagcagttagagtgactatctcatctcagtttccctgagacttttctggtttgagcactgaaaagttctatattctaggaaactcctcaacctcaggccagccaagacagttggttaccttatcatctaccatgttccaatagagctaggagagaccctagaaatcatgacaatttctttattattattaattactttttaatattcttcttttttttgagacaggatcttgccctgtacccaggcttgagtacagtggtgcaaccacatctcattacagtctccacctcccaggctcaagcaatccccctgcctcagcctcccaagtagcttggactacaggcatgtgccatcacacctggctaattttttatttttatttttttgtagagacgaggtctcatcatgttgcccaggctggtctcaaacttccagtctcaagcaattatcctgtcttgatgatttaaattcaaagaaacctagcttcccaaagtgccaggattacaggcacgagccacagtgcccagcccattctgatttctacacacccattttaaagtgccagttaaagccaaggagacctctttatcaatttgttttccttctgattcacacattccctggattggaagagataattaagttctatggttgaagatgttatcttcaggctgcattaaagaataaaattaaataaaaggtcatgcagtgtgccaataagagttttacaagccagttggaatttgaaaattagagagtcaaaaagataaagtgaatcaaaaatcatttatttagtattgaggtaccttttggtacatcaaagagatcatttataaaatagtataatgtaaggaagttgaaagaatgaactacagtggaatactattattatatctacttatgcctttttttctggaaaatgttcacaatgatgtgaaaggatctaagaccagcctggcagccaccagatggtgattctagtcctggctcagtcagtaataggtcactgaccccagagaaatcaattcagcctccccaggtccttggatttctttctgtgaaaatgaaagcataggtaggaatttcccatggaacagctagcagaggagaaatattaaaagtcaggagactcatgctatagttttcatacttcattacaacaatgttgtttaggacaagtgagttaacctgttagcttcctctatataaaatggaaagtcattaaaaacctacatagcagggttcttgtgaagatcaagtgataatgtaggaagcatgtacaaatgtcacattctgccgtcacgtaatggtcctcacagcttgaggtagcatttagcatgtgtcatgatttagtacaagggttggcaaactgttgctcttggattaagtctggctcattgcctgtttttcaaagaaaaaaattgtatatgtgtgtatatatgttatatataggtacacacacatatgtgctatatatagcatatatacacacataatatataaacatgtacatatatagcattatatatatacgtgtataatatctccagtcctcatgaccagccatgcttgttcatttacatttgcatactctatgattgctttcatgcaacaatggcagagttgagtgattgttttgcaacagagactgtatggcccactaaacctaaaatatttagtctctgaccctgaaatgtaagattgatagcccaggaccaggcgtggtggctcacacttgtaatcctagcactttggcaggccaaggagggtggatcacctgaggtcaggagttaaagaccagcctggccaacatggtgaaaccctgactctactaaaaatacagaaattagctgggcgtggtaatgggtgcctgcaatccaagctactctggaggctgaggcaggagaatcacttgaacccaggaggcagaagttacagtgagctgagatggtgccactgcactccagcctggacgacagagtgagactccatctcaaaaaaaaaaaaaaaaaaaaaagatagtccaagatccaggattcttttaggttctgtgtcactatgtgatctcaggttaatgatttattgtttctgattctgtttcttacactgtaaaaaaaaaaaaaatggtgggggggaatacaaatccagccccttctttcctcacagaaatgttgttaagatagataagaaaacaaaatcattgatctcttctggaggaaagatgatttaaattcaaagtattactcataaggtggatgctgttagatgactcagaaatgatgactgatgtgttattattattctctgaaattagttccctcatgtacctcagtgggggattacttagaacagcgatagcatacagacccctgcatcgtgacactacatcaaaagctaagatactgcaccagaatctaatttaatcacagtacccagtcaggagtgagttttaattgtttctttatccctttatcctctgaagactgtcattaacatttacaagacatgaacttcagatcatgccaacatctctgctgaggtcacctggcagctagccattttagtccatgatcaagacagaggggccttctgggcacatgaggagggacaagacagaacagtagtggtggtagcacataagctggtttacagagcaaataccaaagataggcttgtttctgttaaaacttgaatttatattttattcttggacacatgactgatatccaggctgactaagaacatacacaagtaaataacaaaactttgtctaacacgtataaatattaggacctcctttttccccaagaatcccctcaaacctctagggaggatctccctaaaggagcagctcttcatgtggctgaaagcagccacataaggaggctaaggctggcctctgaaagttacctcggcccaggtgcagcccatttatagaccctctatacccaactccagatttatggcatagataaattagtgggcaatcatttgctctataaaatgattcttcattttacaagcttattcactgccgcattcctttactgatctattcctttactgatctattcctttactgatccctctatacacaactccagatttatggcacagataaattagtgggcaatcatttgctctataaaatgattcttcattttacaagtttattcactgccacattcctttactgatctattgccactagtgcagttccaataaaatctcattgttagaaatccagtacacaaatgctttttcactgctaacctggatggaaagatgaagaatacaatgcacttataatccccttagatcttatgatgtggctttggtcaaagtcttctgttctcagtttaggagcttaatgttccttggtacttacaattgacagggagagacaggacaaaagattctttaaaataacaatgaaacaatatgtgatttcattaactaacttgctctaattatctgcatgagatttttaataaaaggatcagtcatacagaaataagctaactggccttttgatgatgagtaataatgatactgacaatagctaccatattgagcattaccatgtgccccatagcattctaactcattaactcattgaagctaaaacctaaaaggtaagtataattattttcatttctgtattacagatgaagaaattaaggcacagagaagtaaaatatcctacctcatgtcacaagctgctatatttggagtcaatattcaaactcagtggcactgactttataattttgctactaaatagttacagtgctgtattgacaagtaaagcaactgtcaggtgctgaaatgtaggagcaagagcaatacataacatgtgttctaccttcaagaaactaataagaatttctgcctcaggccattagagaaaaactggtttgggacttgtcctttgccataaaatgaaagaaaaaaggaaaactggacaaaatatatcaaacaactaatttcataccttggacaacaggaaggttgttgttggacaacaggaagccaaagtggaaagaacttgttgggtatatagtaaattgaacagagaccctagaagggccttggtgtaatagtaaggctaaactagccctagaatcaagattattttagactcactctggtaaaacttaaaaacaagacttgaaaggatcaagtacatctagagctgccaaaacaatagccaacactttttaaaggaaaaaaagacaatctagacagacactcaacatgtaaaatttattatatctatcattcaatcaaaaattactagacatgtaaagaagcaagaaaatatgacccacaactagaacacccactgaagagaagcagacctagaaatgatagtgatgatgaaatttgtagacaggcactataagcaactattatacatatattcaaggatttaagagaaatcagaaacataatgaaaagagaaatggaaactatagaaaaggaatcaaatgtaattctataactgaaaaatacaatatatgaaataaaaaaattcaccttatgggctcaacagtagattagatactgccaaataaaagatacatgaactcgaaaagatagtgatagaagcaattcaaactgaagataaaatgaggctgaagataaaaaggctcttgtaaaaataagaacagagtctcatttttaaataaaaataaacagagtctccatgacctgtgggacaacatcaagcagactaacatatatgtaaatggagtcccagaaaatgtcagggtaatggcaaaaaaacctgaggaattaatgactacaatttttccaaatgtaataacaactataaactgacatatccaagaaactcaataaaacccaagcatgataagcgacaagaaaatcattacaatcaactagtcagaaagcagcaatacaaaaaaaacttaaaagcctccagagagttgaaacacattatataaaaaagaaaaagatgagaataatcactgatgttttttgagaaaatgcaatgtcttgtagaagacaatgggtgacatctttaaagtgcgtgaacaaaaatctgcccacctagaattctataatcagcaaaaatattcctcaaaaataagaatgaaattaagaattttttagacaaacaaaatttgatgagcaattttttcaccactctaagaaatgtcgaagggaatttatcaagtcaaaataaaataatgggaactcagatttgcacaaaagagaaaagtttctaaattaataaatatgtaagctgggtgtggtggcttatgcctgtaatcccagcactttgggaggccaaggcacgcggatcattgaggtccggagtttgagaacaggctgaccaacaagctgaaatcgcatctctactaaagatacataaattagccggacatggtggcgtgcacctgtaatcccagcttctcagcagcctgaggcaggagaatcgcttgaacccaggaggcagaggtttcagtgagccaatatcacaccactgtactccagcctgggcaacagagtgaaactctgtctcaataaaataaaataaaataaaataaaataaaataaaataaaataaataaaataaaataaaataaaataaaataaaataaaataaaataaaataaaattaaaataaaataaaataaaatataaaataaaataaaataaaataaataaaataaaataaaataaataaaataaaataaaataaaaaaaataaaataaaataaataaaataaaataaaataaataaaataaaataaaataaaataaataaaataaaataaaataaaataaataaaataaaataaaataaaataaaatataaaataaaataaaataaaataaaataaaaaataaaataaaataaaataaaataaaataaataaaataaaataaaaataaaataaaataaaatagtgagtaaatataaaaggcattttggtttttaaaatagcttgaaaagtaaatggactgttcaaataaaaaataataaagatataataatgatataataggaaaaaatatatgataatagcataaaagaaaagagaataagtggaagtatactattgtagaattcttaaatatatgaagtacatatctaatgaagactgtgatagttaaaatgcatattgtaaatgctagagcaaccatttttaaaaaatggtatagccaataagccatagaaaagatgagatggaatttgaaaagaaaaacctcatatgaaatgaaaggaagaaaggaacagtgaaagaataaagaataaggtacaaaaaaatcaagatgatataatacaaactcaatatatcagtaattacattaggcataaatagactaaccatgccccattaaaagacagaaatcgtcaaactgaataaaaaaagcaagattcagttatatgctatttacaaaaaaaatattttaaatataaaaatagctaggttagatataaatggatagaaaaagatatacagcaaattctgtatacgtgaaggctgtcataattgtactatctgaaaaagttggcttcaaaatagagaacattattagagaggaggagggacattttataatggtaaaataatctattcatcaataagacacagtgatcttaaaagtaaattcactcgccgaggtgggcagatcacaacaaggtcaggagtttgagaccagcctggccaacatggtgaaaccccatctctactaaagaaaaacaaaaattagatggacttggtggtggacacctgtaatcccagctgctctggaggctgaggcaggagaatcgtttgagctggggaggtggaggttgcagtgagccgagattgcaccattgcactccagcctgggcgacagagcaagactccgtctcaaaaaaaaaaaaaaaaaaaaaaaaaagtaaattcattcaattacaagctttgaaaactacatgaagaaaaaactgacagaattgaaagaatacacacatctatagttgtggctggaaatttcaacacttctcagcagttgttagaacaagtagctggaaagtctggatatggaagattcaaacaatactatcaatcaacttgatcaaattgatattacagaacactgcattcaacaacagcagggtgtacattctttttaagtgcacatggggtattcaccatgatagactatatgctgggttataaaagcttctcaacaaatttaaaaggattaaaattatatgaggtctgtttgttgaccaccatggaattgggtaagaagtcaaaagcattaagatatcaagaaaattcccaaatacttggaaattaaatatcacacttctaaataagccatagatcaaagaagaaatcaccaggaaattagaatttatttgaaccttattgataataaaaacacaatatatcccagtgtatgggatgaagctaaagcagtgcttagatggaaatgtgtaggttaaatgcttatgttagaaaagaagaaagttctaaaatcagtgatctagcttccacattaagaagctaacaacaacaacaaaaatactaaccttaagtacgtagaaaaaagtagaaatcaatgaaatagaaaataataaataatagagaaaatcaatgaattttaaaacggactttttgaaacaaagctataaaactgataaactatcaagctggtcaagaaaaaagagaagatgcaaactggcaatctcaggtgtgaaacaggacacatgactacacatacgtcattaaaagggcactaaaggactctaatgaacaaacatatacaaaaaattcaacaacgcagatgacatgcataaattccttaaaagacaaattgctaatactgattcaagaagaaataaaaaacctaaatactcctataaattaaatgaattgaattcataagtaaaagcctttactcaaagaaaaccccaggcccaggtagttccctaattaattctgtgaaccatttaaaggataaataataacatgactatgcaaactttaagaaaacagagaaagaggtaaatacttcccaactcattttataaggcgtgtatgacactgatatcaaaaccaaagatatggtaagaaaactatagaccaatatccttcataaatatagacacaaaaattcttaacaaaatataagcaaattaaattcagccatatgtaaactggataatatactatgttcaagtggcatttatcttagaaatttaaggttggtttaatatttttaaatcgatcaatataatttaccacattaacataataaaggaaagagtatgatcatttcaggaggtgcataaaaagcattgcacaaaattcaacacccattcataataatgacttttggaaaattaggaatagtgacagcttcctcgacctgttaaaaggcagtgatgtcaaatcttcagtttaattatgaaagagtgaatgctttcctactacgatggggaataagacaaagattcccgttctcaccacttctatttaaacatcatattgcaagtaccaactagtataattagacaagataaagaaatcaaagattacagattgcaaaggaagtagtaaaattattattatgaataaacaacagaattgtgtactgtcaacctaaataactaaaagagaggggctctgtgaaagaaagatgtttatctgggaatagagctttgcaatggaaatacctaggctgtagttaactatgtgtgtattcagggaggtaaaggaagacaaagctttttcaaggaaaaaatgaggaagattacataattgttttaaaataattatccttgactacaaagatcaataagaagggtgcgatgggtacgctaaaagcccagacctcacaactgcacaatatatacacgtcttctgcacttgtacccactaaccctataatttaaaaaaataataataaaaaatagcaagagtgacaccttctgaggttggacaggtagctgctgggcagatgtacttacagaagtaagttttatgcaaagtcttgatggtctctgtgcaaagttgtggttttagcggtcttttttgttatcaggcatgcaagcatgagaaccctctcttcgtgaccttccctagctgtatttgtttgggttttcataacatttatgccttcatttttattctgataactttcacagtacatagaaaatcctaagaaaactacaaacatatgctgctagaagcaagaagtaaacttagcaaggtcacaatatacaaaattaaagtttatgtctgtatactaaaaactagcaaataatattttaaaaaataacatcaaagaacatgaaatactcaagaataattttaataaaatacatgtaaaatttaggagatttttaagcagacttaaataaatgaaagaaaaattttgaaaaggagaaaaaaaatttgaggacttactctgatttcaaaaactttcatctacaataatcaaagtcatgtggtattggcatattggcataagaatagacagatcagtggaatagaataggtctatgcgtatatggtcacttaattttttacaaaagtacaaggttattcaacgggaaaaggatagtctttacaacaaatagtgttaaaacagatatccttaaggggaaaaaaatgaaccttagcccttatctcataccctgcacaaaaattaactcaaaatggatcataaacctaaatgtaaaatcttaaactatgataattatagaagaaaatataggagaaaaatcttttgacctcaggttaggtaaagatttcttagattactaaaggaactaaccatttaaagaaattgataagttggacatcatcgtaagtaaaatttccactctttggaagatatcattaagaaaatgaaaggcaagccacagaggagaaaatacaatacatacgtctgacaaaggacttgtaactctcacaactcaattaaaaggagactaacaagaaaaaatgagcaaaatattttaacaaacatttcacaaacaagatacaccaatccccagtaagtacatgaaaaggtgcttgagatcattagtcatcattgaaatacaaattaaggctaggtgtggtggctcccaacactttgggaggccaaggccagcagatcacttgaggtcaggagtttgagaccagcctggccaacatggtgaaacccccatctctacaaaaaatacaaaaattagccaggcgtggtggcacgcacctgtagtcccagctactcaggaggctgaggcacgggaattacttgaacctgggaagtgaaggctgcagtaagccgagatttcgccactgcactccagcgtgggtgacagagcaagactccatcccaaaaaaaatgaaaaaaagaaaaagaaatacaaattaaaaccaagacaagacattgctaacattcactaaaatgtccaaaacaaacaaactatgcaataatgtggatgaattcccaaatcattatgctgagcaaaagaagccagacacaagagatcacactgtatgattcctttcaggcaaaagtataggaaaggcaagcctaatcaatagtgacaggaatcaaaccaatggttgcccgagacgggggtgggaaggaatggactgaaaaggaccatgagtgaatttttaggagtgatggaaatgttctgtgtcttattgctgtagtagtcacacaggtgtgttcattcgccaaaacttgtcaaatatacacttagaatgagtattttctattctattcaaattttgcataaaaagaagcagctattttgttgttcatgatagaagcaatattagcacttactgttctctagctctttcccaaggttttgcagcactatgaattcctttagtcactcagagaattaggaaattagcatgggttgttttgatctgattgggcatcacaataggaactgacctttctgtcttctgagctctaactttggatctcatgttttgctcctggtgtgtaagtcctagctctcctatttgggcctccttaagggtgggtgcttggtgcaactgtcatagtcctttgcttaaaactttctccttggccaggcacagtggctcaagcctgtaatcccagcactttgggaggccaaggcaggtggatcacctgaggttaggagttcaagaccagcctggccaactcggtgaaacctcgtttctactaaaaatacaaaaattagccaggtgtggtagcaggcacctgtaatcccagctactcaggaggctgaggcaggagaatcgcttgaacctgggaggtggaggttgcagtgagccgagatggtgccgttgcactccagcctgggcaacagagcgaaactctgtctcaaaaaaacaaacaaacaaacagaaaaaactttctcctcagcttattttacgaacatagttgtaagttgaatgaatgcacgcctggagagcaattgggatgcactactgtggaaagtagaggtattcagaaaaggctcaacagccatatattagggatattatgaagtgatttaaacattagatgatggttggactagagaagttctttcccagtcctgattatgtgaaaagaaagcttccaagggcaggagacatttctccacagggggaagtgagtctaaatattaggagggtcagtagccattctgacaacctacccaccatagacagagtgggattcacccctaaaccagcagagtggttagatgtctgtcaccaggcatgtgggtctgaatcagaagaaagagaaggatatcattttggaaatttacaagtgagacatgaaatctaatagaagggatttcaaaaagcacagattcatatgagaagttccctggaaagaaaagatgggtgctgatgtgggcaggggccatctgaggatggcagcttcacagaattgccctctcactccactctggggccaggactccccactcctgtagtcttctccctaagatgagtaaatatgaattcagcaccaagtaaaacggcctacacatcctctcaccagactcttttgcttataatcatcattattaccttaaagccaaagtttactcatctgtaaaatgaggataataataattatagaatcattgtgaggctttgataagataatgcctgtaagtgtttagtacaggctcatagaaagtacttagtaaatcctggctatgattgtggttatgattttgttacttgtttcatcattaaaccatgtatcatttactccggaaacaaaaagtaggaatgctatttcccaatctctgtaccacgctcacagcgaaacagcctgtgccatccactaacatacccataaacaatctccactgcattacaatcaggaacttagggaaaatgaggcttttttcttgttaagctttatctgcagaatctcaagtagtttttagctgtgctcttttatattccagtcaacctcatttccacagatgtactcccctagattgaaagttccgtgagagcaggcatctggtaaattatgcccaccactctttccccagggcctagcaaggtacttggcacttagtgggagctcagtagatataagatgaatgaatatggtgccctttccaaaatccttctacgcaagtcctgctgcactagtcgctgccctgctatggatgcaaaaatgagtgaaaggttgatacattgtaaacgtaactgtgatcattctgagtagtcatttaacctctttacagcagctggatgattatttctcagctatacgaaattattaaataagaaataattcatgcttcatgttccatgtcctccatcatgaggcctttttaccagtttaattagttagtaaaggacagcacgctttcctctccaccttttatcaagaattctaaaggctttagagaaaaaatgactcaggaggtgaaacagcaggactcctggtgttatttataaactcgtccctggcatctgcagcagcaaatctcaagcatcgtttaccttgccccgtaattctggagtttgagtataaatgatgaaacagctaatggcatgttacccgacaaagtagcattagcttcctctatcatcgtcagctgttttttttttttttttttttttccacaaaaatgtgtaaattgcagtttatctcaccagagaagcatttgatcaaatgtactttaattatattttgtgtggctactgagaataatcactgtttcttcatcataaggattgtcctaaaaaattatattaacgtgggtcaaccataaacagcagtgggaatttagctacctttaaatgctaaatttacctctcagcttgtagatttcctacaaatgaatttctttgggtcaagattttttcatgagcattggcaattagtggatattccttgaaccaaccttttactttaagtgaaatgtatttgcattaagagcatattcatttcccaggctgcttcttaacacatttgtttccctttgttttggaattcacaaagcttttcatggtttgcctattcattccctcactgcataatgatttatagtaggttatattttagaaggttttgtgtcaaaaaaaaaaatttgcatctcttcatcaggtagtcagttaaagaggctgcgttgagctgccaaatgggacgctgccaggtgaccaagaaagaaaagcctacttgcataaataaaacgaaagcatattagaacatttagctaacattcacccaatttttcatagttggcaacttctaactttgtttcatcttcaaggattatggtttgaagcaagggtaattcgccttgtgtcttccttttagttcttccctcagaacctggtttgggaaaaacctcactaatattttgtagcatcagccaagtagttgtcatcttttttgtaaccaactgccttatacaaaagcatagacacacttattttggataaatccatactgtctgacacataagcaaatatggaaaatataaaggaatccaaaggctctcacacagatcaattttcttcattggccagagctgcctctaaagaaattcacatgacaccgtcttcatttttctgaacatgatacatattattcattagcatttaagcttatatctaatgcacatttttagataggattttttagtagtaagacttttttatatgtctacctattattatccatggtagagtttcttgtgaccttgaccctgtgatatctggaaatgaaaaaagcccattttgtttcagactcttggtccctctagctataattctacttctgacagtggcccccagaggcattttgtggagggctgctgccactttgacatcacccctaaaattgttgggcacaccctctctaaaataattttatttctcattatagcttaatcactatgaatttctactagagtcatttaaaagaacaattttagcctgccctacttgttgggaagaataggggaaattaacagcatcttgtaactggaaggacccttataggttcctaagactgattccaattccaaacaataataccagtccgtaagtggatctgcttatagagaaacacctgttgcttctgttttttgtctcatatccagttagtttcccattcacagcaaaacattcccttcaatgccaaggaaactcaacctttttgattattagtatagtttcatcaaagtttctttgaaaggtaaaatatcccctttttcttgcctataatttttaaacctttttaaaggttgtaaagaattagttagtcaaggcttcttctcataaagccagggtttcttttttcctagactctatgtgcttaagtgctctatgataaaatgtggatgttataaactcatcagcttggccatgtggaagtgaaaaccactggtcagaggtgtgtggattctcccttgtgacctatctcatattactgtgaaccagctggcccccaataccataagcattaacaatggctgacaaaattgggactccagctccattgtgtcacctgggcatctgtgcagcactcctgccaaacagtcctgctaaactattccgatttcagatgggaatttggtcagaaacagcattttcttgtaatacttcccacttttctaattcccttgtttctggttgccaaaagaatgggaggtagacaggaagaggtggggaaaaatgtttaagttcaaatgtcatctctgctaaaacctgacttccactgcactgtggctttgtaacctccttgtgtttgtagccagctatcaaaaatctgtccatttgaacatgattatactaaagcatgattattttaaagctttcattataaactctacactggaaataatctttagggtgttttcaggtttgaaaacccatatgcactgaatgttctcatggtgtgctctgtcagaaacaatttttaatgatgtttcctcagtgagcatcattccctagatgtggacagagctgcagaaaggcatttacaaggagtcatgctggctcagatgggtgaagagggaactttattgacgtcagaccatgaaaagagagtgggcaataaattctgtatagacaaaggtgaacacaataaactgagactgacatataaacacgagtacaattcaaaatacagtggtaaggaggtgtggatgtttctttatagctgtatatgtttttgacacacccgcacacacagaaaattataaagtcaaagataatgaacctagagtcatgtggaaggtgtgaggtgggtcaagggagaaatagaggttattaaggagtataggtaggtattgaagaagagcctcattttatacacatacagacacatgcacacatatatacctatatatactctctctccatatatacatatatttatatttatgcacatgtaaatacatatatgtaatttatatttattttcccccaatactcctcatacctagagaccatgaactacatacagagggaaggcacactttctacctgaaggccagcccttatattggtgatcagtttgttcagtgctcttaatcattagagtaattgtgtataaaatcatgaatggggactttgtgagtcacttaacatttgcaagaagcatatgaacgtgattgttcttttagagtttgttaggtgggtggtggtaaagtaatacaattttctaaatggtaaaatcatgaatctcatgcatgtcaaaaaatttattcaattcattaattaatgagaatatcagtaagatgttacaccattttaaagagcatttgagaaaccaagtctgtgcaacttaataaatatatattaggataaaattgctgggttagataaaaactggttaatgtcttagaagccaataaactgtaacatttgagatatctgttctatgggacaaaattcattttcatctcttttagacatctttaagttgacatgtaacttcactaaatctgggacctttaatcaacagtaagcagtgagtcaaaataagtacattctaataaataatctttgggtggacttggcccctgaatgacattgaaagaatgtactgcctacctttttgctttatttttaagtcatgaataatttttataagagtggtgaaaggtataagaacatactgagttctacataatagtgtttggatctcaacttgtatactgctatatgttcacatggttttggtaaggagaactgacttgtcattctccaaggcagaagctgagagtagaactcccagaaagtgggatttacttaccataagttgctgtagaaaaggaggatggagtcaatctttatttctgcttttgtcccactacatgttaagaattttttcatttacccattcagtgattcaacaaatatctgttaagcatccactaagtgccaggcattgaggattggggtgaaaaagcccctgctcttaaggagcttacattctagcagaaaagacagacaacaataataaaaccatgataatattgtttcaactggtagatagtgctatgaaaaagaaaaagaagcagcagcatgaaggtaagggagataatgagtgaccacatggaggggtggactttagactgaacgatcagggagtcccaggaggactggcaggcctgcagagtgtggcccggccacagcgatgggcttggtgtcaggtagggctgccattcatcttctgcccactgtatgaatgtaattcaagtctttactctatttcatggtccaggatacctccgacccaagtttccatctctttgtcataaagtagaataggggtgggagatcagagctgcaaatgaagcaagtcatgcaaatggtttcccactggagaaaaggcacattttttcccgagatagggcagtgaagaaggtacagagcatggatttcagatcagagacacctgggtttgaattctatttctaccacttactactgtatgacatcagacaagttactaaaatctattttccatctgttaaagacacatgaagatctctccctcatagggccaattcaatgaaatcatctccagaaagccctcagtacacagaaagcactcaacaagcagtgactattattcttgtaattcccctatttggggagtctgtagcatcatcttcatgtagtactgattaactagtcttagttattgctgccacacagttttaccaccttacagagatgactcattatcacacagttcagatactgtgggacctgcaagtccaccagaggtgttggtgttgacctaaactatttggtcaaaattatgcccatagccaagccaaggtttccaaagagatagaaggtacatgggcttagtggcgcacctaaaactttttagcccaagtttggagattcttgggtagcttgagagttagaaactaaaagtagaatacttttaatggatttgtgattgaggattttttttgtttttactttctggtcctgtcctgtcctttgttttcctttcattttttccccctcttatgagttgagttgctttctcttctagggagctatgtgttaggaagctgctaatgaactgcttttgagtctaattttcaataagatttaatacagtagggattaaactgcccccttgaaaagagagattaagtgtctgcaaatcccatgaattgattttctaattgttttggtaataatgtgtatgtgtttttcatttgctaatgttgctgaaaataataataattttaattaaattttaaatgtatttttagtattttaaggattctagagggactaagttttcttgcaaggaatatgttaagaccataacattcttccctcaccccataattattatgatcagggaatatctataatatattccatggcaattaaattgcataccccagactgttcaagatgtgtttataaaaggagaaatggatttcccacagctgctcgcctgtgaatgcatccttcacacagaaccacagtagccagtatatgcactaaaataacagacttgaatttaaactttcagtgctttcaaacgtctttcaaaaacttctcataacacaaattgcttaatttgtgtacatgaaaactcactgattacatatgaatgagagtcaacctataataatggtgactttgagaatctttgtgtatgtgcccacccatctcttcaggaattagcaggtattcagtcttgttccaacattctgcacaagccacagtcattagtgagagcaccctgtgaaggctgaaatctgctgtgaacagtatggggcagctcaggtattttttataatattcatcagatggtcttcacccagtcacgtagctggaaaatgttttctgtgagatgagtgtttacaaaaaaaaaagattcatagagaaggagcaagggaaggaggaagagggaaaataatccaaaccagggtcaaggcagtcatatagactagaatcacagaccaggtgttccgtctttaaaaagcgatcgtcacaactttgatttattaaattggaatttaaatcttccaagctgtaatgaattgatcatgatactgttgatatagattggctcatctttgtggctgtataacaactataataaagaattaattgagtacctattaatcctcacaagcatcttggaagttggatatcattagccctgtttgctgattgaggaaactaaagttgaatggctttacatcattctttcaaagtcacccaggttttaagcagaagaatttgaatttgaacccagccctacctgcctctaaaccccatattctctcagctgtatctccctcctaggtgcaatggctccttggctgacatgctgaaggatatgtcttcacattcttaaactccaaacctcccttggaaataatttcctaacagtgaaactgccctaataatgccgtagtttgtttccaggggagaatatttgccttcagagcaggctccttctgccagctttccatttcataaatgcattttatgactccctcttcagagctcatatacctgtcagaagatcctatgcaatttatccctggggatagttaacattccccctgacccacccaccctgcaatgtcaggtgctctcagaaatggaagtgcaggatctccctcagtgcccatcttttagatcagtagctgtcactgataaaatgtctccttggaactacagagacaaagttgcaagccagccagcgggcccaccctggtatctcctgcagttatcagcattctcactagtgattgatagaacacgttttggagttgttttagttttgtagaatgttcatgggaacttagatgatatctgaggaaatgccttcttcaagtcactagttctaaaggaaggcagccaaattccttcagtctgagaattttggagctctgaagagggcatggacaaatatttcttgcctctcttttttaaatatggaatttggaggctttgtctgtcgaccaccatgccgtgtctttaagaagctctgactgggaaggaaacagccccaagtgttccaagctctgtctgctggaattaaatgtcccttcctgtttcctgacatccacaattctaattcatcctccattcaccctcagtgacttctgttctttgaaggttttgactctgtccttgtacatgaatttgacattcacctgatactctgtggggtccagagagcatgtactccccaccagcttcaactaactctaaaatgtcacagtttctgttaaagtgctttctagctactaccagagtaaacatacagatttgtctcccctgggtgtgctgtgagttcatggcataaagtattttctggttttaaaatggacttctggcctgtaatcccagcactttgggaggccgaggcgggcggatcatgaggtcaggaaatcgagaccatcgtggttaacacggtgaaactccttctctactaaaaatacaaaaaattagctgggcgtggtggcaggcgcctgtagtcccgggaggcggagcttgcagtgagccaagttcacgccactgcactccagcctgggcgaagagcaagactccgtctcaaaaaaaaaaaaggacttctggcttttctactgggaaatgtggttatctgtgccttctggaggtcaagatgtcatcatctggccctggtccctctcacttctcctcagactggacctcttctccagctgtttactcaccttcgtagttgttcacacaatttctccttcatgttttttggagcatctccctaaggtgcatctctagtcaccccaccttctcattcatcctcccaaccaccatggctccacatttatgaactacattcagtctattttcagcctgacatttaggaccttccacaggtagttgccaactttatctgccaataattagcccaagttaccccccagtgtcaaccaaactggaacgctcacatgttctgttcatctggaatacctgtgcctatatctgtctgttgacatcctaagtactccaccccagagcaaggggtttatgggagtagataggggaaaactctggtacaaagttgtaagaacgtgggttgggcttggagaaaatctagatggcatcctggggcaatggagggctcaagaacaatggcaatgtccagtccacaagacaggaggtaggggatttgaagagggaaatcctagcaatgtggttaccagaaacacatagaaacatacctccccttccctaaaatagttattggatataataataattgccttttaataatacatgacttagcaagaggcaaaataagggaattcctcagaggtgagaaataatagaaataatgaaaatctatagaagtaagaaaaccctggggcctggcatttgtctgctaatccctgtttgcctagagcatgggttttaatgagcagtgggtgcatctaggacaagtacaaaacttggggccactagtgtactttataagatattgattaactttagacttattaagatgaatatgtaacctataatttccaaggtctccactgacagaattgaaataaagcatgtagcttccaaactatagagttggagggaaaaggaatgagagaagggaaaaaaatcaacccaaaagaaggcaagaaagaaagaaaaaaaagaaacctagaaaacataataaacagatagaagcaaaaaaattcaactctaaactattcataagagaaactcctaaaagtatgagatagagaaaggctgccagtaaaacgatgggaaaggacataccagggtaatactctgcaaaaagaactaggtgtgcctatcttaattattaggaaaaactggacttccagaacaaaaagcaacattacagatgagttttcaatttaccagggatacataattttaaatttgtatacccctaacagcataactttgaaatatattttaaaaaattactggaactacggaatattcaaaatcacaaagggacattttcacacatctcacagagggacattttcacacatctctctcaaaattgatgggtcaaatagacaataaatcagtaaggagttaaaaggtttgaagaacacaattaagaagcttgatctaatggacttacacagagcactgaaagcacattctcttcaaatacacatggaatatttacaaaaatgcatcacatactaggccatagagcaaacatcaacaaaattcaaagaatctatatcatacagccaacattctctaacagttaaattagaaatcaataatgaaaaaaataactcagaaaacttcatacttttgaaaattaaaaaaatgcattctaactcatgagtcaaggaaaaagtaaaactagaaattaataaatatttagaactgaattgtcatgaaactactaatgggaactggtgagatacagctaaagcagtattgagggaagattatagccttactgcttatgctagagacaaagtacgtctgcagagtaataaactgagtgtttaactccaaaaattagaaaaagaaaagcaaataaatccaaagaaaggaggagtaaaataatataagcataatataaacttaggagcagaaatcaatggaagaacaactactaaataatagaaagtatccaaaaaatgaaagtcatcattttttctttttcttcaaattattaataaaactgacaaactgcaagcaagatttaaaaaaaaaacagagaagacactgataatcaacatcaagaatgaaaaagagggcatcactatagatgctgcagacatcaactaaaattaaaaacaggatattactgacaacttcatgccaattattttgagcatttagacaaaactcacaaattcctagacaaatgtaatttccatagttaattcaagaataagtacaaaacctgaataagccaataaccatgaaagaaattgaatcattagttaaaattgttatcataaagaaaacatcagactttgatggctttgttaaaagttctacaaaataaccaggaaataaataattctaatcttacacaaactatcccagaatgtataaaaaaaagaaggaaaaccatgttatgcatcagatacatccttgatactaaaactggagagccacaaacagaaaatgtaggtttttcaaaatgaaaatttacaatagcaacaaaatatataagccatcaaagaaagaaaatgaacaaaagggatgtaaaactgttataaaactttaaagacattaagaagacaaatagaaacatatataaacacaccattttcatggataagaacacaatattctaataaaaagatgttcggttccccccaatttaaaatagatattaccacaattctgatcaaaatccaaaaatacttttggagtatatttaaatgattctaaaatttatctgaaagagcaaatggttctgaataatcaaaacactcctgaagaagaaggaagagaaagtgagggaatttgccctaacagatatcaaggattctaaagtaatagcaattaagatagtgtggcattgttgcagagatagacaaatagatcactgaaacaattagaaagccccaaaataaacatataaggaaacttaatatggcacaatccgtaccgcagatcagtggagaaagaggatgtactactaatgaataaatgtttctaggcaatggaaaactgaaaatagaatcctacctcacacccaacacaaaaatcatttcctattctggatgggtagagaacttaaaaatgaaaataaaatatttttaaaatttagaatagaatttcagagaatatctttgtaatattagggtaaggaaggacttcttaagacataaacagtatggatcttacaggaaaatattcataaatccaactacattgaaagtaaaaacacttattcatcaaaacacacactaaacagggtaaagagatgagccacaaactgggaaatgatatatacaaacttactaacagaagtgtctaaattatgccaagaactcttacaagtcaataagaaaaagacaaatccattgaaaaatgggcaaaatgcatgaacaagaacttcacaaaagagaaaacacacataaatgacaaaaaaatccacatgtaaaaacatacttaatctcacaattagtttcttttaaaactgaaaatgaaatgttagcatttcacactcaccaaatttacaaaaattagtttgacaatatcaagtgctgtagactatgtgaagcaagagaatgactcatatactaacagtgtaagtgtaaattgaaaaggaaaacattttggaattgcacggtaaaattgaacacacacatactctatagcccagcaaaccactcctacattcaaagccttgatagtgttggtagcagcacgtaatagaaaactggaaaccacctaaatgaccattgttggtaaaatggataaataaatacaaagaggtaatatactgcaataaaacatgaaaatactagagctatacacaacagcatagataaatcttatatatgtttgaatggaaaaagcaagctaaagaaatatatctggaggatatggttcaaaagtaggcaatattaaactgtatatctgtacacgtataattgttatatatagtcatatacatatatgtggtaaagtatgaagtggtaaaactgtagaaaagcaaggagtaattaagaggcaagacaggctagtgggtacctctggagggaggaaaagatctgcagtgggcaggggtgtcataaatgggtttccaagatactggtgatatcattcttgcattaaattatggacatatatgtacttattattttcaccctttataatatacatttatgttctgtacaatcttatgtgtgtatggtatatttcacaataaaacagtcaaccaaccaatcaatcaagctagctagaggctaaagaactgaaactagaatccataagatgggtctagtaggttttcaaggataaataagagacaatgaagtttccctgaggctatgatccatgactgaaactagcaaaaagcttcacacttgaatgagaagaaagctttgaagcagggcagagactcctgctggtgcccttggaggttgctggggatgttataactctaggaagtaaatggatgatttgagaaggaaaacttgaacaaaggggtattggctttcttttgtaaccaggaaggtacataatttgcaaacgtgcagatacaaagaagatactgtctttttataaatatgaggcatttgtctcagttacttatacaaataaaagtttattttcccttatatcacaggaaatccagaagaaggcagtgcagagcttgttgagagagttagcaatattttccaaatgtaggctacttccactctgccatttttagtttaggggctttttgccccatgcagctccaaagttctcatctgccttgaatgcagcattagggatattttcccaactctttgtcaacgaagttaaaggcttttctagaactcatccacagccggctactcacatcatagtcatctgaatggtgacacatggacatttcttgcagcaagagagcctggaaaagtaattattttgctattgcagactgtataataggagcaggcaaaagtgaagggggagaggtgtgtattcagcagtgtctgtcaaaatactccactaagaattcttcctcttttatccccaggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaatttttggaaga

SEQ ID NO: 1614 - DNA, 13559 bp, Homo sapiens
cctggctaattttttgtatttttggtagagacagggtttcacgacgttggccaggctggtctcaaactcctgatctcaagtgatccgcctgcctctgtgtcccaaattgctgggattacaggcatgagccaccgcaccggccatgctttcagttttcaagaaagaagacaccattattgccaaagattttggtaatttgagagatacaatgtatgttttctccatgtggatactagatagtaaggatgtgttgaatttgaagtgtctatccagaagtattttgggtacttgtttaaggattgtaaaacaatgtttccatttctggatataataaatgtatttgttaatataataaatgaatagattagacccataaactatttgcagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggcaggtggtactgagtctaagcactggatgaagaagatagtagaaaacagtctggatgctggtgccactaatgttggtaagtttgggagagttttaagccacaagaaatgatcagtgaatgttgttgtagtcaagaaacatttgttattgaaataagactatcaagtgttgatgtagtaataagttattatttttaagttaaagttagcacctattatgtgcctagtacttagctaggtagtaataataataacgacagcttttcttgtgttcttatggtgtgccaggcaggtgttatgctaagaattgcacagaaatatttaatttgcagaatagctgggcgtggtgtctgacgcctgtaatcctagccctttgagaggctgaggtggggggattgcttgaagccaagagttcaagaccaacctggccaacatggggagacctcgtctctattaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagattgtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaatgtggtaaaaccctgtctctactaaaaatacaaaaattagccagatgtgatggtgcatggttgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgtttttttttcttttttttttttttttgagatagagttttgctcttgttgccgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattataaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgataaaatatttttatccattcacttgaccccttagaaaaacctctctgaaaattaattggaatcattattatttacaattttctatctcaatatctcagcttctagcttctgaattctgttttgtctcacagccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattatagcacagatactaaatttttataaataattacatgcacacacacatatatacatatatatacatatatatacatatatatacatatatgtatacatatatatacatatatgtatacatatatatacatatatacatatatacatatatatacatatatacatatatatatacacacacacatatatatatatatatatatatttttttttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattataatatcttttggattctttaaaaaaatttttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcagagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacacgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaattgactgggcatggtggcatgcacctgtagttccagctacttgggaggctgaagtgggaggatcacctgagcccaggaacttgagactgcagtgagctatgattgcgtcaccacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtctcgaattcctgccctcaggtgatccgcccacctcggcctctcaaagtgctgggattacaggcgtgagccaccatgcctgaccttatgtacttatatttttatgagaatatttctcttggttttctgataaatgagttactggcacccttatgaatttgaatgcaaatgaaacagctaaatgttatataattgtcgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctggggttacaggcgtgagccaccacgcctggcttttttttttaaagcttttttgtaagtcagccagcaagaacacaggaggaagtactcaaatctcccttacacagctgggggctatgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatgcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacggaacagtggccacgaggggccccaacagaggaagaaaccaggtgaggtgtggtatagtggactcgactgccttctaaatctcagtggttgtccgggtgcggtggctcacacctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtcaaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggtggcagtgagctgagatctcgccattgcactccagcctgggcaacaagagcgaaacttcatctcaaaaaataaaaaaagaagtctgggtgtggtggctcgtgcctgtaatcccaggactttgggaggccaagatgggtggatcacgaggtcaggagttcaagaccagcctggcctagatggtgaaaccctgtctcgagtaaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgtgtcaatgccgatatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatacagattttcccagctgtctgtgctgaagtccctgtggggaggctcctggctggtttcctgtaggtagacagctacacgtcctgcccttcattggcttcttttcatgaagctcctgccatctacaaaacatgtctcccttcttgaatcacatctctgttattgaaactctagaagtcgaccgggcatggtggctatgcctataatcccagcattttgggatgccaaagcgggtggatcacctgaggtcaggagttcaagaccagcctggccaacatggcgaaatcccgtctctaatacaaatacaaaaattagccaagcatggtggccactgtactccagcctgggcgacagagcaagactccgtctcaaaaaaaaaaaaaaaaaaaaaaaaaaagagaaagaaagtatcatgcttttctgcattctgtgaattgttttagtgagttatcgaacttcagggcatggtgggaacctccaaatttgcagccagttggtgagaagtacatgtggtctgaggacacccaagcctgcaggtgtgtctaaagcgagggcagcctagtgggggctggtggccttaacctgtggcatttgaggtaacatcagggagttgacatcagaattgcatcacataggctgggcgcagtggctcacgcctgtaatcctagcactttgggaggccaaggcggagagatcacgaggtcaggagatcgagaccatcctggctaacacagtgaaaccccgtctctactaaaaatacaaaaaattagccaggcatggtggcgggcgcctgtagtcccagctactcgggaggctgaggcaggagaatggcgtgaacccaggaggcggagcttgcattgagccaagatcacgccaccgcactccagcctgggtgacagagcgagactccatcccccccccaaaaaaaaaaaagacaaaaaacagaattgtgtcacacaggccagatgcagtggctcatgcttataatcccagcaatttgaaaggcaaggtaagaggatcgcttgagcttgagcttgagcctgaggccgcagtgagctatgaccacaccactgcaccccagtctgggtgacagcgcaagaccccaattccaaaaagaaaaaagaaaaatcacaaagaatttcatggcagagtgcctgtctttcacagctttaactgctgcaggaactttctttttttttttttttttttttttgagagggcgtgaggagacacaatctctgctagtgattctcctgcctcagcctcccaaatagctgggattataggcatgcaccaccacgtctgcctaatttttgtatttttagtagagacagggtttcaccatgttggccaggctggtctcaaactcctgctgggatcatgggcgtgagccaccacgcccggccacctttagagttttcttaccacctggttttcctctctcaatatctttctctcatttcctgccttaaaactctagcttggcatctgggcgcagtagctcatgcctgttaatcccagcactttgggaggccgaggtgggtggatcacttgaagtcaggagttcgagaccagcctggccaacatggtgaaaccttgtctctactatttttacaaaagttggtcggacgtacagacgggtgcctgtagtcccagctgcttgggagactgaggcaggagaatttgtttgaacccagaggtgaaagttgcagggagccgaggttgtgccactgcactccagcctgggagacagagcaagactgtctccaaaacaaacaaacaaaaaaaccctgtagcttgagccttctcttctattgtttttctttaaaaaataaaaattaaaaatagatgtagatgctatgttgctgaggccggcctcaaactcctggcctcaggtgatcctcctgccaagacctccaaaactgcagggattgtaggtgtgagcactgcacccagccgtatgttttttttctacataaaaaacagcacaggattatcttccagagctaataaatatgttcaaataaccacaaccccattaaggaaaaatatcactgggcagcaaataatcaatccagaccaatatgatcacagttgctgtgaaggtgagaaaagttcatttttattatgtttccacaagagacgcactctattgttctcttgaaaacacacagctcatgtcctcctttagaacacacatcctctttaaagtaacatacaaagatgccaaaacaaggtaaaaaattacatctgaattctcacatttcaaacatatatgaaatatcaaataaaaatttatttttacaagaatttaggggaactactacatagctataaatgtaatatatatgttaactaagtatcacagataaaaaccatgctcccttcagcagcacgtgtaataatagatacaaagattgaaaggtaaaagatttaggatgaaaagaatcctctcttaaaaaggaaaacaaaattatatgtatgtgtatataatagttataacacccatcacacagctttatagaaacagcatctattcaaaaataccagtatttccaaaatatttaaaataatatttaaagtaataataatatttaaataaataaatatatttaataaatatttcaataaataaaataatacttaaataattctatacccatgtttttcaaaataaaccaataaattagatagtatgtattagacgtgttagtatatatatctgagacatgttaaaaatcacaactgaattctcacaattcagtcacaaacctaaacagcaaataaaaatttctatcaccagaattatgtttttttctggtggggaactaccaatagctataaatagaagagatttttatggaagtatcatagataaaaagagtgctcgcttcaggagcacatataataatacagaaacaaatttaaagataataaaatatttaggataaaaagaattgtctcttaaaaatgaaaagaaaattatctttatgtatatataacaactataactctcatcaaaaaactacaggaacagcatgttttcaaaagtacaacaatttccaaactatttgaaataaatctatgaataattcaatggccaacatttccaaacaaaccaataaaatgcagagtgtgcatgaagctatctgttacaatctgtggcactgatatttcacaaaagaattctgtgccaatctgagcccctgcattgtgccttcaaatgctcctggactgtggcaaccaagtctgtaagaaacaggacctccaggttccggcccagggaggttggaattcagcaatatagaaagggtggtggtgccgcaggaaagggtggaactggaaacactcctgttttcttacttttctccaaggactcctagaaggaccccacccccctccccccacccctgctcccaggaggacaacgtgatcactgtattcagctccatcaagaatggtccaggttcttctagatgatctgcacaaatggttcctctcctctttcctgttgtctgccattagcattggaataaagttcctgctgaaaatccacatctcccctgggtccggtgttctggaagtgagagagacaatgtcacacttgaaggaggcagctctctagacaggaaggttattcacgtcccatgtcaagtctagagttcagagcaattgagaaatgcaattttatctgctgcctttcattctataccctgcttctgaaccatcgtgttcaactgtgaaactcacactttggtgaccacaactccaaaactcacttaatacacccaaggtcagccccagtgatctgcttcatagcaaggactttgggtgggtctgcccagggagtagggcaccctcagagaatgtggctttggacttcatcatagctggggccttttgtgtcacttaagatctaaacttgtaaccatgctagatgtgtttctaatgtgacaacatcacgaaccacgagtccagaagcctaatccttaatcctacctcctcatgatgaagtctcatgctctgtgctcaccgtggttagctgcacaagatgtaaaccaaagcttcactgaaccctcgacccaaatcggtaactcaagtgcgtcaatcataatgaacctccccaaactcagtatttatgattatttttgaggcagggtctcactctgtcgcccagactggagtgcagtggcaggatcagggctccgtgcagccctgaccttccaggctccagcgatcctcccgcctcagcctcctgagtagttgggagtagagatgcgtcccacatcgcctggctaatttttgtatttttgtggagaggggatctcgccacgttgcccaggcttgaagccggatcaagcaattgggttcctcggatttccaaaatagaccccaatattctgcctttaccccggaggatgcagatgtaccttctctcaggccgatgacctcaggcctccacggtccctggagctctaggaaaggcgagcgcgatctcgcgcccacacccagtgctctgggtcataagcctggatctggaaaaacaaacgccctttgagaagacggggactcgccaggatacccctctctcccctcatccagcctccagcccacccgattcctccccacctcctccacctccccaggccccactcacctcctccaactcctcccgggaaacccaagccctgccgctcatggaacagaagaactggaaccgaagtttctggaacagg

SEQ ID NO: 1615 - DNA, 9583 bp, Homo sapiens
ctctttcccctcttgcccctctccagcttttctggtccaaccctcttctgcgcctaacactggcacctccttttcttccggctgatgaataattgtccgcaaaccagcctctctggggcactgaggggcgggaaggttagaaggagccagggctagagtcctggaaggtggcagtcaggtcgcagggccacagcagtcactctgcgactctctcttccggtgtttctccagcgccaagcgggagaagacggagcctgggagctgggactggaggagcgggaagcgcagtatcgggaccacggctctgggaccaggaaaaacgcagactctccagagtcaatgtctacttcagccagctcaagggcgcgacaacctggcgccgagcatctcaggccgccgcggggaccccccctaagggactcgggaacacctgcctaccctagaagaggcggagaataaccccgtagggagttaagcggcctctgcctacagcgttcctcccgcctccacggcgccgagccctgattgacgttcagccaggccaatcatagcctgtgtctgaggcgcgcggagctggagcgcccagggcatgtccgccgatcccaaggaggcaatctgtcaggcgccgcccgggcggcagtatgcctgagggggtcctccgtgttcgcgcctcccgccgcctgcactgaaaggtctgtacctgagcctggatacttgaacagaggcagacactgcggctcaaaaccccaagggtaggtacctattgtgcggagtctcggaacgcctgcctggaagaagagttccggcggctccccgaacgcttggagaaagcgcttggatgcagttgcagggtgagatttgagacggtgattgtgttttccagcaggcgctcaggcggggtggtgaaggagggatacagacctctaaagattcctctctcgttggggtgaggtggggaacagcagtgacagtagttctcatccctgagcctcctccgggccggcccgtggaggagagagaaggggagggagaagggtttgcccaggccttcagacactttactttgtgggagatgtatgtgctgagtgtccctgctctggagggattgttaaagaatccaggttcttggggagtgtctcaggagaacactccaggtgatatccttattcttcctattttcaccgtgttggtttttttttggatataacttgttccctttaacccgaggtggccttggtgtctggcagctgttttctctgccaggcaccaccctctgggcctcacgtcttcatccctcaagtccgctgcctctgagctgctacttagatctggtctgtttctacctctgctggaccagaagtttgcattaacgcccccaccccatcctgcaagaccggcgcttccaaccaagggctctctcctctgaacctagaacctgcttggaaatcgagtatttcctctatgcccaggtggagattgatgtttgggtttcacatctcccaactctgttgggtactatgtcgtttctcagcttggttgtatgtgcctccattgagtggaccgtatctccagaatttctcctaaccctcccagtgtactcccctgcaatcctttctttttttctccaaatcccccaccccccaccagaaatgactttacccctgtgccacttattttggcctggagcactaaggagccatactacacccaatgccagaggtggaacagaaatgaggtttgaaatgggaaccagaagctaatctgtgggaaattcttttactcctcagacgtgtaaagatgtgttggagactctcgtaaatatgtattcagtaatgcagcatatacagtgatcaccatgtattcattttttatgggaatcaacaattcagaatgatcaaaaatccctgtgtgtagagacatgaatctataggaatatcacacatagtgagcacaactgtgagtgaaatcccatgtttcatgcatcccagcagtcccaaagggagcctccaaatgtgtacgggattcagactccatgtaacctgcatctgtctatgcactagctatgtgagctgttacctcagtcttgatgaggttactcaggaagtctgggatcttgatttttgccggtcactgatcacctggctacaggaaaggagacctaaatccagaacttaaatttatgaacaccaggtctgtaggcactagacctcagaagtaggtgagtaggtggctattggttggtcccttctggagtgaggcagagatacctatgccatatgcaacataaaaggttgcctgagcccctcagcctgaggtagagtaaggagggagaggtggagagggactttcttctcagaccagggaaatcagaagccatcagatgccttcagtagggaatccagcacaaagaggatcataagtcatctccccacttctctatagtcatcatagacgtaattgctaacctacccttccttggtgctctggttagtagagtgaagttgagataatataaatgaaaaaactgagcagaaagggagtgaggatacggggcctcttcagtttgccttatgggcttcccactctaaatagatgaggtacacaacattctggcagtatcacactagggccagagttggtagctcacagatgtacgatagaggatggaaggagtatgcctctcaggcaggcaagtttagcctggtagacagaggatgtggcttaaaagtcactgcctacaagaccagtgcatgcaagtgagtccctgctgctgcttggatcagaggaggtgaggcagaaggctgatgaaaacccaccaactgatggtcagtccgagaagcagtcaagatggagaactgcaaaattaacagcttaagttttccaggagtctcagtgcccaatgtcaggtctaccagggatgtccagcccctctggtcagagccccaggagccttgtctgaatgtggatcccctctgcttattcaaagagacctgggaagctgagccaggaacctggataatgaccagaaagtcacccagacacctgagaaatgcctcccttatatccaagagatccctgtgtgtagaacacatgaatctattggaatatcacacacagtgagcagactcttcttacacttactaaactctcttcgtagatttactaaatttttcaccagtgactcaatggagcgaaaccaggtcccagactcgatttaaaaaaaaaaaccacacacacacacacacaaaaagttctttaggtgagcatgtatgcatgtgtaaatggtactatacaatggtatgattggatagtcaaaggaatatctaacccaagtgtacataaggagtaaatttggagtcagaggaagttggtcattgtaggaaagtaactgctgcaagaaagatttcttagaatgtaactgtctaatatgaggcatttatgcctcttttcctccatgtttctagtttctgccttgggtttggcatttattgtttatcctgcttcaagtataagactagtggtttattcgagggcccacaacttccacttctaccctggcgtcacacagatcattttctcttctcaagtcattgtattttcactggtagtaaaagaggataatatcttcatcttcaaataaattagtgggagggattcaaattatgagggaaaagaaaaattggttcttctgctgtagggaagggttactgaaaattaaaggacaacctactgagctgaagagagctttggggtttggtaatttggggtgtgaggtggatcttcaggaatgccatgggcttcaagactagtgtgtctctcccttagtatgttcctcctcagtttgaaaggacttcctggtaaaggactgaaagaaatgtccactccatcatgtctctgctgacacctagcttctcttctccagttataagtccattttcctactggggtaacacaagaaggaggaagaatagctcaggggtcttcccttcacatctctcctacaaggattgtgaaatgtcatatgcctcctcccatagacttagatagacctaaaattgtcaacatgtgtccagatagttgcaaaaaatatataatttccaacatattctccatattaacactttaaaataaaactgttaatcactcatatgttcaattcaatctaaatatcataatgttttgacacccattatcattaatttaaaaaatatacaaacaacctctttcttaatggttggaaattttacattgctcttttttcccactttgaattcatatttttattctaccccccatgtagaatttttctttttctttttttttttttttttgagttctcaaccctggttacatcctaatgtaatttttttctttgttcttggaaatcttttattgagccacctattctgcttctttgcaacaaaatatgttcttacattgaatttttaatttcttgttgtaagtgtaaaagttatatgggctgggtgcagtggcccacacctgtactcccagcactttgtgaggctgaagcaggaggattacttgagcccaggagttcaagaccagcctaggcacatagggaaacctcatctctacaaaaaaaaaaaaaattactggacatggtggctcctgcctgtagtctcagctacttgggaggctgaggtaggaggatcacttgagcccaggaggtcgaggctgcagtgagccatgatcgtgccactgcatgcactctaccctggatgacagagtaagatgctgtctcaaaaaaaagttatatggattaagataggattaccaactgttagagatcaaaataatgtcagtacagattggatatgccttatttgaaatgcttgggaccaaaagtgtgttggatttcagattatcttggattttaaaatatttgtatatacataatgagatatcttgaggccgggacccaagtctaagcatgaagttcacttatgtttcttatatacattatgcacatagcctgaaggtaattttataccatatttaaaataattttatatgtgaaatgaagttgtgttaagtacagtacttacatgtggcatcatattggtgctcaaaaagtttcagattttggagcatttcagattttctgatgagggatgctcaatctgtaatacacattttggtaaataaaagtgtaagtttgtaatggtaaaatttaactagaaatgcatctcttaatgagatggatagggactttattttcccaatttcatgttgacaaatgttacttattgttaatgaatctgggctgtatattatttcaattaaaaaattttaacatgaaagaactaaggaatcttgatcatataaatgaatgagaaaataaagacttgttgaggcaacttcacccaatttttaaaatttcttcttagtcgtatgcaaaactcacataatgggctattattaaataatatttttaataatctgtcagctgacaactcaagtataaggttcttcttcaattttgttgaaagcaaagaattagaaaccaattgacttgcaaaactatttttatacatacattaggttctttcactttgtttttagaactataccaaagacttcacaaagtcttataaaataactaataattatacctgctgctctttcccttagagataccttgttcatgaatctcaaattagataaaactagggttaaagaaaaacaaccccccacacacaaaattggagatcaaaaatcaataggttcttaaaaaatatctcttcattttttatgtcatctggaagtgccttttaaaactatgacacagagatggtgctgtatagtttacagttcatgtgtgtgtgtgtttaatttcattattgtacaaaattgttaattttataatcatgcatttgatagatgtaaaacagtgtgtcagcctccaagcgggagaaattaatccaaaataaatgaagctggatttctaaagtttagagcatcacatccaagattgcatttgggaacattctgttttgtatccatacacaaatgaatttctgtttttaagaacacaatttaatctacttagtggaaatcaacagcaaaatgaagagaaggtattagataattaataaatataggtttacagaaattctattactgactgctattatgtgcattaattacagcagaatccacaaaacatttccatcaaattaaatcttactctaggaggtatatgataaaaataaataaatgaacagagaaataacagcatactataaactgttacccaaatagaaaaatatatttacactatccagaaatctttggtaaaagttaatgaaaatatttcccctattagttagaagaagttcaagaaaacatacattaaaataccttcaatatgtgtttgttttactccaagatgtgatgttgatctgtgagaaattaattttgagcgttttgcctccactgccttgaaataatgcaaaataagcaactgagctgggggcagtggctcatccctataatcccagtgctttgggaggccaaggagggaggatcgctggagcctgggtgacagaataagactctctctctctctctgtgtatatatatatatatttgcaactgaagcacagatgggacacaggtaagtgggagaactcaccaagctctttgttagtatttagagtgtttcatagaaagttaatatttcttaacttttttttttttttttttttttttttacaaatttagaatatcctagctctgagacaaaaattgggaacctcagcatgagtttgtcacctgaatgaaataaaaaaaatcacgttgaaggctggtgcagtaacatgtgcctgtagtcccagctactctggaggctgagtcaggaggatcacttgagaccagaagttcaggaattcaagactggcttgagcaacatagcaagacttcatttcaaaacaaacagaaaaaagccaccaccttcagtatttcttgccaaagcaaaggagccatttgttctttacgatggtcaggaaaggaagcatcaaggtcatcaaatgaaaaattttcagcatttcagcctctctgctcagggaaatatctgaatctagaatatcacaacatgagccaaaaccgccccatttctcatgccacatgtcactcttaacacaaggttactcaacctcgagcatggttggcatttggggctgaataattcttttttgtagggggctgtcctgggcattgtaggatgctcatgagctacctcagtctctaccacccactagatgccagtagcattgacccctgatctctctacccaagttgtgacaactaaaaccatctctggataatggaggaaccttaaatgcatattgctaaggaaaagccaatctgaaaggattacatattgtatgagtccaactatatggtaatctggaaaaggcaaaaccatggagacagtgaaaaggtagtggttaccagtggtccatgggaagggttggatgaataggtggagcacagaggatttttaaggcagtgaaactattctgaatgatactgtaatggtggatacatgtcatacctttgtcaaaaccaataaaatataacaaccaataaaactgcacaaagagtgaaccctaatgtaaactatggacttaataatgtatcaatattggctcaccaattttaacaaatgtaccacactaatgcaagatgttactaatagtggaaactggagggaagagggcttgaggggacatacgggaactctctgtaattcctgttcagtttttctgtaactgttaaactgtccaaaaaaagtctgtttttataaatggaggcatggttttatatggactaaaatactatgattgcctttttattttacacatggtgaaattagagcaggacatattttaaactcaaaattcacaaaattaatttatgaaaatgtttacccagatcaagaatattaaagaaacttagattaatattgttaccttgaatttattttactgagtaatcctctaagactcctctacacattattaatctagaaggatttttaaagtctttatgacaattaattattggtctacagtcaaattgcgtatccccattaactagagttatatttttccattttctgatccaaaaactttaggaacaggaaatgtttattttagaaaacaagaacacttcttaagcatttgctgttaacagttattttcacatgtgcttgtacttattttacacttgtcagaacatagtatttacctttgaaccaaggttttataataagcaagcactttttttatttagaagtcacattttccaagtagaaaaatcattaaaaattcagtcctctgaaggctaatttctttaaatcatttaacctaattgtttaaggtatagattggaatttttctcagcactctcttgaaaacaggtgacagtggaaccctgttaggttcacaaatcctagactttgattatatagcccaggctcaaatttttctcgaatgttacgaacattcaaagcattaggagtcttggtttcatttcttaattttttttcttctgggtatatttgagactcatcttggattcaaataaattaataatagtctcatgaaaccgataaaaatgggagctccattgaacatgagagacattgattcgtagtttctaacatcctccaaatgaggagcccatccctaatttagatgcttctttcaaaggaggctcctttccttcgttatccataatatagtcacaccagtcctgaaaaaacatggaacagactccagatctttatatttcatactctaaagtcgtacaagccaatctgcatttcctctagtggaaactgtatagctggtcatctttccaggacccttttatcaagaaacaatgcagcttctacatttgtgctgcttctacaccaaaacagctggaatgtatatagtatggttctggatgctcttgtatacctcactcttcatttctcacctaacccatgtgctatgatttgaatgtttctcccctgcaaaactcatgttgaaatgtaattgccatgataacagtattaataggtggaatatttaagaggtgattagggtgggattggtgatgttataaaagggtaagttcagccccttcttgctctctctgtcacccttccaccttcctctgtgtgatgatgcaacaaaaaagcccttcccagatgccagcatcttgattttggacttctcagcctacagaactataagccaataaatttctgttatttgttattagtctgtgatattctgttacagtagcacaaaatggactatgacaccatgtgtttacacagaaagaaaaaaatatcatacggtaattgctcctaaatatgcagagaatatgttctgatatccttagtggatgcctgaaactgcagatagtaccaaaccttatatatactatgttttttttcccatacatatgcatgttaaagtttataagttaggcagagtaagatatgaacaataactaataatgaaatagaaacgtaacgatgtgctgtaataaaagttatgtgactgac

SEQ ID NO: 1616 - DNA, 9583 bp, Homo sapiens; identical to SEQ ID NO: 1615

SEQ ID NO: 1617 - DNA, 124810 bp, Homo sapiens
ggtggtatcatttttctctgattgttcttgatcttgatttttaggcagtgcattagtgtctgcacatttgaaaaacaagaaacttattctagttcttgcataccggctttatctggaaaaaccctttcctagtcatccagcaactctttgtagggtgtctagtgtggtctgcaggtgaacttgttgccaaagtcctcaggcaggctggcctggtgcctgtgttagcagatggtaggcctgtttcctgggtctgtagagttgggcctgaagcctggatcaactggggtggatcttttcattgggtatgtggggatgaacgtaaagccaatttctataagggcaggtacagaggctgttaacagtaggtgctggactgagcatgggtccacaggggctaacatggctctgaggcgtgcattgagcctgtgtctgcaggggctggccagattttggaatgagcatagtgtctgagtctgctgggataagcctggcatctgagtccatggggactggcctggtactggtgcaggactggagccggaatctggagaaatgggcctgggatcttggtagacgggggcagacctggagcctgagtcttcagagatggtcctagagactttgtccatgatggccagcctagcaacagggtctaatgaagtcggcctgtaccctgggtctgctagagcacagctgggccctgagtttgttggatgctgggttacaaaaaccagcctggagtctgatgctggcctagggctgtggtgagatggggccagtctaaagtttgagaccataggtgctagactggtgcttgtagccacaggggtgggccaagaattgtggaatggcctggaggctggttgtgtgagatctgtcctagaaccaacatattcagaagtgggcatggacactagggccacaaagggtggcttgggtcctagggctgtaggaactggactggaacctaagtccacagaggcagtactagatactgggtctgtaggcacctgcccaatactggagtcaactgtgatgggcctggaccctgggtctgctagaggatgggaccataggaactggcctggagagtggggtggcagaaactggcttaggcctcgggaggcctggagcctgggtctgcagatgcttgccagatacctgactaaggcctagggctagggctgccaacctggaaatggggtgggcctgaatcctggattggtgtgagccaatctagttctgggccggtctggaacctagggtggacttggagtctgcgaccacaggggctagccttgtgctaggcagtcctcgagcctgtatccacaggggccagattaggggttggatatatggacactggcatggtgactagagttgcaggagctagcctggtcctggggctggcttgaaacctggagttgtcgaggccggccttgttctgggagcagtctggagcctggagtcactggggctggcctggtcccaaagactgtctgacatccaaggcactggggtagacctggcatgaggatatacccagaaaccaagtccaccaggcaagcctggagcctgggctgtgtgatctggtctggcttagtgtgcaggtactagcctggagtttcgggcaatagtcgcatacccattactggattttactgaagcaggctctgcgttggagtccaaggcaaagttcagtgctcacttcacttttcttcttcgacacagagattgcctctctctgtgccctgctgcctggtgttgtgggaggggtgacacaggaaatgaaaaattgttcttcctatgctcttcaattaatcttttcttatttctctgctacacaacatttctgtaacctttcacctggttttcttagctcttctgaaggtattttcatgcatagatagttgtttaaattgatgtttctgtgtgaggataaatgctagaaagtcccattctgacattttgctgatgtccagtttcacggcatccaatcagatttctatataacgattgtcaaagtggctcagcagcatcagagacaggtctcctgctaatttggaaagaaagattgcagatcttatgttaaatgatcttatcaaacacacacatatatacacacaataataataataaatagagctgtcaaaactttaggaggtgatgaatatgtttatggcttttgttgttgtgatagtttcatgagtatgtatgtattcacctctatattcatcaaggtttatatattaaacacatacagctttttgtatgtcaattatacctccataaagtagttctacaaaaaaataaataaacaccatagaggaaaaatacttttggcctctttctccatgaagtatgacttctatttcaggtttctggtggttactgaacttccagattttctgatgataagtataataagagaaataatatgttaggctagaaaagacaaaaatgcaggatttgaggatgaatcaatcaaattttttcataacataataggacttattgttcaacatattcaagccagtaccaggctagagtgagagaaagtttccagatcaaatatttgtgtaaactaattcaactaaagtctcaagaggaagagattcatgatgagatatctggagtcacaatgtgcaaaattcatcacaaagtggaaaccagcatcttacaatacaaagaacaatggcttgggattctgagcatctgggttctggtcttggttttgcacatgcaatcatgtgtccacttcccaggacttagtttcttgaaactagacaatctctactaaacctcctatctgattttcctccctttcaggaagttaggcaggtgctcagatcagctttttggtcacaaaggatgaaggaagaaggcaggtgtctttcttaaccacagttttgggacatggctttagagaatgcattagcagggactaagcaaataatgaaagctgaatttggggtagaaaaatggggaacaggagacgaaagaatcagaaagaaaatattaaggagcaacaaagagtcccctattgatttgtagtatagccaaagttttgtttttctcttccttagactcttagaggactagaagacatcagagagttttaaaatgttctaggatgccaaagccaagaaagcatgtcctgtggatccgacaccttctcagttccctgatctagctaaaaccaaataccacttgctgatttctccggaggcactgaaacctcatcaccaacccagaacagtttagcatgacttgttctctccatgaagtccctaaacatcccccttcttcctctctaaaagcttcaagaatccactttcatgtcaagtttttctacagaggcagattgttgtttatatcaaactccagaaaccctcatccttttctgatatttatttaagttggtgctgtcagtcttttctaccataaagaacctgtgtttacttggctcttctgtgtcttgccaccagccaccagtcagttaaaacagctttcttttgctacagagaggtgcagccacatctaaagccaccagcagtgcaaggtcctctgactgctttaacaacccctccctgagtgtccagatatgaagaatctgctcaatcaccaaagctcctgaattaagagttaggatgctcctttggaccttcaggaggaacttcattaggaattctgagatagagcaagcattgctggggaaccacaggtcccagtgtcctcctgtcatctcagaagccagtaaagaaaccttcttccctagaaagacttctggagagaaaaaaattccccaagatttgagagcatgagagtctcatggtgaggtccctggtgaacagaaatcagaaaagtactagtacacagaagagatgtacaagcatctagtcactgcctcaaagtaactttgaatttattatgacttagattgagatagagtgattctttgactgttcggtccgtgcctgaaacaaacatgattaatatccataatcttattaattttattatccctaggaggcaaagtctccaaagttttccaaatgatcttgcaaaggcaactctcctcagattccctaggaagttttcagattttatgaataggtgccaacagctatcagatgtcttccaacgatggctgctgcatcccagtttcacattgctaagggttaaagaaggacattgatatgaaagaagcatcccagagacccttgacacattgtgagagtacacagagggtggggctccatcaacctcccacagacactcagccatactattcccattccctgccatgagcaagagtttcagggcctcacaggggttcaaaggtggccaaatcattgccactctttgtagtatgaagtacaccaacacgtaaaggtaggctaaacattgataatataatagctttaaatgtgtataaatgtatgcttacaacctcaaaaatgccatgcaatattattgttctacttacaagatcagtgcaggaattataaagcattaattcagagtggactcttggcagtgtgtaatttatggtgcatgtgttctccattctgtctgtgtttctgtaccattgggtgataacactagaatctcaaatttgggaacttttttgaaagtggggccatgcctaaatggtatcctagttgtctcttccaccatgaccccatgatggacctgcaaagtcccaaagatggaagaacattcaggggtagccagctggagagacctagaatcagagatctctcacacagcctgaaaagcccaaagcagatgagcataacctcagcacctgtgaaaccagaattcattgcttccattcagagatcccatgttcatgtcagaatccaagctgccacgagtgtttcatgaagtcacttatgactaatactgagtacaatgggactgatatcagaactaagctaggcccggagagccctgaggttgtgacacataaggctaaacctttgagttttgatccacagagtagatacatcagagaagtggacttggagaatcccctgctggagtcctagagagtaaccactctgtcagatagcatgtgtttctgagaggaaagcacaggggtctagttccagccgtatccctctgcaccccatatgcacgtgctgagttctagagagactccagagctggtctgaaaggctgatgcaaaggagtctgctctggaactgaagtgttataagaaactggcaagctcagcagccctacagataggtgaggagcccagagatgggagaggaagctattctcctggccaaggtcctgattcagtttgccagaatcataggcagacttgaggccgactggagctagcactggcagtggaattgaaacctcccctgtagtcccatagagaattttttttgtataaacatagaaattgacccttctgatcttaatgcttgaaacttttatttgttttatatgaatttcatccttagtaaaggacccctacgtccctcaaaaagtatcaaagaattgaaactcaccagatgatcccatccagacaatgggacaccagacccctcataaattatgattgcttccttaggtcgcctgagttcctgtttttctacacattgttacatttcttcactgctatgaaaactcataattttagttgatcagcaagacggatttgagaccgagcttgcatctcctctgctacagcatccaactcagccttcttccttggcaattggttatattgattggctttctgtgtggtgagctgcaggacctagaccacacccctggtgtttcagtaacagcttttggtttcccgaccaggaacactttggctcagttgccatgggccaggagtctcacagaactactaagcagctgcttacccaattttggctggagagataagtaccctctggggccaccacagctggccccaaccatggtcctgattgccttggaagaactgcctttggaatttcacatcggcatccagataggtgactgtcctttgtgggcccagacagaaagatctgctcctctcagtttgggaaatttttaaaggaatttccacttgcgggttgaataagcccaactgacgaagagaggaaaataccctgactgtttcagtatggacattcttgggggcttgtttgtcattgtgtgtgtgtccaggcaagtgagtgtcttttgtgggtactagatagtgggatcagctcctctccatttgagaaattctgaaggaattttgatttgcaggttgattgagcccaaccaatggagagaggaatcaccccaactgtttcagtttgtagacttttggggcttgtttgatgctgcaacagttggattgttttagtgattgtttgcaagtgtctgatatagtcatcagaaatcagaatttaataaactgacactcttttgtaacactgtttgaccccagtatagtttggaatctggtatttgcccttgaatgggaaagtgggttggagttccatgtatccaggcttttgtgctgctgctgttgggccaagttagtatgtgatattctcctgtggtgctgtttgaccccagtgttctttggagtctggagaactttggactttaaaaattaaactgccacggaaactgttttactgaaaattttggttcacagccttcactggattacctatcaaggctaacaaagttcagccatgtgaacatgtttgcagactgatgagtttctatttcaatagctagagttccaaggtaaaagctattggatctttgggtgtatgtatgtctagatgtgtctttgggtgtatgtatgtctagatgtgttaatgtgtaggcatatgtattacgttaaatgttgtgactacccaattggattataaataaaagagtgctcatagattaagtaaacaagtccaaagtatttttcatgttcatgctacttaagtaaatctttagcaagctagcattaaaattttgtaaaataaaactagaaatgtcatcatagttgtcagcatacatttttgtctgggttttgtatttgtttctgctagatattttgaggtatgagagtttggcacagaagtttataaagttgtcaccaggagttggagataagcctgggaaacagagaccccctcccccatctctataaaataaaaattaaacaattagccaagcacagtgattcatgcttgtagttccagctactcaggagactgagattggaggattgcttgagcctgaatgatcaaggcttcagtgagtcttgattcagccactgcactccaacctaggtgaaagagcgagaccctgtcaaaaagacaaatagaggcagagaatgacaatggggcacagaagcattgcagggagactaggggaggagtagtaattttttttattattattacactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccacgtgttctcattgttcaattcccatctatgagtgagaacatgcggtgtttggttttttgtccttgtgatagtttactgagaatgatgatttctagtttcatccatgtccctacaaaggacatgaactcgtcattttttatggctgcatagtattccatggtgtatatatgtgccacattttcttaatccagtctatcatttctggacatttgggttggttccaagtctttgctattgtgaatagtgccgcaataaacatacgtgtgcatgtgtctttatagcagcatgatttatagccatcccattactgggtatatacccaaaggggaggagtagtaatttttaataggatggccaaaggaggccttattgagcaggtggcttttaggtgaagacttaaagaaggtaatagagtttttataggtctaataagaaaacagaatgcaggcagaagaaaaagaacagccaagtgcctgaagcagagaggccaaagagagtgaggtctaggacctgactggacagatgtcagggaggtgactggagtctaacttagagaactgttataaacaatttgtacctctttctctaaatgagattgggagttgctgcaggagttgcacaaagacatgacaaaatctggcttttgttttaaaaggagcatcctcatttgttattgacggaagactaaaggcattctccatccagaaaagactgctaagaactgtgaagcatataaaagtttaccctacttggggcaatgtttcatgaatgctgacagataacacaagctttctgggtcaaagacagagttttatgactcattcaacagggagaatgatttttgtgtttgtgtcagtcatccttgctccacaagtcctacagaggaaatacagaaaggcagattaatgttgcaagtgcaacagatgtgtgttgaagccaaggaaccctgaatttaggtcacctggatgttttataatgaactgcaagcaaacctgtctgaactttgctccagagggggacattatctttcttatactgatcagtaagcagacctaccctctgcttcagaagaaagcaatatctctagcttccaagctgtcctctttagaaacatccttgaaaagatagtcaggagaaaaggctgtcaatgtctctgctcataagacatacagaaatgtgagaggccatgaagaattttctcccagccagaattagcaggatgtcataatggattggatgtaaagtgggaggggaaaagatacttaagaataactccaagaatttttctttgaacaggtgaagaaatggagttgccatcaactaagttgagaaagactacaggtgaagtaggctgggtggagagggtggataagaagattgatttgagacataatgagtttgagatggctattggaaggaatccaagagatgtcaaacaggccgttagatacatatgccttgagtttggaaaaaatttgagtagtaatttaaatgtattagtcattggcaggtagattgattttaaagctatgggaccagatgggatcaccgggaactctgaagtgatccaaaattaagaaactggggaggaaagaagggtccacagatgagactgagaaaaagtagtcagtaaagttaaagaaaaaacaagagagtgtgttgtcttggaaaccaagtccattaaaggatgatctattaagatgagaagcaataattgaccactggatttaataacacagagatccctgatggttttaaaaagtgtttcagtagaatggtagcagcaaaaacccaattagatgaggttaggagggggattggagatagcatgtatagacaatcctttcaataaattttgctacaaactgttgaaacaaactaattacagcctgagaaggactctgtacttcttcatttgagtccttgtgggtaaactgtaacgtagcttaatcatcagacaaaattgaaaacctaatttagtagtgtgcacctgtaacaatactccagtgttggccaatcccagcagccatacttcaactactcatagactgctgaatgttcaaactgtgttcaaataaggcaagcgcccagttgtaaccaatctctttgtttctgtacctgatttctggttcctgtacatcactttaccttttttgtctataaattcattttgaccacgaggcacccccggagcctcggtgaatctgctgtgattttgtaggctgccggattcacaaattgtttgttgcttaatgaaactcctttaagtttaattcagctgaagtttttcttttatcagatggtgtcacaagaaggatctgaagtggagcttctagtatccccaggagcgcgaagtgaacacggaaggtacctgcaggatccaattgtgtccattgatctctcagagtggctgaggataataggtaagctccctctcgcattttggagcttcacacgttggtgttttgagctctctgagttgcttggagcaaatttctgatccaaactgggtttggagtcacaacaggaaacagactgggtctaggaacagatttgatcttggaattaactggcctggatccagttagaggcctcttacatctcactgggtcagaaaggaactggtagtaagcagtaatgttgcaggagttataaaatttggcttttgaaaattcacagggatttttgtgttctacccctttgtttcttttcttttcttttttttttttgtgcgcctaggtaggaaaaaaatcactggctaagttcatcaagagaacctaagaataaagacaatattttagataaaaatgggatccttaatttctgtaaaactgagttccttctggcttatacattaggactgtataccaagtcttacagaaatggcaaaacattactaaagatacttagagtggaacattccaaatgaacaacaatgccaatgcatttaaacaacaatgccaagtacatttataaatgagggctctcagtaaagtctctttgactaaaaacagttttggcactattggatgtcaactgctattctttttggaataatctgccttgcactctttgttgactgctgtgggtgacaggatgaggcatgtacagaattgtggtgaatggggagctttttccttctccctacaaataaagaaacttgatagctgatgggactgtggggaaaaaagaaaaaaatatatagcatttattctgttttcataattctcatatttaactatggttccattgccttccatgtttttttcaatcttgcataaaaataaaaacatctcaatggtacaaactaaaattctcaaataagaaataaatcacacatactttcaccacccaaaaacaattttcatgtttatttattcccttcaagtccttgtccacatgcaaacataatttgggtacatatgtaaaagttatatattttgatatttttacccattattcattataattgcttttctgtagtcttcacagtgaccactgactgtgtgctactcatatttacagactgtcattcacaaatttataatttctctttagtggacattaaacttattttccatatattatgaaaaattattttagttaaggaatgaaattctgatacataatacaacagatgtgaaccttgaaaacattatgctaagtgaaataagccagacccaaatggaccaatatcatcggattccatgatatatgaagtacccagaataggcaaattcctagagaaataaagtaaaagttattttatatacatatataaaatatatatattatatataggggtatatatatatatacccctagccaggggctagggagagagggaatgagtaattgtgatttcatgggtatagttgccatttaggatgacaaaaaggctctggaaatggataagcaccatgaatgtatacaataccgctgcattgtacgcttaaaaatggttaaacggttagttttgtgttatgtgtcctttacaacgatttttttaaagaaggtggggaggggtctccccaggtttttagcagcttcctgatttagaaaagaaatgttgatggtaggaatacaggtagagaacacttttatttgggtagatgttagaagctgaggccagggtggggtcacaagagcaatattaagtatgaggagaggccctcaacaaaggtcattgcaaggggatggagtagggaatgcacaggaggggtattttggacaaagattggcagctgataggtgtgggtattgttctcatgtatcagcccaggatataatgttcccagggcaaatggaacacaagtttttttgcggggagtgatatagcatggtagatcttgaattaaaacttttaaaatcttgaccaaaagctcaaaggagaagacaatagtgaaacacatgggtatgggcaattttagttaaatcaggtgagaaacagagcaaagaaagcacttggagatggggggaagaaaaagaccattttttttttgacagctacaagaacagcagagtcagacaggggataggctcatgtcagagatccagttttatttactaaaagttccttgggtattcaaacattctgaaattatgagatcttgcaaaaggatgcctttgtttaaacattgcttcatctagctacagaacatagtttaactttgaggcctttgaccccagacaagataaaatatgtttcaccttgcctattacttaacacatatttgttaactattttaacttcatggataaaaaatttcaaaaatctgtgttaactgatttgcaaatgattgtttcaaatatctgattcgtgggttccttctcttacattaattttgttgtaagttcttcacatttttaattatttttacatcattgaatataattgctaaatctctatatgacatgttgattaatatgaagtcaattaaaaaaactaacatatattaaaacttgttcttactttattccaggcataatgctatgcattttatacatattacattgtgtaatctcaatcctttggaaaacatgcattctaatttccagttccaaagttgtgagaaaacactttgaggttctgattggttaagcaacttaacaaagaagtatgagatggaactaaaatttgaaatcagcctaagctttgaacctatcagttgtgatgatcaccttctccaagttattgttaaattattggcacatttctaagaattctgaatgatatttcaacaaaagtttacagatatgtgttaaaatttttctatctgtttttaatttttgtaatgaaactgggataagttccaaaatggccgtaggtttgaaatatttggccctgagaaactaaagaaaatctatgcctactcctgctccaagttttttagtcatacctgttcttagagggctgatattttctgttgcagatgaaagaagaattctcaggcatataatgaccaaaatacaggaaaaaacttatgatggtagtggtggagtgttctgttacaggcatttgggaagctcacagaactcttaatattcacttttaattctttccacaagggaggaagggcatgggttttggagacagtcatatatggtttcaaaatctgactctggcatttatctctaagaacttgagaaatttacttagtccctctgagatttggtgtattcagaatgaatatgatactaacagtacctacatcacgagtgttacttgaatggagatgtataaagtgcattttaaattcatttgtttccttaacattttcccttcatttcttatcttttcagagtttcttcttcaaggtctcaaggtctgaagcatcccacagaatgatcctactgaataactcccataagctgctggccctatacaaatccttggccaggagcatccctgagtccctgaaggtcagggaacagtgggaggtcagggtatgggagtaggggtgttgaggatgagaaaatagcaggcttgtgattctagtccttcctgactgtttgcagagggttggagctgggaaacaggatgggactgggggcacaggctgcatatcaagagctgctgcttctctttgggaagaggcagctaggtccactctgcaggttttgccactcatttggagaggcagtggagcatggtggctacgaacatggtttggagcctgtctgaatggatatgcattccaaggctgccattttctagtcagatggctttgtggatgtttctttccctttctctgactttacgtttggtttttccatcaatgagatgggaataacgttagcacctacctcttaaagttgctatggacactgaataaatctatacaatataaatgctaagagcattgccaagtgcccagctagtacacagtagctctttggtatcacaaggacagtcctacctgtgagttctgcctgcttgctggtaacttcacgtccatcagtatggtcctctccaggaccatactgctcatctcaccatcactgacttggtctcagtaccttctcttaatctccatttttctcttcctcttcacaaccagatcctcatctctggggatctcaacctctcctggtccctttcatccctccttcaggtgtatggctctgtgtatcacatcaatcacgggaaccccttcaacatggaggtgctggtggattcctggcctgaatatcagatggttattatccggcctcaaaagcaggtaggcacacagacagggactggtggagccaggcaggtccacagggcctgaggaactgaccagttcagacaccatggctgcttttatagggtgaaaggaaacgtgagtattttaaaacactccttcagtactgggcaccttgcatgagtgccacgtgttcccacccttcgtgtaaagcataggactcttctgggaaagggggtggaggaggaaagggaggaaaaggacaaggctgacactcacagattaagggccctatgaggtggcaggggtcacctgcaggggctgaaaggaggccaatttacagggaaagttgggtgtctgagatattagaacagtggcttagaaacagaaaccaaggcataagtctaccagtaaaattacctctcagggccaggcatggtgtcttctacctgtaatcccagcattttgggaggccaaggcaggaggatcacttgagtccaggagtttgagaccagcctgtacaacatagtgagacctcatctctacagaaaataaacaaaattagcagggcatggtggtgcatgtttatactcctagctactcaggaggctgaggtgggaggatggcttgagccccagaaggtcgaggttgcattgagccaagatcacaccactgtactgaagcctgggcaacagagtgagaccctgttgtttttgttttgtttttcaaaaaaaaaagttacttcttaggaaccagggaagggactcataattactgtgtgtcaactgtgtggaagcacttctctcgttagtgaatgttatcatcagaacaatcttatgaagtgagcattaatatctccaatttacagataaggaaacaacattgagaaatattaagtcatgtagcggctggattcctgatgttaaagcattgcccagtctgaattcaagtgcagtggactctaccacttttactagctatataaccataggcacttctgtgagtttcatcatccgttaaaatggggaaaataagaggatcttcttcagaggattacacaaggtttaaatgagatactgtatgttaaacacttagtacatagcacataactgtaaatagtgtttacaataattagccattattggctgaggacacacaaggaataaatgatggagctgaaatggtaatacaaacctaggtgtatttttttcctaaatacttcccctttgtgtttgtgtgtttcatacacatctggttagtaaactgaagcctcattgccagcccaacttcatgtaggtgtaaacgctgagcccccaaataataataagccacaccaggtcaagactagtttgcaaactgggtcaggattcggatgcagaaagtgacaaagtgaccctagcttgaggaacaaaggggtaaaggggatgggaaccaggctgagcctaacaccttcctcagggatgttcttttgatctcctggcttcctgacaatttgggatcaaagattaatgtttagtttatttaatcaatggtccaatttcttcaaagtgtggtatgctagataactgtaggaagtcaaatagttccttttacttcagtaactttgtagttattatatgtattttagcaacgtaactatagcatcaagccataccttcatgtatgcattgctttgaacaaagttagtttttacagtgagtcaataaacaaaaatatgaaaatataaaagtcccacaccacacatataagaccaaaaaaaaaacaaaaaggaaagaatgaaatacgctgcaatttacttggaagtgcattcacctagtctgattccatagcataccatgtttctttcagtattgaaagtcaatctgattttgaataagagcttttcagggtgggatgcaggagaatttatctagaaaaaaattaattttttcattgttgatttttaatcacaaagataatctatgttgattatacaagtaaaaaaatccaacatgattttaaaaagttaataacctcttacctcccctcccctcctctcctcctttcctaccccttggttgtaatcagtgtccttgcccatattaatacacagaaggaatcccagcactttgggaggccgaggcaggcggatcacgaggtcaggagatcgagaccacggtgaaaccctgtctctactaaaaatacaaaaaaaaaaaaaaaaaaaaaaaaaaaattagccgggcgtggtggcgggcgcctgtagtcccaactacttgggaggctgaggccggagaatggcgtgaaaccgggaggcggagcttgcagtgagctgagatcccgccgctgcactccagccttgggcgacggagcgagactccgtctaaaaaaaaaaaaacaaaaaaataaacagagggatattcactgatgatctcttttgtcatcactcttaatttgcctttaacatatggacatcactttgggtgaatcaatacagcactaaagtattcgttttaataactgcggcatttcatagagtcaatgcaatgctatttagtcaatcattctcctgctgttgggttcaaactgttcatacttctttgccactacaaacaagcttcaataaacatcttcatatacatatctttatatcctggaaatttttctcagtacaactgatttccaaaaggaatatctgcaagttacagtttatcttattctaagcaggcaatgccaaattaccttcccaaaggattccacaattttatttttattagcaatgtatggaagaattgtttccccacattctcacgagcactgaatattatccctcttttaatttatcccaaactggtgggtgaaaaatggcatcttattgtggatttaatttgcatttccctgactagcgatattgaacatattatattttcatgtttctcggtcatttggtgtttacttttgacctgtttatattctttgaccacttttacactggggttttgtgtcattcttaaaattttgtaagtgttttggaaactagggatactaaaaaaaggtgtatgctacaaatttgttgcccaatttataattattttctattttattgatggagattttgacattaagaaattttttattttcatgtaatcaaatatattatctttttcactatgacttctgaggttttgggtttttttagttaataattaggaagatttttgctactcgaagatcatacaactgttttctcattttgtcttacagtgagttaattgttacttttgacattgcaaacttcattctatttggaatatatttttgaatagcatgaattaacattcttttatattaatcttccttatggctggctaattatgttagtaccatttcttaaataagtcattccctactgaaatataaatgtctattttgtcatataacatgttatatatttttgtatctgtttctgtattttttctagtcttttctcatgctatttcattgtttctgtggtaaattttaatatctaataaagcaaatcacccttcaccaatctttttttactttcctatttcttataaacttaatagctatatgaacataaactaattcttccagttccccaccaactatcccaaataactattggagttgtgattggtattggaggagcatttttcgacaattttggaagaattaatatttttgtgacactaaattttttcatcaagaaatatggtctttttctcactttttttcagtttgcattctatgccatctggtaaaatgttagtgttttcctgtgataaactaagtgatttttccattaagtttacccttaggtattttatactatttgttaagattattaaattattttcctgttatatttctgagcattattattttgttattgctttgtgtttgtagtcttgatttccaaatatgtcccactgttgtttaaaatcctgtttgtgtggggcattatttgttttttttttttgtcgaagtctcttggattttctaaatgtgtaatactgtaatctacaaacaaagtaatttgctgctgctttgccagtatttgtatgggtttttagtttcttgcattattgcataatatgcaacctaaggaaacaattccaactaataatagttctatacttgtctcatccctgattttaaatagctataaaagcttacatttggaattacatttgattctgtatttgcaggtttagagcattttcctgttgctcctactttcatagaacttatatttagaatggagggtaaattttatgttatttaatttttgtcttttctatttggcaatttatacactcatgtaatttttttctcctctaatttattacactaaaagaccttccaatcaaagccatcctggcctttctaaaaccaactgttcatattcacattttttgtatatgctactgaatattttattcataatttttgtatctgcatgcataagggaatgttgtcataactctctttttgttatttccttaccagatttggcattaggatcttttcatctgttaccaaagtctactattaaaatcatgtgtttgtttttggcttatgtagaatttaaatgtaaaataatctgattttggctacattttattttttaatttcaacattctttttaaatacgggggtacatgtgcagatttgttacatgggaagattgcatgatgctgattcttggagtatggacagattccatcatcctggtagtgagcatagtacccaataggtagttttctaacccagccccttttactccaccctctggtagtccacactgtctattgttcctacatttatgcccatgtgtggtcaatgcttagctcccagttatgagtgagagcatgtgatatttgattttctgttacagcagtaatttgcttaggattattgcactgtggaaagtagtctggaaatttcttacagaaattaaaacagagttgccatccgatccagcaatgtctttactaggtaaatacccaaaagaaaatgaatcattctaccaacatgacacatgcacttgtatgttcattgctacacagttcacaatagcaaagacagggaatcaacccaggtgatcatcaaaggtagactggataaaaaaaacttgatacatatatttttatggaatactacacagcaatagaaaataataaaatcatgtcctttgtagcaacatggctgaagctggaggccataactcttgtctactttttaaaaggtagatgtttaatttcatttctgatattttctattagtttgttcaggatttctatttttttgcaagtcaatattgatagtttattcttgagggataacatccatttcttttatcagtaaatatcttgccttggagtagtatgtagtcttctattagaagtcttttgttcttttctctgtttcttctgtttctgttctcatagcttacagtctgttttttttttttttttgcttttttctctttctcttgtatttcttttaataaatgccttaccagaagtttatctctctctttcttcttctctctctgtttttgccatttaaaaatgaacttttggctttatatatcctttgcactatgtcttgttctccatttcattatttatagctttcatttttacaaattgttccatttgttattttctagtttactttgatattcttttatatatttccttgactatttacttggctatttttggtcattcttttaaaatcaggtcttttaaaacatctactcttctaaattcactgacgttttgggtttgaccatattcaggaacttgcatttataaaagcaccctgaaattcttgaaggtttctttaaattaattacactattttctctttaactctttagcaatacaatttccaacataatattaatacattcactgctaaaacgctcacacttattgtttatattttcccagagaaacatcctcatcttccaatgaagtttctgtcatgccagaatgggatcacgagtctctttctttcaaacccaagagtctaacaccacataaattacccagagagctaccaaaaaattcagttacatcattctattttgtgggcttctgggtgtaaagccagtgtcacttttcaaataggctgatatcctgtaggcttgagaaaaggcaaggtctcgttagtgtttatattcactaaagtatcttgctcaagccctggacaccgtagattctaggacactattgactctaggtgtctggtgaaacagtaggcactaaaaattagagaaatcacagttaaatttattttgagccaagtttaaggacttaactcttaacaacacaaactcagtacaacccagaatgtgtcccacagtaggttacctggggcacagtatatataacaggagtatccgtttggcacaggtggtaagagaagcagggagagaagcaattgttgcatttttttattctgctgggtgcttggtgatgctatatataaaatagggtatgtgtgcagttgagtgggtagggagaaaggtgaggcatcttaaggcctggtggagggtgactgatttcatcctgtcttagttctgcatgtgataaggaggtttataaccaatacttgtcagtgttaaatatttaacaaactccagttacacaggtaagaggtcagcggtagcttataggcctaggttttattatcgatgtgcccaactgcagccatcatgggccactgttaaaattttcttttgaactttcatttttctgataattgcaaccagtgagaggtgaagaaaaagttcaagggaatgacctgatcttatatcatccaatacaggagatgactgatgacatggattcatacacaaacgtatatcgtatgttctccaaagagcctcaaaaatcagaagaagttttgaaaaattgtgagatcgtaaactggaaacagagactccaaatccaaggtaacgagtctgaagaaatgggcaagcagctgtgcttctcaaattgtgtcttcaactaacagcattagcatcacctgagggctcattagaaatgtaaattcacagaaactctggggactgggagaggtggagcaatctgtggtgtgacaaggactccatctgactgtggtgtaaactcaagtttgagaactactaagcactgaggtattaatcaggtgggagcagtgtaagtagagaactccatgtctgacaagattgctttcttggctttcttcccaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaaggtacaaaaacatgtgctgatcatttataattgcgattccttgtacatttttgtaattcacataaatcagttttggaatgaagagaggatgaattcattccttgggatgaataaaggttgtcaaagttcaagatccaaaactttgcaatggtgagtctttaaacaagaagagttcctgggatctctagattgggatggcacctagaaattacaggattggggatgaaagttgttgtctttctttttgttgtctacagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataaacctaatctgtatggatactttatcaaaaatgaatgtccctgctatttctggatttatgaggcaatggtacactaaagaatggaatcagttcagtgaatagaaaggtatccaaggtgaagcctgagacgaatggctttcccaggctaccttccatcactgttgtacagaaaagaaatccagagaatcaaatggactggccttgggggtctctgctatggaaatgccattttttgtgtctcctttctcctactctttctcacatcctcttcatgattgaagcatggcacaaggcaaggtgttgcctgcgagtctggttgtaagttcagcctttggtgtttgcactactgctatcataaggggtcagggacattccggggagaagtgaccactaaggtgaggattagagagtgagtagaagtgagccagacaaaaaaagcagaaaatgcagatgatggaaaggacatgtgccatgcactatcataagaacttcctaactgaacactgatactacaattctgaatccctgatcttaaaaaataattatacttcaccaacaaaacttggcctcttttggttccactctgccaccctgccattggaacttggattactgtgaacattgcagctatagcaaaataaaaaataaaaaaaataaataattggcattttcattctttctgatagtctagatttgaagcagaaaagatactttaatagaattggctttggaagtaaagtctgccagtattaagaaacacctattttcatctctccataaaaaacaaaacttccacaaaattgaatgtttatatttgatgcgattttaaagtgtgcaattccagcaattaaagaattgtgtaggtcatggagcatttttaaaaaacttcatcttagaaggctgtggtagatctgttaccgcttagtatgaatcaatccaatcagatttctaaactcctaagacctggctgatttgttacattgactgaaatgaaagcatggtctgagaaagagaggaaacatgtcatttgggatttcaaaggttggaacattcttacataaaaaataaactcgggaacttggggtaatatgaaaacagctatatttttcactcaagatgcaaaagctaataaagatgatgaaagaagacaaagcaaataaaatttgcctatttcaaaatggtgcctcgggcaggtcctgtatccagaagaggatgctcatccagggtctgtaagctcaggtcatcttagctcagcccagctggcagcttccctcctctgccccttccctgaatgcaagccagcttcccttatctagcccttcatggtcctgttacgatagtgattcccaaaccttatcatccacttggattaaaaaaacacaagaaagcatgggaaagaggaaggaggatttcttaaatatggcaaaaataagtccaaaattatcagtaaacacaatacagatgaatggggtaatttttttattaaaacatatgtttttcatattgagttaaaaacaaagtccaagaagcatgcattaatctgctctggctgccataacaaagtttcatacactgagtagcttacacaacagaaattgatttctcactcgtttggaaaccgggaagggatatgacaaggttctggcgaggtaggtttcattctcagtcctcctctctcagcttgttgatggctgctctctctctgtgccctcacatggtgtagaggagggctcagactctcttccttttcttagaaggacttagtgtcatcatgggggctccaccctcatgacgtcatctaaactcaattacgtctgaaaggcccacctccaaatacatttggagttgggacttcaacatatgaatttggggatcacagtcagtacataagaaagcacatctgaaataaaaacacaaaggctaaaagaaaggaaaaagatatactaaatgattttgaaactgaaaaagcaaagtaataacatcaatactaagcaaaacagaacttaagacgaaaatctgctaaatacagaattctcccacaagataagtcatgaatcttcctcacaacacaactacaaaatacatatggcaaaagctgacatacaaaaagaaataggcaaatccacagtctcagtaggagaactcaaaatacttccctcagaaagcaacagatgatgccgataacaaagacaacttgacaaaatgccatcacaagttgatatttctggtgatgttggggttatctgcttactgtgtatttgagaacttctgttcatctgtttgtcaaactgaccagcagggggtgctggggagggaaacactccacagggagggtggggaaagttctctaagtctagaggctcctggtccccccatgatcatcatctatcaggggcaagcactgctgatacaggagctaaaaaaatcaattatttaggcagttagtgtgggtaagggagtcgttggtaaggttttccttttaataaaaaagcagcccccatctaattttgttttctaacaacaatcagcctgaaaaatcagctgcaagcatagataagcaagctaaaacttgcaaaggggaatgccggcacctatgccaatagaaaagggatacttggaagccaggcatactcgcatgttcaacatggaggtgtcctcttctttttttttttttttttttttttgacggagtctcgctctgttgcccatgctggagtggagtggggcgatgtcggctcactgcaccctctgcctcccgggttcaagcagctctctacctcagcctcctgagtggctgggatttcaggagcccaccaacaggcccggctaaatttttttttttttgtattttttttagtggagacgaggtttcaccatcttggccaagctggtcttgaactcctgacctcgtgatccaccctcctcgccctcagaaagtgcggtgattacaggcgtgagctacggcgccctgcctcttcttcccttttctttgtcttcaagtgttcaggcaacatggcgctggccagatagagaccccatctgcataataaaagattaggatgggatggccagcctcttcgtgcattcacacctggtccaaccaaccctctgagccctgtgtaaatcagacactggctcctcaagctcatctataaaaccagccgcaacttgccccaaacccagaaacccgctcaggcacccttccaatgcacagggaactctctcttctttcttttgcctattaaccttccactcttaaatccactccttctgtgtctacatcttcaatttccttattgtgagacaaaaagcctctggcatttacccaaatgattctgcttcactgccatctctagcccaagtgccaaaaatgaccactttagcctgatgaatgccacggctgctaccatgctgcttaggacaagcaaggatacaaagatggactggggaatggtttatcagagaggccgcaatgaaagcatatcccatgcaactttccacttcttaacttctgtcattttcaaacttaaaggtttttttttttatttttatgttttgttgttgttgttttgtttttaacagtttctatttctggcccaaagacttctctttgttttcctcctatgacatatttattgtttgttctaaagtcctttccaacatttcctatagtaatttagaagacatgtgtttggttcacatcttgatctcctctccacctagaattctttttactttctcccaggaagattccacccctcctattctgccagttccctctacctcaaacagttgccctttcaggcagataagcctgggccagttctactttactatggacaccaactcttctgaaataacatctgagtcttgggatttgcatatgaatcttcccttgacacagaaaacagtctttccttttaccttcactaaaggcatacacttgggagaatggacagcactaaaattccacaggtttcaaaaccaaacgtgctgtgccattctagagttcttggaatgaagacgacaaagtaggttagaagggatgatttcctccttcctttgtcaccatgaaggagctcctgtttttaaagggaaaaattaacgacagtccaaaagaaactcttgcaaatcaagccttgccatgccaccacgagaagggtaatctgtgtgcctaggggtgaaatttttaaatttttgtaacggtgtccagggtcaccctgtggataacaaaaatatttaaaaacctacaccggtgccaacctttcagaactgtgtgtctttgcaaggacttaccaaggcctagagatgatagcagtctacaggcaaactccaaagcctcccacctgccccaaccaacacacacacacacacacacacacaaacaccaccctgctattctttggccctagatctcacttaaatttattctaaatcttaatctccctgtgccttcaaactcatgtgttgtacagccttggtaattgctttttaaggatattccctgactttataaaaactatttatgagacatatatctaaggtaaaacttttcatttcagcccagatcagcactctttttattagaattacaaatcctgaatttcttagttgctagaaaaatatattgaaaaggaattatgcttgtatagcaacggattatctctggaaaagtactgggtgtctagaggatgagtgaaaattgtttcccctatatatatttttttatttcgaaaagtatatcctgtgtatattcaaaagataacattttataaacagggaaattgcctccactgtggactcttattaattcacttatccaccaagttctcttattaactgacttatccatcatattcccttattaactttttattcaaccactagtatatgcttctattgctcataattgagcacaaatttctttactattatataaaataaagtgccagctattccactttttctcccatacctcaatgagatgacatcttccaatagattcatttccctgttttgctccctcctcccatccagatgagtgtgctaagtgatacaaaatgcttttatttctttacccctcatccccctgagcccaatccctggatgttttatttccaggtgtcatagaattttccttgtggtgtgtcgcttctatttaaagaattcttctttaaaacttttatacacattcctgtagagtctatcattgtccattcagagttaactgtctacataaaatttgtcagattttttttggctcaccactgtttcttctcctttttatctgctcctatttgagatctctgttcccatttgatttgttaaaattctttctccaatattttctgtgtgtaattatgctacttatatgatagctgaagactctcaaattcacaaatacctttctttgatcctcacaagaatataacttctgaagtcttatatatccacaaatatttttcttttaccctcaggggattgatgccctatgaccccacattttaggcttaacaaatttaatttttttctcttaatacataaggaaactgaggtgcaaagaaagaagggaaacttgaaccttcattcaaggtcacaaagctagtaagaagtggatgactagcgatgagggtttcaggttgagattaacaacaaatgtcacagaagacaatagtgtttaacccaacttcaagttcataaaatgaatggacgtttcctgatccctcaacttcctcccccacctcaggggatttcaggatgtaccaggcaaagctgtctccctcgatccccaactgtttctcagtcagtgaggggtgttaagaactcttcactgcccctcttgaagcttacattctggagcagggagagagaaactgaaaaaaaatttgaaaaaaaaaacccagtaaacatatttcctacatactgagatgtagtatatgaaaaaacaacacaggattcaggaagagaagatgatggagggagaaagaacaacaaataaataggaaaagagcctccagataggagaagataaaagggagaggaaacaggaaggggtcagaacaggcctccctaaaagcctggcatttgacagagtgctgcagaatgaagagagccaagcacataccaggggggtagggttgcagtctgaggaagcactccaggaagcacccaagatggtccactagggtgaacaaagaacatacttgaaccaccagttagattcaccttcatctaaaaaataagaaattaaatgtgcctgatatttatttaatatgttaatttcaaaactatatatatatatatagttgatgctcaaatcgttaaaaattaggtatgtaaaattaaagctcatagattactcttgcctatggcaaggagctcctgataggcaaggatacatctcacccatctctgtatcttcagaatccatcatattatgtggaacataataagtatcagtagtatgttggggggaaagatcgaaaccatgctgagcaccggaattctgtgtaaatctttcaaaaaaaaatctcttctactttatagcagagtcccttttcttttttatttttagtagcaactagccccacaccttgcagatgagctcctaagaaatgaatgggtgaatgaatgcgtggacagcgagatggatcagtgagtgaggaacagcgattcgcaggacctgcatgcattgaaatcctgacaaagcagcctctgcaagataaaagaccttaggctttgccgtttgacagaagttaaaattattcaagggctgtccttgggcaatttacttgaagtttcataatctgtgaaacagaaaatgaattaaataaaaagataattgagacaaacctataaaaagtgccaaagcaggatgcctggcattaagggacgcttcacacctgttatctctcaccctattctctcttcacccctactcccgcccggcagctccccgctgttagcaccagaaatagttatctgctaagaaaacgaaaagtgtaatgctggctttaccccgcgacgctttaaaaaactccaaaaacccagcgtgatggggggtaggtttgcctagacacagctgaggcagccttaataaactgagaggaaggttaattgtcaaagagggttgagccactaggagcagcagcaaccttggactaacaggtgtatcttcagcgagcacatgtcccagcacatgtccccacgcccatccttccatttagcgccacaaacgcagcctcttaagagaatgggaagtttgggagtcacagaacggaagctaccattggccttaatggatgtcaaccattaaggtaagcttgggagtcggagaacggaagctaccattggttttagtgaatgtcaatcttcacccgccacttttcttcctggcctccttgccccttcctattctgctggctagttctctctcgtcatctgctggccgcactcgggaacataccaaacgcggaaacgcgccttagcttgccctgaatacctgcaaaccgagggctcggcgtggtttttaaaggcttggctagcgtgcccccggcggtactaaaagagggctgcttgcgccaatctcattcccacaggatgcaagtacagaagcagagcggacgcccggaaggggtcacagagagacaggcggggcggttgaccagctgactggactcactttggagaaatgcaaattaccgagccacagtccaaccaatggtatcaaaacagaatctctacagatgtagctcagcgaagatgaatctcggcctcaccccagagaaattaaatatattgggggtacccagaatccccattttaaaaaacctatccaagtgataagtttgaacattaaagtacagagaatcacaaactggcagaactctttaacttacaaaaaggtaatgaagaccccccaagaggaaaaggaatttgcccaaggtctccctgcaagatcctaagaaaacatgaggctctaaggttaaaaacctaactgacaaccattccctcccgcaactcgtcctctgacctctagcaaactatcctgtcctaatctgtgaaataggagcaacagttacacctatcccagcaggtggctgcaaatatcaaatgggaccaaaatgagtcaactaccaagcaccacccgactggaactacaggttgaactaaatcttgatcgccctacccctgttcatctcccagtaccactgtatgaaggtggaggtgaagcctgtcttgaagagagagagaggctccttggagcctctggagtccgaaggtagatgttaccttcctcttgagtgcattgtcttcctaagataggatggacaacagggtctatatggaaagtgttggctgtcagggcttcaagtctggctcctaagctgttgctggagggttagagaccccactccagctctctctaaaatgagggcagcttgttagcaagagtgagtgaggtgagccctctatgaacccatgggaggagagaaaacgagcatcccatataagcttttacataccccattgcaagctccataatgtggtgcccaggcccttatctctaacccatccccagaagccaattctccttagcccttcctgccacttcttccattgtacatccagatggttcccttcttctcttctatcaaactcctactcatctctcatccatcaagcccaaatataaatctttctctgtgatatactcgcaagttagaggcagtggtgccttcctctgtattcccagaacatgttgtttgcaactctaaatacagacatcagcctactgttagggttcaggagcatcttttaggagttcatggggaaatcactttccataaatgctggccttattccctaacttcaccagacctgaccttagtgcttcatccattcccacctctcctgaccatgtaagaggccttttcttcttattggtttgaaaaacacaaaatgacccaaccaccagttatgtggccaaaagaattcttgtcacattataatcaaatccagccaacaagatgctttgtggcaagtgaacgttccttttcagggcaaacactgtccccaggaatgtgagacaacttccacagccccatataagtattagctggaagtgaggcttcgttggtggctcaaaagattccctgagcacccctacgctgtcgctgatgtcaaattgcagtgggattgcatcaaatctctcagagcacagctgcaaagagaaacgcaaagctagagctctactctggacccatagctctaggcagttagtttctctgtgaggttcaattttatacataaggaagaaatggaagattgctaccaaaaatgacatcatgttacttattctaatcgtgtggttcagttgctactccagtgatgagcaagtaaagaggaattagaagcatgactattcctaggctcaaggagcagggaagttctggaattgggtgtgtggcagtgctgcttggagtgccattacaaaggggcaagactggttcactgggaggtaaaatatagggcacctaagagacaaggggtctgggaaacaaggcagacttttgtagttatcatttgctctgatatctctccacgaactttcttctcccttttaattttctctgtactttaattacatttctttttagggacaggcccccaaatctggccataatctggccccaaaactggccataaacaaaatctctgcagcaccgtgacatgttcgtgatggccatgaagtccacgctgagggttgtgggtttactggaatgagggcaaggaacacctggcccacccagggaggaaaactgcttaaaggcgttcctaagccacaagcaatagcataagccatctgtgccttaaggaaatgttcctactgcagataactagccagagcccatccctctgttttggcacattcctttgttttctgcaaggaatacttttagttaatctataatctataatctatagaaacaatgtttatcactggcttgctgtcaataaatatatgggtaagtctctgtttgaggctctcagctctgaaggctgtgagacccctgattcccactccacacactgtatttctgtgtgtgtgtctttaattcctctagtgcgactgggttagggtatccacgactgagctggtcttggcaatttctcaggcctggcatggtggctcacatctgtaatcccagcactttgggaggctgaggcgggcagagcacctgaagtcaggagtttgaccctagcctggccaacatggtgaaatcccatccctaccaaaaacacaaaaattagccaggcatggtggcaagcacctgtaataccagctgctcaggaggctgaggcatgagaatcgcttgaacccaggaggtggaggttgcagtgaactgagatcatgccactgcactccagcctgggcaatagagcaagaccctgtctcaaaaaaaaaaaaaaaaaagacttctcagttaatgaacaacattgttaccatcataagtcctagcttccctctctttctccctccatgtgtcttttatttttatctatgttcttctctcccagattcaccctctggccccttcttaaggctccgtgggcattcaccctcacgtgttgaatgtccacttccctccttattttttaactggcatggattagcatctcaaagtcaacaggtcaaaagtagaattactgatacacacacacatacacacacacacacagcccaatcctggcatacacagcgtctccttcctcagtcttccccatatcagttaatggagactttatccttctagttgcttaagtcaaaagcccaggaatcatcactgagccctctttttctcttatttatggaacatccataagcaaattccatgtgctggcctttcaaaatatatgtggaatccagccatttctaacacctccaccattaccacctgaggccgggctccgaaatctttgcaatcctgggacagactcttagccgccttctcccttccacatctcctcttgtcctcccagagtttgtcccccacgcagctgccagagtgattttttaaaatatgtcaggttatattactcccttgtttcaaatcctccatttaaaataaatttcacatttaaaacaaaatccagacttcttcatatggctgaccaggtgctttatgctaatggaatgtgcagatgctcctccctaaggagtgcttctttccagggcaaattatctccagtgatgtcaggcaatttcaacaacaccattctctaccacctcttgctcttcatagctttttttctccagattctataatgaaaagaaaatcaagtttccttgtgcaatgatttactctccgatgtatattggtgccagtcacttatactgctttcagatgattcaagaataacagcgatttgagaaagctgtccttaagttttctcttctgtttttctgtataatattatttttacaattatacttccaaagttttctctttccaagcaccacaacacccgtgtaatttaagcagtgatttcaggggtctctctatattttacattaatttcagaaacatgctcttgattattccaccaaaaccatcaacttttacatcaacatctgtccttctatgagttacaaaataattgtcaccatcccccccttaatcaaccatcgtctccccttctttgaccaacttttcaaacacccaatactgaaagcatctccttctattcaggttcttagatagtaagacgttctgttcttaaacagtaagatgttttctcaagccccatgcaaagcacttctttgatcatcactttggggatacccaactctggcgtcttcatcaggagggtaaagttccacactcagtaatgcgcgtcctgagaacaatgcctaagcagtgctggccgcttccttatccaggctggcattgtctgtgttcaccagcccgtccgggaagttggatcatttgcggagcaggccaagtccctctagccctcacgcaggcgtgggtacagcctgctctggaacttgcagtaggctggagtctgggcttctgcatcatcaggattgagctctctctgctgctgccaacggatcccgcctgggtgctagtcccgccaccgccgctcaccccacagcggcagaatggcagcaagtgccacacaccaaagcaccggggcgggatatttgccctgcagctcccgccagcgcgctgctctgacgcaaacaaaacgcggggaaagcgcgaaaccgccaggtgcctcccactcagggatgtcagggaggtgactggggtctaagtcatggagaacttagaggggctgttacaaggaatttgtgtctctctgaatgagactgggtgttacccctgcagtagcaggggttgcacaaaggaataacaaaatctggcttttgttttaaaaggagcattctgtttttccattgagaaaagactaaagacattctccatccagaaaagactgccaggaactctgaagtatctaaaagcttaccctacttggagcacagtttcataaatgctggcagatgacacaagcctcctggatcaaagacagtattttatgattcattcaacaggcagaatgatttttgtgtttgtgtcagtcatccttgctccataagtcctgcagaggtaatacagaacagcagattaatgttgcaaatgcaatagttgtgtgttgcagccaaggaaccctgaatttagggaacacgtatgttttataatgaactgcaagcaaacctatctgaactttgctccagaggaagacattatcttttttatacttaacagtaagcaaacctgccctctgcttcagaagaaaacagtatctctagcttccaagctgtcctctttacaaacatccttgaaaagctagtcaggagcaaagactgtcaaagtctctgctcataagatatgcagaaatgtgagaggtcatgaagaattttcctccaaccagaattatcaggatgtcataatggattggatgtaaagtgggaggggaaaagatacttaagaataactccaaatgttttcatttgaacaagggaaaagatggagttgccatcaactaagttgagaaagactacaggtaaagcaggctgggtggagagggtggataaggagttcgatctgagacataatgagtttgagatggctactggagggaatccaggagatgtcaaacaggccattagataaatatgttttgagtttggaaatgagtttgagtaataatataaatgtattagtcattggcaggtagattgatattaaaggcatgggatcagatgggataaccagggagtaagtgtggataaaaatgagggccaattattgaactcagaggtgatccaaaatgaagaaattggggagaaaagaagggtccacagaggagactgagaagaagtaacaagtgaagctaaaagaagaccaagagagtgtgttttcttggaaagaagtgaagaaagttctttaaaggatgagctattaagatgagaaataataattgactcttggatttaataacataggctttaaaaagtgtttcagtagaatggtagcagcaaaatcccaattagataagtttaggagggggattggagatagcatgtatagacaatcctttcagtgaattttgccacaaagtgttaaagcaaactaaatatggcctcagaaggactctgtacttctgcatttgagtcctcatgggggaactgtaacctaccttaatagtcagacaaaattgaaaacctaatttagtagtgtgcacttgtgacaatgcttgagtgttagccaatcccagcagccatacttcagccactcatagactactgaatgttcaaactgtgttcaaataaagcaaatgcccagttgttaccaatctcactgtgtctgtacctcacttcctgtttctgtacgtcactttaccttttttggtctataaattcgttttgaccatgaggcaccccgggaggctctgtgaatctgctgtgattctgaaggctgccggattcacaaattgttcattgctcaattatattcctttaaatttaattcagctgaagtttttattttatcagattatgtcagaagcaaatccgaagtggagtttctagtatacccaggagcacttagtaaacatggaaggtacctgcaggatccacttgtgtccattgatctctcagagtggctgagaatcacaggtaagcttaatctcacattttggagcttcacacatttgtgtttggagctgagtttctttgagcaaatttctgatccaaactgggtttggagttgcaacagaaaatggactgggtctaggaacggatttgatctgggaattaactggcttggatccagttagatgccatttatgtctcactcagtcagaaagaaactggtagtaagcagcaatttacaggagttataaaatttaacttttgacaattcgctgggatttttgtattctaccccctttgttttgtgtgtgtgtgtgtgtgtgtgtgtgtgtgcacctagggaggaaaaaaatcattggctaagttaatcaagagagcctgagagtaaagccagtatttagaggtaaaaattgaatccttaatttcaggaaaactgagttccttctggcttatacattaggcctcggaggcagcaaagtcttacagaaatggcaaaatcttactaaagataacttagagtggaacattccagttgaacaacaatgcattgaagtacatttaaaaatgagggctctcagtaaagtcttttttgtctaaacacaggtttggcactatgggatgtcaactgctattctctttcgaataatctgccttgcattctttgttgatggctgtgggtgacaggattaggcatgtaaagaatcatgatacatagggagcttttttcttccccttaaaagaggggaaacttgatagctgatgggactactgggaaaaaagaaaaatacagaaaaatagcatttattctgttttcataattctcatctttatggttctagtgccttccatgtttttttcaatcttgcataaaaataaaaacatgtcaatggtacaaaagaaaattctgaaataagaaggaaatcacacataattttgccacccaaaaacaactttcatgtttacttattcccttcaagaccttgtccacatgcatacatactttgggtagacatggacaagttatatattttgcttttttacacattatttattataactgcttttctatagtcttcccagtgaccactgactgtgtgctactgatatttactaactgtcattcacaaatttattatttctcttcagtggactttaaacttatttcccatatataatggaaaattattttagttatgaaatgtaattctgacacatgatacaacataggcaaacctcaaaaacattatgctaagtgaaataagccaggcctaaagggacaaatatcatagaattccatttatatgaagtacctagtattggcaaactcctaaagacataaagtaaaataaaagttattttgtgtatatatccctagccacgggctagggacagagggaatgagtaattgtggtttaatagatatagtttctgtttagtatgacaaaaacgttctggaaatgggtagtggtgatgcttatacagcattgtgaatgatcacaaaccactgcgttgtacgcttaaatatggttaaacagtaagttttgtgttatgagtaatttacaattttttaaaagagtatggggaggggtctacccaggattttaccagctaattgattcagaaaagaaatgttggggggcagttccaagatgggcgaataggaactgctccattctatagctcacagcgtgagtgacgcagaagatgggtgatttctgaattttctaactgaggtactaactgagggcttcatctcactggggcttgtcagacagtgggtgcaggacagtgggtgcagcccaccgagcatgagccaaagcagggcgagatatcacctcacccaggaagtgcaatgggtcagggaattccctttcctagccaagggaagctgttagagacagcacctggaaaatcgggtcactcccaccctaatactgcacttttccaatggtcttagcaaatggcacaccaggagattatatcctgtgcctggctcagagggacccacacccagggagactcactcattgctagcacagcagtctgagattgcactgcaaggcagcagcgaggctgggggaagggcatctgccattgctgaggcttgagtaggtaaacaaagcaccctggagcccaccgcagctcaaggaggcctgcctgcctctgtagactccacctctgggggcatggcatagccaagaaaaaggcagcagaaacatcagcagactgaaatgtccctgtctgacagctttgaagagagtggtggttctcccagcacagagtatgagatctgagaacggacagactacctcctcaagtgggtccctgacccccaagtagcctaactgggaggaatcccccagtaggggtagactgacacctcacatggccaggtacccctctgagacaaagcttccagaggaacgatcaggcagcacatttgctgttcagcaatatttgctgttctgcagcctccactgctgatacccaggcaaacagggtctggagtggacctccagcaaactccaacagacctgcagctgagagtcttgactgttagaaagaaaactaacaaacagaaagaacatccacaccaaaaccctatctgtacgtcaccattatcaaagaccaaaggtagataaaaccacaaagatggggaaaaatcagagcagaaaagctgaaaattctaaaaatcagagtgcctctcccactccaaaggaatgcagctcctcaacagcaacagaagaaagctggacatagaatgactttgcctagttgagagaagaaggcttcagatgatcaaacttatccgagctaaaggaggaagttccaacccatggcaaagaagctaaaaaccctgaaagaagattagacgaatggctaactagaataaccaatgtagagaagtccttaaatgacctgatggagcagaaaaacatggcaagagaactacgtgacgaatgcaaaagcttcagtagctgattcgatcaactggaagaaagggtatcagtgattgaagatcaaatgaatgaaatgaagtgagaagagaagtttagagaaaaaacagtaaaaagcaatgaacaaagcctccaagaaatatggtactaggtgaaaagaccaaatctccgtctgatgggtgtacctgaaagtgacagggagaatggaaccaagttggaaaacactctgcaggatattatccaggagaacttccccaacctagcaaggcaggccaacattcaaattcaggaaatacagagagtgtcacaaagatactcctcgagaagagcaagtccaggacacataattatcagattcaccaaagttgaaatgaaggaaaaaatgttaatggcagccagagagaaaggtcaggttccccacaaagggaagcatatgagactaacagtggatatctcaacagaaactctataagccataagagagtgggggctaatattgaacaatcttaaagaaaagaattttcaacccacaatttcatatccagccaaactaagcttcataagtgaaagagaactaaaatcctttacagaaaggcaaatgctgagatattttgtcaccaccaagcctgccctacaacagctcctgaaggaagcactaaacatggaaaggaacaaccagtaccagctactgcaaaaacatggcaaattgtaaagaccatcaatgctaggaagaaacgaatcaactaatgagcaaaatacccagctaacatcataatgacaggattaaattcacacataacaatcttagccgtaaatgtaaatgggctaaatgctccaattaaaagacacagactggcaaattagataaagaatcaagatccatcaatgtcctgtattcaggagacccatctcacatagacacatataggctcaaaataactcattttatgaggtcagcatcatcctgataccaaagccttccagaggcacaacaaaaaaagagaattttagaccaatatccctaatgaacatcgatgcaaatatccttaataaactactggcaaactgaatccagcagcacatcaaaacactaactcatcacaatcaagtgggcttcatccctgggatgcaaggctggttcaacatacacaaatcaataaacgtaatccagcatataaacagaaacaaagacaaaaaccacatgattatctcaatagatggacaaaagtccttcaacaaaattcaacgcccttcaagctaaaaactctcaataaattaggtattgatgggaagtatctcaaaataataagagctatttatgacaaacccacagccaatatcatactgaatgggcaaaaactggaagcattccctttgaaaactggcacaagacagggatgccctctctcaccactcctattcaacatagtgttagaagttctggccagggcaatcaggcaggagaaggaaataaagggtattcaattaggaaaagaggaagtcaaattgtccctgtttgcacattacatgattgtatatttagaaaaccccatcgtctcagccccaaatctccttaatctgataagcaacttcagcaaagtctcaggatagaaaatcaatgtgcaaaaatcacaagcattcttatgcaccaataacagacaaacggagagccaaatcatgagtgaaatcacattcacaattgcttcaaagagaataaaatacctaggaatccaacttacaagggatgtgaaggacctcttcaaggagaactatgaaccactgctcaacaaaataaaagaggacaccaacaaatggaagaacattctatgctcatggataggaagaattaatatcatgaaaatgcccatactgcccatggtaatttatagattcaatgccatccccgtcaagctaccaatgactttcttcacagaattggaaaaaactactttaaagttcatatggaacaaaaaaaaaaaagcccgcattgccaagtcaatcctaagccaaaagaacaaagctggagccatcatgctacctgacttcaaactatactacaaggctacagtaaccaaacagcatggtactggtaccaaaacagagatatagaccaatggaacagaacagagccctcagagataataccacacttctacaaccattggatctttgacaaacctgacaaaaacaagaaatggggaaaggattccctttttaataaatgatgctgggaaaactggctaatcatatgtagaaagctgaaactggatcccttccttacaccttatacaaaaattaattcaagatggatcaaacatttaaatgttagacctaaaaccataaaaaccctagaagaaaacctagcaataccattcaggacataggcacaggcaaggacttcatgtctaaaacaccaaaagcaatggccacaaaagccaaaactgacaaatgggatctaattaaactaaagagcttctgcacagcagaagaaactatcatcagagtgaacagacaacctagagaatgggagaaaatttttgcaacctattcatctgacaaagggctactatccagaatctacaaagaactcaaacaaatttacaagaaaaaaacaaacaaccccatcaaaatgtgggcaaaggatgtgaacagacctttctcaaaagaagacatttatgcagccaacagacacatgaaaaaatgctcatcatcatgggccatcagagaaatgcaaatcaaaaccacaatgagataccatctcacaccagttagaatggtgatcattaaaaattcaagaaacaacaggtgctggagaggatgtggagaaataggaacacttttacactgttggtggggctgtaaactagttgaaccattgtggaagacagtgtggcgattccttaaggatctagaactagaaataccatttgatccagccatcccattactgggtatatacccaaaggattataaatcatgctgctataaagacacatgcacacgtatgtttattgaggcactattcacaatagcaaagacttggaaccaacccaaatgtccatcaatgatagactggattaagaaaatgtggcacatatacaccatggtatactatgtagccataaaaaatgataagttcatgtcctttgtagggacatggatgaagctggaaaccatcattctcagcaaactatcacaaggacaaaaaaccaaacaccacatgttctcactcataggtggaaattgaacaatgagaacacttggacacaggaaggggaacatcactcaccggggcctgtcgtggggtgggggtagaggagagggatagcattaggagatatacctaatgtaaatgacaagttaataggtgcagcacaccaacatggcacatgtatacatatgtaacaaacctgcacgatgtgcacatgtaccctagaacttaaagtataatagtaataaatgaaatgttgatggtaagaatatgggtagagaaaacttttatttgggtagatgttagaagctgaggcctgggtgcggttataaaagcaatattaagtatgaggagaaggaggccctgaactaaggtcattgcaagtgaatggagtagggaatagataggagaggtattttggacaaagatgtggcagctgataggtgtgggagttgttctcatgtaccagcccagtctacaaagttctcagggcaaatggaacacaagttttttctgcaggaagtgatacagcatggtagatcttgaattgagacttctaaaatctttactaaaactttaaaggagaatacaatagtaaaacacagggtatggacaattttagttggcaggtgataaacagaaaagacatatcttggaggtggggggaaaaaaaagaccagttttttttgacaactgcaagaacagcagagttaaacaggggataggctcatgtcagagatccagttctatttactaaaatttccttgagtattcaagcattctgaaattctgagatcttgcaaaaggatgcctttgtttaaactttccttcatctagctacagaacatagttgaactttgaggcctttgaccccagacaagacaaaacatctttcaccttgcctattgcttaacacatatttgttaactatttaaccttcatggataaaaaatttcaaacatctgtattaactaatttgctaatgattgtttcaaatatctgatccatgggtttcttcttacattagttaaatttgttgtaagttctttacatttttaattatcttatatcattggatataattgctaaatctctatatgacatgttgattaatataaagtcaattaaaaaaactaacatgttaaatattgttcttacataatgccaggtataacgctatgcatttttatatatattgcattgtgtaatctaattcctctggaaaacatgcattctaatttctggctccaaagctgtgagaaaacactttgagttctgattgattaagcaacctaacaaagaagtaggagacataattaaaatttgaaaccagcctaagctttgaaactatgagtggtgatgattaccttctccaagttattattaaattaacggcacatttctgagaattgtgaatgttatttcaatggaagtttacagatatgtgtcaaaattttttcatcatttttaaaaaaaatttgtaatgaaatgagaaaagatccaaaatggccataggtctaaaatattttgccctcagaaactaaagaaaatcgttgccacatcctgctctaagtttttcagccataactattcttagatggctgatattttctattccacatggaaaaagacttctcaggcatttgatgaccagacgacagggaaaaagttatgatgttggtggtggaatgttctgctacaggcatttgagaacctcacagaactcttaatattcacttttaattcattccaccagggaggaagggtatgtgttttggagccattcatatatggtttcaaaatttgactctggcatttacctctgtaagaacttgaggaatttacttggtctctctgagctttggtatgtttagaatgaggatgatactaacagattctacatcatgattgttacttgaatgaagaaatataaagtgcattttaaattcatttggtcccttaacattgtcccttcccttgttatcttttcagagtttcttcttgaatggctcaaggactgaagcatcccacaaaatgattctactgaataactcccagaagctgctggttctatacaaacccttggcctggagcatacctgagtccctgaaggtgagggaacagtgagagagtcagaggctttgtgcatgtttctttacctttctgtgcctttaccttcgttcttttcatcaaggaaataggaataatattagcgcctacctcttaaagtttttgtggacactaaataaatccatacaatgtaagtgctaagagcattgccaagtgcccagctagtgcacagtagctctttggtatcagaaggacacctacctgtgagttctgcctacttgatggtgacttcatgtcaatcagaagggtcctagagatgctgctgatctcaccatcactgacttggtcacagtactgtctgttgacttttgtttttctctttctcttcacatccagatctccatctctgaggatcccaggctctcctagtctttccatccctccttcaggtgtatggctctgtgtaccacataaatcacaggaaccccttcaatatggaggtgctagtggactcctggcctgagtatcagatggttattatccagcctcaaaagcaggtaggcacacagatagggacgggtggagccaggttggtccaaagggcctaaggaactgaccagttgagacaccagggctgcttttatagagtgaaagaaaatgtgagtattttaaaagactccttaagtacttcgcaccttgcaagagtgccatgtgttcccacccttcctgtaaagcataagactcatctaggaaaaggggtggagggggtagaggaagaaaatgataaggctgacactcacagactaagggccttttgaggtggcaggggtcacctgcaggggctgagaggaggcaaattgacagggaaagttgggtgtctgagatatcagaacagtgacttagaaacaaaaaccaaagcagaagtctaccagtaaaaatttcctctcagggccaggcatgatgtcttcttcctgtaatcccagcacttcaggaggccaaggcaggaggatcacttgagcccaggaatttgagacccacctctgcaacatagtgagacctcatctccacacacacacaaaaataaataaaaaataaacaaaattagcagggcatggtagtgcatgtttattctcctagctgctcaggaggctgaggtgggaggatgacttgagccccagaaagtcaaggctgcagtgagccaacatcacaccgctgtactccagcctgggcaacagagtgagactctgtcttaaacaaacaaacaaaaaaacaagaaccaggaggttactttgcaggaaccagagaagggaatcataattactgtgtgtcaactatttggaagcaattgtcttgttagtgacttatcattagaacaatctaacgaagtgaccattaatgtctccaatttagagataaggaaatgacactgagaaatattaagtcatgtagctgctggataccagacgttaaagcattgcccaatctgaattaaagttcaaaggactgacggtaaccataggcccttctctgagtttcatcatgtgttaaaatgggaaaaataacaggaccttcttcagaggattacaagacgtttaaatgagatattgtacatcaaagacttagtacatagcacatgattttaaatagtatttaccataattagccattatggtaattggaataaactattaagctgaaataaggaataaactattaagctgaaatagtaatacaaacctgggtctatttttttgccctaaagacttcccctttttgtatgcattttatgcacatctggttagtgaactgaagcctcattgccagcccaacttcatgcgagtataggcgctgagcctccaaatagtaataagccacccgaattcaagactagcgtgcaaactgggtcaggattggaatgcagaaagtgacaaagtgaccctagattgaggaacaaaggggtaaagggggtgagagccaggctgagcctaacaccttccctaaggatgttcttttgatttcctggcttcctgacaatttcggattgaagatgaatgcttagtttatttaatccatggtccaagttcttcaaagtgtgatatgctaaataattgtaggaagccaaatagttctttttacttcactaactttgtatttattatgtgtattttagcatcgtaactatagcatcaaaccataacttcatatatgcattgctttgaacaaggctagtttttataaagtgagtcaatatacaaaaatattgaaatataaaagttccacaggacacatatatgaccaaaaaaaaaggaaagattgaaatatgctgcaatttactttgaattacattcaccttgtctgattccatagtataccatgtttcgtgcagtgttgaaagtcaatttgatcttgaataataactttttagggtgagaaacagaatttatctagaaaaaaatattttttttgttggtttttaatcacaatgataatatatgctgattatacaagggaaaaatttaacatgattttaagaagttaataacctctcacttcccctcccctcctctcctcatttcctaccctttggggtaatcaatgtccttgtgcatattaacatacactgatgatctctcctgtcgtcactttatttatttatttatttattatactttaagttttagggtacatgtgcacaatgtgcaggttagttacataggtatacatgtgccatgctggtgtgctgcactcattaacttctcatttaacattaggtatatctcctaatgctatccctacccccacccccaccccacaacaggccccagtgtgtgatgttccccttcctgtgtccatgtgttctcattgttcaattcccacctatgagtgacaacacgcggtgtttggtttcttgtgcctgtgatagtttgctgagaatgatggtttccagcttcatccatgtcccaacaaaggacatgaactagttcaaccattgtggaagtcagtgtggtgattcctcagggctctagaactagaaataccatttgacccagccatgccattactgggaatatatcctgtcatcacttgttaatttgcctttgacatatgggcatccctttgggaaaatcaatacagaactaatatattcgttttaacaactgtggcattccacagagccaatgcaatgctatttagtcactctttcttctgctgttgggttcaaatttttcacactttgttgcaagtacaaacaatgcttcaaaaaatgtcctcttatatatgtctttacatcctggaaacttttctcaatacaattgatttccaaaagggatgtctccaagtcagaatttattttatcataagtaagccctgccagattaccttcccaaaggattccagttttatttccattagcaatgtgtggaagaattgtttccccacattctcaccggcactgaatgttttccctcttttaacttatgccaaactggtgagtgaaagttggcatcttattgtagatttaatttgcatttccatgactagtgatagtcaacatattgtattttcatatgtttatcagtaatttggggtttacttctgaactgtttgtattgtttcaccatgtttacactggggttttatgtcattcttaaaattctgtaagtgtttttgatactagggatactaacacaaggcgtatgctacaaatttattgcccaatttagaattattttctattttattgatggagattttgacatgaagaaatttttaactttcctgtaatcaaatatgttatatttttcactatgacttcagaggttttgttttctttagttaataattaggaagatttttcctactccaagatcatgcaagtgttttcttattttgtcttacagtgagttaatttttacttttgacatttcaatcttcattctatttaaaatatgtttttgaatagcatgaaataacattcttttatatttttcttccttatggctggctaattatgttattactatttattaaataagtcattccactactgaaacataaatgtctatgttgtcatatcacctttacatatttttgtatctatttctgtatttgtttctagtcttttcttatgctatttcattgttttgtggtaaattttaatatctaataaagcaaatcacccttcaccaatacttttcttactttcctatttcttatacacttaagagccatatgaacaataactaattttcccagttccccaccaactaccccaactaactattgcaattgtggttagtattgtctaaaagacgattgtggaaagattactatttttgcggtactacatcttgtcatctagaaatatggtctttttctcacttttttcagtttctgttctatgccatcttgtaaaatttaagtgttttcctgtagtaaactacatgattttccattaagtttacttttcggtattttatattatttgttaagattattaaattatttttccttttctatttctgagaattattattttgttattgcttttcatttgtatttttgatttccaaatatgtcacactattctttaaaatcctgtttgtgtagggtattatttggttttgttttttgtcaaagtctcttggattttctcaatgcataatactgtaatgtacaaacaaagttatttgctgcttctttgccaatatttgtaagggtttttagtttcttgacttattgcataatttacaacctaaggaaacaataccaactaacaataataatatttttatacttgtctcattcctgattttaataaaatagctataacaacatatatgtagaattgcatttgattctgtctttacatgtttagagcattttcctcttgttcctactttcatagaacttatatttataatggagagtaaattttatattctttcatttttgtcttttctatttggcaacttatatactcatgtaatttttcctcctttaatttatcacactaaaagatcttccaatcaaagccattcaagcctttctaaaacaaactgttcctgttcacatttttttaccttttttttaattgtactttaagttctacggtacatgtgcacaacgtgcaggtttgttacataggtatacatgtgccatgttggcttgccgcacccatcaacttgtcatttactttaggtatttctcctaattctactcctcccccagccccccagtcacccaccccctgaaaggccctgatgttccccatcctgtgtccaagtgttctcattgttcaattcccacctaggagtgagaacatgcagtgttttttttctgtccttgtgattgtttgctgagaatgatggtttccagcttcatccatgtccctgcaaaggccatgaactcattcttttttatggctgcatagtattccatggtgtatatatgctacattttcttaatccggtctatcattgatggacatttgagttggttccaagtctttgccattgtgaatattgccgcaataaacatacatgtgcatgtgtctttatagtagcatgatttataatcctttgagtatatacccagttatggcatcgctgggtcaaatggtatttctagttctcgatctttgagaaatcaccaaactgtctttcataatggttgaactaatttacactcccacccacagtgtaaaagcatttatatttttccacagcctcttcagcatctgttgtttcctgactttttaatgatcaccattctaaatggagtgagatggtatcgcatcgtggttttgatttacatttctctaatgaccagtgataatgagcattttttcatgtgtctgttggctgcataaataccttctttggagaagtgtctgttcaaatcttttgcccaattttgatggggtttttttttcttttaaattggtttaagttcctcatagattctggatattagccctttatcagatgggtagattgcaaaaattttctcccattctgtaggttgcttgttcactctgatgatagtttcttttgctgtgcagaagctctttagtttaattagatcccatttgtctgttttggcttttgttgccattgtttttttgttttagtcatgaagtctttgcccatgcctatgtcctgaatggtattggctatgttttcttctaaggtttgtatgctattaggtcttacatttaagtctttaaaccatcttgagttaatttttgtataaggtgtaaggaagggatccacgttcagcttcctacatatggctagccagttttcccaccaccatttatgaaatagggaatagtttccccatttgttgtctttgtaaggtttgtcaaagatcagatggttgagatgtgtggtgttattcctgaggctagggttttgttccattggtctgtatatctgttttggtaccacgctgctttgattactgcagccttgtagtattgtttgaaattaggcagcatgatgcctccagctttgttctttttgcttaggattgtcttggctattcttgctcctttttggttccatatgaacttcagagtagttttttccaattcagtgaagaaagtcttttgttccttgatgtggatggcactgactctataaatcaccttaggcagtatggccattttcacaatattgattctttctatccatggtcatggaatgttcttccatttgtttgtgttatcttttatttcatggagcagtgatttgtagttcttgaagaggtccttcacatcccttgtaagttggatttcaaggtattttattctctttgtagcaattgtgattgggagttcacccatgatttggctctctgtttgcctcttattggtgtagaggaatacttgtgagttttgcacattgattttgtaccctgagactttgctgaagttgcttatctgcttaaggagattttgggctgagacgatggggttttctaaatatacaatcatgtcatctgcaaacagggacaattcgacttccttttttcctaatcgaatacctttcatttctttctcttgcctgattgccctggccagaacttccaacactatgttaaataggagtggtgagaaagagcacccttgtctgtgttggtttccaaatggaatgcttccaatttttgcccgttcagtatgatattggctctgggtttgtcataaatagctcttattatttagagatacattcgatcaatacctagtatattgagagtttttatcatgaaaggctgttgaattttgttgaaggccatttctgtatctattgagataatcatgagatttttgtctttggttctgtttatgtgatggattatgtatattgatttgcatatgttcaaccagccttacatccaaagtatgaagccgacttgatcgtggtggattagctttttagtgtgctgctggattcggttcgccagtattttattgaggatatttgcagcgatgttcatcagggatattggtctaaaattctctttatttgttgtgtctctgccaggctttggtgtcaggatgatgctggcctcataaaatgagttagggaggattccctctttttctattgattggaatagtttcagaaagaatagtaccagatcctctttgtacttcttgtagcattcggctgtgaatccctctggtcctggactttttttgttggtaggctattaattattgcctcaatttgagaacctgttattggtcaattcagagatacaacttcttcctggtttagtcttgggagggtgtatggttccagcaatatatggatttcttctagattttgtattttatttgcatagaggtgtttatagtattctctgatggtagtttctatttgtaggattggtggtgatatcccctttttcattttttattgcatctgtttgattcttctctcttttcttgctggcgttctatcaattttgttgatcatttcaaaaaaccagctcctagattcattgatttttttgaacggttttttgggtcactgtctccttcagttctgcgctgatcttagttatttcttcccttctgctagcttttgaatttgtttcctcttgcttctctagttcttttagttgtgatgttagggtgttgactttagatctttcctactttctcttgtggacatttggtgctataaatttccctccacacactactttaaatgtgtcccagagcttctggtacattgtttccttgttctcattgatttcaaagaacatctttatttctgccttcatttcattatttacccagtagtcattcaggaaaaggtttttcagtttccatgtagttgtgcagttttgagtgaatttcttaatcctgagttctaatttgattgcactgtggtctgagagacagtttgttgtgatttctattcttttacatttgctgaggagtgttttatttccaattatgtggtcaattttagaatgagtgcgatgtgatgagaagaatgtatattctgttgatttggggtagagagttctgtagatgtctattaggtccacttggtgcagagctgagttcaaatcctggatatccttgttaactttctgtctcattgatctgtctaatgttgacagtggggtgttaaagtctcccattattattgtgtgggagtctaagtctctttttaggactctaaggacttgctttatcaatctgggagttcctgtgttgggtgcatatatatttaggagagttagctctccttgttgagttgatccctttaccattatgtaatagccttctttgtctcttttgatctttgttggttgaaagtctgttttatcagagactaggattgcaagccctgctttttgttgttttccatttgcttggtagatcttcctccatccatttattttgaggctatgtgtgtctctgcatgtgagatgggtctcctgaatacagcagattgatgagtcttgattctttatccaattttccagtctgtgtcttttaattgggacatttagcccatttacatttaagggtaatattgttatgtgtgaaattgatcctgccattataatgttagctggttaatttgcccactacttgatgcagtttctttatagcatcaatggtctttataattgggcacgtttttttctgtggctggtaccagtttttcctttccatgtttagtgcttccctcaggaactcttaggccttgtggtaacaaaatctcttagcatttgcttgtctgtaaatgattttatttctctttcacttatgaagcttagtttggctggatatgaaattccaagttgaaaattcttttctttaagaatgttgaatattggcccctactctcttctggtttgtaggttttctgctgagagatccgctggtagtctgatgggcttccctttgtgggtaatccaacctttctctctggcttcccttaacattttttctcatttcaatcttggtgaatctgacaatcatgtgtcttgaggttgctcttctcaaggttgctcttctcaaggagtatctttgtagtgttctctgtatttcctgaatttggatgttggcttgcctttctaggttggggaagttctcctagataatatcgtgaagagtgttttctaacttggctccattccccccgtcactttcagatacaccaatcaaacgtagatttggtcttttcacatagtctcatatttattggaggcttgtttgtttctttttactctcttctctcactttgtcttctcactttatttcattaatttgatcttcaatcactgatatcctttcttccacttgattaaattggctattgaagcttgtgaatgcatcaagaaattctcgtgccaaggttttcagctccatcaggtcatttaatgtcttctctacactctttattctagttagccattcgtctaactttttttaaatgttcttagcttcatttcaatgggttagaagatgctcctttagctcggagaagtttattattaccgaccttctgaagcctacttctgtcaactcgtcaaagtcattctccgtccagttttgttccattgctggcaagaagctgcaatcctttggaggtgaagaggtgctccagattttggaattttcagcttttcttttctggtttctccccatctttgtggttttatctacctttggtctttgatgttggtgatctacgatggggttttgctgtggatgtcctttttgttgatgttgatgctattcctttctgttgttagttttccttctaaaagtcaggcctctcagctgcatgtctgttggagtttgctggtagtccctctataccctttttgcctgggtatcaccagtggagctggcagaacagcaaatagtgtagaacagcaaatattgctgcctgatccttcctctgaaagcttcatcccagaggggcaacctcctgtatgaggtgtctgtcagcccctactgggaggtgtctcccagtcaggctacatgggggtcagggacccactttatgaggcagtctgtctgttttcagagctcaaacaccatgctggaagaatcactgctctcttcaaagctgtcagagacatttaagtctgcagaagttgtctgctgacttttattcagctacgccctgcccacagaggtggagtctatagaggacgtaggccttgttgagctgcggtgggatccgcccagttgaagctacttggccactttgtttacctactcaagcctcagcaatggcggatgcacctcctcctgtcagactgcagccttgcaggttgatctcagactactgcactggcagtgagaaaggctccattggtgtgagacctgctgaggcaggcacgggagggaatctcaaggactgctggttgctaagactgtcaaaaagtgcagcatttgggcagaagtgtaccattttcccaggtggagtctgtcatggcttcccttggctaggaaacagaaataccccaaccccttctgcttcctgggtgaggcaatgccccatgctgatttggctctccctcaatgggctgtgcccactgtccaacctgtccctatgagataaaccaggtatctcatttggaaatgcagaaatcactcatcttctccatctaactttctgagagctgcagactggaggtgttcctatttggccatcttggaagtgctcatgttcttctgatatactactgaatattttatgcagaatttttatatatgtattcataagagaatatggtcaataagtctctttttgttatttttttaacagatttggcattaggaacttttcttctgtttccaaagcttaatattaaaattatgtgtttgttttggcttgtgtacaatttaaatgaaaaataatctgattttggctacttcttattttttaattttaatttttttctttagatacaagtggtccatatgcagattttttacatgtgaatattgcatgatgctgaattttggagtacggaccgatcccatctgcctggtagtgagcatcgtacccaatagttttctaaccagcccctctgtctctaccctctagtagtccacagtatctattgttcccacatttatgtccatgtatgatcaatgcttagctgtcagttatgagtgagaacatgtggtatttggttttctgttacagcattaatttgcttaggattattgcactgtggaaagtagtctggaaatttcttagagaaattaaaacaaagttaccattcaaccaaacaatgccattagtaggtaaatagccaaaagaaaatgaatgattctacgcaaatgacacatgcatttgtatattcattgctgcactgttcacaatatgaaagaaatggaatcaacccagatgcccatcaattgtagactggattaaaaaaacgtggtatatatattcctgtggaatactacagaacaacagaaaagaataaaatattgtcctttgtagcaacatgggtggagctggaggccataatccttgtccaatttttaaacggtagattttaaatttaatttctcatattttataatagtttgttgaggttttctatgtttttgaaagtcaattttgatagtttatttttgagggataacatccatttcttttatcaataaatatgttgcctttgagtagtatataatcctctattataatttttttgttcttttctctgtttgcattctcatctctcatactctacgcttatttttttatttttgttttttctctgtctctcgtatttccttaaaataccttaccagaagtttatccctctctctcttctctttctgtttttgccatttaaaaatgaactctggtttttatatatcctttatactatgtcttgttttccatttcattataggtagctttcatttttatagatggttccatttgttttcttctagtttactttgataatctttttataattccttgaatatttacttggctattttcagtcatttttaaaaatctggtcttttaaaacatctactattttaaattcatggaagttttggtttcggccatattcaggaacttcctttcataaaaacactcgcaaattcttgaagttttctttaaaattagtcacactattttctcttttttctaaaataatattcactgctaaaactctcatacttattgtttatatttcacccaagaaacagaaattcatcttcccatgaagtttgtggcttgccagaaggtgatcaccagtctatttttttaaacccataagtctaacaccacataaattacccagagtgctgccaaaatttcagctatttcattctattttgtgggcttctggctttaaagacagtgtcactctttcaataggctgatatcctgtaggcttgggaaaaggctgtgtctcattaatgtttatattcactaaagcatcttgcccaagccctggacactagattctaggacactatagattctaggtgtctggtgaaacagtaggcactaacatttagataattcacagctaaatttattttgagccaagtttaaggacttaatcctagagatacagcctcagtacatcccaggatgtgtcacacaggaggttacgtgggggcacagtatatataacagggggatacctgtggcccaggaggtgagaaaagcagggagagaagcaactgatgcaatctgattctgctgggttctcggtgatgctatatataaaataaagtaagtgtgcaattgagtgagtagggagaaaggtgaggcatcttaaggcctggtggaaggtggctgatttcatcctgtcttctttctggatctgataagcagttttataaccagtacctgtcactgaaatatttaacaaactccagttacgcaggcaagaggtcagcagtagcttataagcctaggttttattatccgtgtgcccacctgcagccatcatgggccactggtaaaattttcttttgaactttcatttttctgataattgcaatcagtgagaggtgaagaaaaagttcaattgaatgatctgaactttcaccatcctaaacaggagatgactgatgacgtggattcatacacaaatgtacattgtatgttctccaaagagactaaaaaatcacaagaagttttgaaatatgtgagatcataaactggaaacagatactccaaatccatgataacaagtctgaagaaatgggcaagcagctgttcttctcaaattgagtcatcaactaatattattagcatcacctgagagctcaatagaaatgtaaatttacaaaaactctggggactgggagaagtagagcaatctgtggtgtgacaaagactccagcagattgtggtgtaaactcaagtttgataacgactaagcattgatgtattaatcaggtgggagcagtgtaagtagagaactccatgtctgacaatattgctttcttggctttcttcccaggtcttcaagaaagtttaggtgaggggataagagtggctgcattttcaaagtcactgaaggtagagcaatcaagagcagtcctctttattatggagaatatcctgaagttccatgactccaataaaagcaagctggaagctgagctgagtcaggccacccagatgatgaatttgagagacaaaaacatgtgctggtcatttataattgctattccttgtacatttttgttattcacataagtgagttttggaatgaaaagaggatgaattcatgctttgggatgaataaaagttgtcaatggtcaaaatacacagcttgcaatggtgggtcattagacaagaagagtccctgggatctctagaatgtgatggcacccagaaattacaggggtgaggatgaatgttgttgtctttctttttgttttctatggtgaaactcccaactttaagaatgccctgttggttatctcttattcagggctggtaaatgataactggaggtgcaggaagaatgagaggagctggcgttacatcaagcactgtataggaggcctgccagcagcctgtatgctgggtccagatggggctccggtatcatgattaaccttggactcttcttgtgatgtaggaatagcctacagcatggaaaaataccaaagggcagacgacatggcacgggtgatcatgggattcatgaaatatctgcatcagaataatagtccattttacttctcttttctagaagtaaatgatgactcccacagatttgtggggcagttctgttcctttgaggccacgtgtaagtaccaccaatggacctgatacccggagaatctagttccattttagacaatgaagctacctagctatcttgtgcaagccatctcttaatatatccgtagaagaaaccatagaataggtttcttcacttacaaatgtttattcggcatttatgatatgccaggagcttttctaacatagagacttgatgttagaagacacagccatgctcttgtggaacttacaatccaggctggaggcaggggagagtatagtctttaaatatgcataagtgtagtagggaaggacgggtttagtagtaaacatgtaactagaaagccaggctcagttcttacctcttagaatcagaactctttatgaaatgtggttgacagaatctgctatctggaagataaatgaaggactttaataaaattgtcattagaatatacctaatctatatggatactttattggaaataaataaccctgatatatatgaattgaggcaatggctacactaaagaatggaatcagtctctttgtttagtgactagcaaggtatcaaagtaaagtctcagacaaatggctttcctaggctacctttcatcattgttacgcagaaaaggaaatctagagaatcaagtggactggccttggggcctctgctatggaaataacatttgttgtgcctcctttctcctactctttctcacttcctcatcattattgaagcatggcacagggcaaggtgttgcatgtgaatctggttataagttcagcatttggtgtttgccactgctatcttaaagggtcacgggcattccaggggaagtgaccactaaggtgaggactggagagtgagtaggagtgagccagacaaaaaaagcggaaaatctagatgatggaaaggacacatgccatgcactatcattagaactttctatttgagcgcttatattacaattctgaatcgctgatcttaaaaacaattacacttcatgatcaaaaggtggcctcctttggctctggtcttccactctgccattcatatttgccattggaactctgctaacatggtgaaaccccgtctctactaaaaatacaaaaattagctgggaatggtggtacatgcctgcaatcccagctacttgggaggctgaggcaggagaattgcttgaactgggacctgggaagcagaggttgtagtgagccaagttcacatcactgtagtccaccctgggctacagagtgagactctgtctcaaaaaaaaaaaaaaaaaaaaaagaaagaaagaaagaaagaaaaaaattggaaggcagaaggaaatgtgagtgcagaagagaagaatgtgatgcgatgatgatgaaagcagagagataaaacatgatgtgattcagagacccaagctaaggagtgaggacagcctctatgatctggaaaaggcaagggagctgatttacccacattgcctccagaaagagctggccctgccaacatgtcggttttagccccataaatcctattctgaacttccgactgccataaatataacacattgtgttgctttaagtaatcatatttatcataatttgttataatgacaaaagaaaactaatacatcatagacataagaatcatcttgaaaatttaaagttaagctttaaatttgcaactcaacctagcaaccccttgtgataaaaagcaagtaagaaaaccaaattttcactcctagccacaaaatttaatttagctgagcatctcaaagctcctcagagggtactcagaataaaaagcaatttttttcatcaaagaagtcatcttcatttaagaaagtgttgctataaagggttatcttgacactaatgattggcattgggtgattttaattctgagatgtctgtcaccataaatgaaattatgagaccataggattgagcttctaattttctgtaagaatacagaggaagaggagggtaaaaatgttaagggtgagcttaaataatacccagatcctggataatcaggtgtcttttgtgctaatgtacatcatcatatttgtgtttgaattaatgattttctactgataagatttgaaatggacagtggaactaatcaacaatatttcttggggatgcatttccactgatgccagccacaaggtcaaatcttaaacccaacatttttcagtgcctgtaggattttctcactattatctgccgcatgagcataaaatgggatttctttctgagaaagataactttcaagatgataaccaatttgcgacatgttgccttggtttctgtgtttggggacagtataacccattctcaactcactggactgtcccatcacaagccaagagacaagctgtgcctctggacccagcacaccaaatcctagaaaatcctggatgcagcgttcaatatatttaaagctcctctcatttttcccaaaggcccagtgttcatttacaagacctgcatgtgaaacacctaagaacatgtttgaaaagtttccttccctatgaagaaaaaaaaaattacctttattcagccaatattatcaaacactgaaattccaataacaccattcctttccttaaggatcctacagcctagaggaggcaatagctgtattacaactaccttttctattcctgcttcaaaatgtttccaaataattggtgggggaacaccgtgttttatggtgtatttaatagcagacagataatatgatatgttataggacatctcaaaatgtcccgttaagtatcctaaggaagaaaatgaacacgtctttaaaagagtgaggatatagaccagagaagccctccacgtggctgaatttacttgaaagatgcgtgtatgaaatcatgtgcattttgagttctactccacaaaatatctaaatatacaagatagtaattcgttgaacagatattccaatcaaacatattttacaggaagatgagaacaatgctgatcttacatcttcatgtgtcccaaagcctgtcatcacatacccagaaacgcagtttaagaagctgcaatataggaaaaagaatactaaatttttggtactaacctttgggattctaatcctgattattttcttttggaaaagttatgtaagactcagttttcttgtttgtaaaattatagtaatatcctctgtaaatatggaaatagtgaaagagagaagatctccaggaatttttgcccctctccagggaggaagacttttgagaagtttgtcagtttcagagtcacttcatgtttgccagtgggtgggtaacagaacgctaagttttctatgggtgatgctttgtttttgctcacttccatgcctaacctgatcctgggcttgcttcctgaaagatctcaagtacgctttcctgcacccctctcctgtggatagccaaacctagaatggcaagatataaagatatccatgcgtaggcttagaggaatcaccttagggcaggtacttcatgccagacttccagagttatactactaaatataatttaatccccatttatcattgttccctgtgtatatgttccccttaacaatctcatgggaacactggtggggcaaagcagtatttgaagactgttaacttttctggctaaatcaaacatatctgtgaatgtgtgtttaaattctatttattttttcaattagtaacaaaattattaagcataaatggattactagaggaaagcaaatctctcttctttctctgatctcctattacccaattactttctctagaagcaaccactaataccaatatattttgtacaagtttcccataaatctatgcaattttagatatgtacatacatttgtttattttcacaaatggtagcatactatatacattgttctatccacctcatgtttttttacatagcaaactattttggaaatattttctaatctgtcatgtagagctgcttcattctttgtaatggcttcatagtattctaatgttttaatgtaccataatgattttttctatttccccattactggatgtttaggttgtttcataagttatgatatcacacattaaatttatgaaaatcttaccatccagtttagaaatatcattcatttattatgcatagtctttgactcaacagttttaattctggtaattcatctttcagaaatatttatacaactgttcaataatctatttatgatgatattcatttcagaaagtgccgtaaattatgtgtacatattgcaaaaataaatacataactcatatggagtactaaaagcatacatatcagtgtcaaaattatttacacctagcaggggaacccaagaggacagattttatttttcattttgtatgcttatatactttctataagcatgtagcattttgtaagatataaatagtttcagtaaacattttttgatgccaccatgatgtccattgccctctccgaaggactcttgtgagctctaagtgaaataatatgcataaagaccttgtctaatgaaggctctgttcatgctcagcacacagttcctaacgtgacgccctttctttacccatgcaattttgtagcccatcataatttagtctcaaattctacacttccaagtacagcctttgtggcaactcaataattctatcaaggaatttgggaagtaaaacgtaaaatctcacttcttatcatcacccattttaaataaccccatattgtcattacttgcagtcttgtgtttctttggtaattccggtataaagagcatggttttcatgtaatctacctgcactgattttgaagttgcaacctttcttattgcttcatccaagccctcctgtcaacctggagagaggagaaagacaggtactgctttataccttccatatcagctaggaataaaccacgcatcttttcttttaactcagactagttagattggatctggaaagtttgctcccagttgataacctcggagcgtgacctcctctaagttgtcaggagctttggtgaagatgtggtaagagttggtgtaatgatcccagtcattttttatctccagatacaacaaatatcatacatagccctacaattacaaaatactcttgcataggcctagaatactagagattaacttgtttgaaacattctgtttttctaagataggtgtagaaaatggccttgcagtcgctccaagaataactcactatttatacactgaagatagtgtctttcttttagggcactaaagtgagctgcccttgagagggtgagtaaatagctccattgtctcgaatgggaagtgtaaccaaaatggtgtatgttaaggatttaaaagagaaggtgcctaaggtatggaaaaaatataagaaacaggtttggcaaggctccgggtttttggcaaggtgacacctgagctaatcctaacccaggaaggactctgaggctggctcagtgattggctcttggagtacatgtgaatagataaacttttggaaagaactaacattccagagccagatagtacctagaatagacagcttggtctggctctacatgtctgcctaccctctgctgatgacacttccacttgagagtcctcgcaggtgaaaacacttcttaatcactttcagccatagaagtctaggttgggatgtagtcctatgatcagaattttgatggaatagactgagtgcttggaatcctaattttatttacacatccagggttattgatcactggatctaagttcaagccttatctcactgccctaccctctctcccaaacagcccttccaaaacctgcatacgtcaacagtgtcaacattcttctcaccactcctcagtttcagttccctcattgccacacagagaatgtctggagagtgactgccctggtattcagtaactattgctcctacctggttctgaggctgagtaatgatgatctggtaatctgtccaggcatctaccatcacctccattttgaatgggtttttatgttttatgttgaaaatggtgctgtatgcctataatgcaacagaacaaaacagtaggggatgaagtttttctccaatgtaaagtcttatatgaggcatgggaaataaggacaagaagcctaggaggacttaggatggggccagtgcttccaaggtggttcattgggctactcattgagagttatgttgcaaaagggaccaataagcatccacaaaaatccatgttaacacccgaatcattaggaactggcttcccttatattcattcattttttaaaaattcatgccatttcacattgtaattgtgaaatgtgtgaaaagttcacattgtaaatgtgtagcagatctttaatggcttggtcaacacaaaatattggctacaatcaattacaggtggtaatatatcctgaaagattaaaattagaaaaaaaaggtccagaaccatcagggccatttggggctaaaaccaggatggccacctcctcctcagccgagtgagtgctggaggagggagcctgaaactaggctcactgtgactcatttgtggcacccattattgcccaacctgcagttcactatggtgaaggagcaattcagactcaccctgcagcatcccgtctgggtcaaacagtggctgctccctaaggaatagttgggggcgctacataaagtagtttaaaaactattgtaaaaaggacatgtttcaccaatgttctttccttagattctccagtgtttgtaattcataaaaattccagccgatggggcatgctgaccaacttaagagctgtcaatgcagtaattcaacccctggggggctctctcaactgggttgccctctctggccataatccccaaagatttgcctttaattataattcatctgaaggattgcttttttaccgctcctctggcaaaacaggattttgaaaaatttgcttttactataccagccataaataataaagaaccagccaccaggtttcagtggaaagtgttgcctcagggaaggcttaatagtccaactatttgtcagacttttgtagctcaagctcttcaaccagttagagacaaattttcagactattatatcattcattatgttgatgatattttgtgtgctgcaaaaaccagagacaaattaattggctgttacacatttctgcaaacagaggtttaaaacacagggctgacaatagcatctgataagattgagacctctactccttttcattatttcagagtgcaggtagaggataggaaaattaaaccacaaaaaatagaaataagaaaagacacattaaaaacattaaatgactttcaaaaattgctaggagatattaattggatttggccaactctaggcatccctacttatgccatgtcaaatttgttctctgtcttgagaggggatccagaattgaatagtaaaagaacattaactccagagacaactaaagaaattggattagttgaagaaaaaattcagtgagcacaagtaaatagaatacatcccttggcccaactccagcttgatttttgctactgtgcattctccaacagccattatcgttcaaaacgcaggtcttgtggagtggtccttccttcctcacagtacaattaatacttttacattgtactgggatcaaatagctacattaattggtcaggcgagattacgaatactaaaattgtgtggaagtgacccagaaaaaatcattctttctttaatcaagaaacaggttagaaaagcctttatcaattctgcttcatggtagattggtcttgctaattttgtggaaattattgacaatcattacccaaaaacaaaaatcttccagtttttaaaattggctacttggattttacctaaaattaccagacataaacatttacagaatgctctgatggtgtttactgatggttccagccatggaaaagcagcttacatcaggccaaaagaacgagtcattgaaactcaatattactcagctcaaagagcagagttggttgctgtcatttcagtgttacaaggttttaatcagcctattaacattgtatcagattctgcatatgtagtacaggctacaaaggatggtgagacagccctaatcaaatatagtattgatgatcagttaaaccagctgtttaatttgttacaaaaacactgtaaaaaaaagaaatttcccattttatattactcatatttgagcacatattaatttaccagggcctttaactgaagcaaatgaacaagctgactagctagtatcatctgcattcatagaagcataagaacttcatgccttgactcatgtaaatgcaacaggattaaaaagtaaaattgatatccataaaaacagccaaaaaatattgtacaacactggacccatgtcaagtcctaaacctgcacactcaggaggtaggagttaatcccagagttctatgtcctaatgcattatggcaaatggatgtcacacatgtactgtcgtttggaaaattgtcatttgtccatgtgacagttgatacttattcacattttgtatgggcaacctgccagacaggaaaaagtacttcccatgttaaaagacgtttattatcttgttttgctgtcatgggagttccaggaaaaattaaaacagataatgggccaggatactgtagtaaaacatttcaaaaattcttaaatcagtgaaaaattacacatacaacaggaatcccttataattcccaaggacagacactagttgaaagaactaatagaacactcaaagctcaattggtgaaacaaaaaaaggaaaaagacagtaagagtataacacttggtgaaacaaaaaaaaagaaaaagacagtaagagtataacactccccagatgcaacttaatctagcactctatactttaatttttttaaacatttagaaaaatccgacaagtacttctacagaacaacattttactgataaaaaggacagttcacataaaggaaaactgatttggtgaaaaaataataaaaataaaacatgaacaacaggaaaggtgataacatgggggagaggtattgcttgtatttccctaggaaaaaaacagcttctagtttagatacctacaacttacagaagaagttgccatccagcaaggaagtggagccactgacctgggcccagttcaaaaagctgacacagtatactgaaaaagcctgaagaaaacaagggtaatgtgaactccagagaatatactgcttgcagctttgatgactgtatcaatggtggtcagtctccccatgtcttcaggagcagctgcaacttattatacttactgggaccatgtgcctttcctgcccttaattcgggcagtcacatgaatagatagtcctactaaagtatatgttaataatagtgcatgggtaccaggccccacagatgatcgttgccctgccaaacctacaaaaagaaggaatgatgataaatatttccattggatatcattatcctcctacttgcctagggaaggcacccagatgcttaatgcctacaacccaaaattggttggtagaagtacctactgtcagtgccaccagtagatatacttatcacatggtaagtcgaatgtcactcgggcaacaaataaataatttacagtattcttcttatcaaagatcattaaaatttaggcctaaggggaaggcttgccccccaaaaattcccaaagaatcaaaagacctaaaagtcttagtttggaaagaatatgtggctgatactgcggtgatattacaaaacaatgaatttgtaactattacagactgggaccctcgaggccaattatattataattgtatgggccagactcactcatgttcacaagccccatccatctggcccattaatctggcctatgatagtaatttaaaaagctggaccaggtttataaaaggtgaaaatcaccctatccattaaaatggagtaaaaagagaatttcctcacctcgaccaaagttaattagtcctgttactggtcctgaacatccagaatgatgaaagcttactgtggcctcgcaccacattagaatttggtctgcaaatcaaactataggaacaaaaaatcgtaggccatattatactattaacctaaattccaatctgacaattcctttgcaaagttgtgtaaaactcctttatatgctagttgtaggaaacatacttattaaaccagattcccaaattgtaacctgtaaaaactgtagattgcttacttgcattgattcgacttttgattggcagcacagtattctgctggtgagggcaagagagggcgtgtagatccctgtgtccatggactgactgcaggaggcttccccatctgtccatcttttagcagaagtattaaaacgatttctaactagatccaaaggattcatttttactttgattgcagtgattgtgggtcccattgcagtcacagctactgctgcagctgctggaatttctttacactcctctgttcaaactgcagaatacgtaaataattggcaaaagaattcctcaaaattgtgaaattctcagacccaaatagataaaaaattggcaaaccaaattaatgatcttagacaaaccgtcatttgaaaggaagataggctcatgagcttggaatatctttttcagttacagtgtgactaaaatacatcagatttttgcattataccccaagcctataatgagtctgagcatcactgagacatagttagatgccatctacaaggaagagaagataatcttactttaaatatttcaaaatttcaaaaacaaatttttaagacaacaaaagcccatttaaatttggtgccaaaaactgaggcaattgtaaaagctgctgatggcctcacaaagcttaaccccgtcacttaggttaaaaccatcagaagttccactattgtaaatttcatattaatccttgtatgtctgttctgtctcttgttagtctacaggtgtatccaacagctccaaagaggcagcaaccagcgagaacgggccataatgacgatggcagttttgtcaaaaagaaaagggggatatgtagggaaaagaaagagatatcagactgttactgtatctttgtagaaaaggaagacataagaaactccattttgacctgtaccgtgaacaattgttttgccttgagatgctgttagtctgtaactttagccccaaccttgagctcacagaaacatgtgttgtatggaatcaaggtttaagggatccagggctgtacaagatgtgccttgttaacaatatgtttacaggcagtatgctgggtaaaagtcatcaccattctccattctctaggaagcaggggcacaatgcactgctgaaagccgcagggacctctgcccaggaaagccgggtattgtccaaggttctccccacgtgatagcctgagatatggcctcgtggaatgggaaagactggaccatcccccagcccgacatacgtgaagagtctgtgcagaagaaggattcatagaggaaggcctcttgcagttgagataagaggaaggcctctgtcccctgcctgcccctgggaactgaatgtctcggtataaaacccgattgtacatttgttctattctgagataggagaaaaactcccctgtgtcgggaggtgagacatgctggcagcaatgctgctctattactctttactccactgagatgtctgggtggagagaagcatacatgtggcccacgtgcacatccaggcatagtaccttcccttgaacttatttgtgacacagatttctttgctaacatgttttcttgctgaccttctccccactatcaccctgttctcctgccacattccccttgctgagatagtgaaaatagtaatcaataaatactgagggaactcagagaccggtgctggttcgggtcctcagtatgctgagcaccggccccccgggcccacttttctttctctgtactttgtctctgtgtcttatttcttttctcagtctcttatcctacctgatgagaaatacccacaggtgtggaggggctggcctccttcataagtatatagccaaaatcaatacaaatggaagcaaagtggttaacaacatgggctttggaatcaaacaaaccaaaattccacccctggctcctcttctggctatctgggtcaccttaggtaggtcaaattatttgagcctctctgcctcagttgcattatctataaaatggggatagtaatatctacattgtaggttgtcatgaggatttccttgccagaaaaggtgtgtgaagtgtttagcatggtggtaatttgtgtatatacaaggttctgaaggaaattttaaaaacctttaaatccagtgaaggtgaccattccactggacagaaacataaatgaagaaaactgcagcttcaaagatggactatatgtaagttgcttgaataaacctattggcacaaaatagacattttgaggcaaaccacagatctagaacaagctcatctgtttctgtcactgtctaagatcatgggtgcagtaacaaaatggcacagaaatctgcgcattctgcagactttggtagcatatttccccagaggagagtaatctccttggtaagtgatattatgtcttgctctttattgtgactcaagcatcaagctcagcacttagcatagtggaaaaattaataagcttttgttcagtgaatgaacaaatagagtcagtgaaggttagaaatgtggtttttagaatgcttttcctcaaagactgagcattaagtctctttgctcctggcatagccaagtttctgagaaaacacgtggctgctaacagaaactttcaaagcagaagaaaatgctttatagtaggtttttttgcaatgaatattggatatgtaacctatagggggtgcacaaaaatgtggattaaaaaaaggttgtaaatggcctgttgcctctaccaatagcatatgctctcccacccgcttccatttcaccgttagcttccctccatggctggactctggttctgctctcaccaatgagagacacctagtttcaattcactccaaggtgccaaggcagtagaaggtttatgggtcaacatgatgcaatagtctaatataatataatatattcttcaatatattataatggaggattataagagagtgactattggatcaggtgttttttaacaaaatcgagaggaaaaggagccagtagaagagatcggaaacatggcaaaaaaaaaaaaaaagaatgtgaaaaataagagaatgaccttggaagtcaaaataagagaaaccttcaaggaaagagtgaccaaagcagtcaaaggttgctgagaagctaaaagagatgagtactaaaggcggcagtgcattttgaagttaggagttgattaccgactttgtaagagacatggacaggagaagaaatcagattatggggattggagactaaatgaaatgtgaggaagtgaaggtaactttttgaaagagcttgaccagaaaagaaagaagaacacgagagtatcaaggggaagaagagaggtacaagagctcaaagaaaggcatttctcttattagatgagagttaagcatacctatactaactacaagaggtaagatgtaagtcattgataggccaatgtgtctaacaggacatagaaaggtgacagaaattcaatgaccttatgtacaaaatgccagccactatttcagcttatttatgttgactaattcatgtaatcatcaaccataattatcagcatacttgttaaattaagttttgaacaggaagaatacttcttccagtgagaagtcaaaaaaatttaggatggatgcagatgcaaatgtatgtatgtaggtatacagcaggtcatcaaataatgtcattttgttcaatatcttttcattataatggtgaagagaaaaaaaacagttcctggctggaccactgtctatgtgcagtttgcctgtcctcctcatgtctgtgtggactttctctggataatcccatttcctctcacatctcaaaaatgtgtacattagtatattgacatgtctaaattttcacaggatgagtgtgtttgtgtgtgtgtgagagagagagtgtgtatgtgtgtgtgtgcacgtgtgtccccaggatggaagggtttccagtccagggtgggttcctgccttgtgctctgagctaccaggataggcttcagccacttgctccgctgaactgcaataaggcagttgaaaaatgaatgaatgaaacattcataataaaacaaaaattcataaagtctatgataatgatacaaatgcatgacaataaacaatgctgtgcaaaaggactcagcgagcccatcatatttgtgatggatttttaaattcatagatacaagagttgcttcttacaccttttgctttgcaaacatttatttctcaatttaactcaccaccactgtgatcaccatcacacatcaacgcaacaaaaatcaggtaaataattatcttacttgtttgtatcaatatttcttaaatgtatatacagcttacatttattgcattgttttatattagaagtgcttcagttctttataagtttggtgatgtttttgtcaccagaaatatgctgtaggaacttaactcttctttatattaattagcttatggtaaaaataattttgatatgtgttgtttcatttgatgttgcagtttccaagaacctattgacaatgttaagtaaggactaattgtatacaggagtacacagggttagaaaaaaggagcatagagttggcaagttatttttgaatgtctatttcctggaagaggtaaaatttcttcctattcccaaaatcactttttagaagtgagtgggtgagggagtatgccaagaaagtgttcagaaaaagaagtaggatgttaggggaaatggttagggtataaatggcttttgatgttaatgggagaaacagtggactagaattagcaaggactggcaagcatgcttaggatcatgtaaagagggacaccatcactggaagtgttactcaacagtatattaagctcagcaccctaaaagtagaagcacagaagacaaattaaaacaaaccaagattggctttttcagggctggataacaaaaaagataagggacaaagcatttgagaacatagtaatgagggattgaaactcacatctaagatagagaagaaaaaagtaaagtaggttggagaccaataaagtgagaaaatatagaaaaagcaagggacgaaagtacttgatgaagtcaaagaatagcaatgttaatagacaggggaaaatgtacttacaaataggagactggagtcagatattaggctattagaggttgagatttcagaggtattcagaagtagatcagtttggcatgtatgactgttggcatcaactccaagtcaatagagtaggagccaagaagggaatgggagcttcaggtatcacagacatgaacaggatgtagcagaagttggctgaagagaaaaattaggatgtcaggtgccaaatatttcaacgaatgcagagaaatttggcagagggcaacagaaaagcattgttttattccagccacatgacacagaaggaagaaggaagatttttctatgcaaataagtaatactctagaagcaggattggaggcaaggagaatactgattttttttctttttggtaactatattaccctggagatctagaggttgttagagaaatgtttaagcatattgataatttataattcaaggaaagcatttggacattttacaaattcaaaaggctacacactggctttttctaaagtattttccagcttcaggtacctaaaaggttttgaagaatttgttctcaacattgagaccctggtgagtgctcattccaagggttttcaggggaaaagaaataaattaacaaatacaaatgattgagaacaagaatcctaattaattgaaatgccaagaaaaaaaggctgttctaaacaattctgcttacctgaagtttctttgcagagctgtaggcacactgcctgctgcacttgctcagaatggcaatggaaaggtttctgtagctaacactctatggactcagacacactaaaattcaattgactcacgctgtcactgtttagcataaagcttcaggaagttatgggttcctgtagattaaaccagatgttctgtccgtagacaggaagtcagaggctttgtggaccagaggaggactgagaccatgttctgtattgagcagcctctacaattataagaagttttacacaagaagcttttgatttatacataacttgttatagctgaaagagtattctagaacaatattaagtcaattttctagagttggcaaaaatagcacagctgcagccttatttaaaacaagttagcagagcaaacaaagagttggaaagtttggtttcaaggcaaaatacctggcctaatactttcaaccatttgtgggttggaaaaagacaagaatgcctcaagaaagttactgtaataatgagaactgggtttcatataccttgtcctctggttgtctaaagtggagcaagagggaagggtattgtaagtataagaagaaaaagcaattagtggagaaaagtttcagggggactggaattagctttgtagaggaatagagacaaacattgttttcaatgtgtgttcctcacaccatctacttcaagatcaattgggcttgcttgttaacaatacaagaacttttccagatcaggtaaatcagaggctcccaaagtgcctggcaatctgtatcttataaaaagctatctaaaagagtctgatctatattatattttgaaaacattgagattaaaaaatgggaaaatatgttataaaatttttatcctgggtgcagtggcttacaccggtaataccagctacttgggagtctgaggcagaaggattgcttgagggcagaaatttgatatgagcctgggcaacctaataaaactcatctttaaatttttggtttttaattagccacatataggggcatgtgtctatagtaccaactactcaggagactgagatgaaaagattgcttgagcccagaaatttgagatcgcagtgaggtatttcaccactgcacttcagcctgggcaacagggtgagatactctctctaattaaaaagaaaaaaaagtctttacccactttctggaagtgaaagcaacttcaaattgtaatcatttatgacatgagaaaaacaagagttatttttacacaaataaggaagctgttgctgacaaaaaagtaaatgtcttccctcaagtcacaaaactaaccattggcaatgtctggaatatgaggccgaatatcgaattcttttaatgacaccatgattccatagacagtgattccctacccttaggcagtttataacttcttacaaacctaaatcatctactccagacgacatattaaaaattatcaattaggattttctactatctgcacatgcttgctgtgtaaggcattgaattttatacttttagttactctactttttgaaccaaaagttgttcacataatcaaagaatttttacatatttataattgtaaatgattaatttgttaaatctatatgaaagtttatagagtttacagtaaactaatcatccttttaaaaaaatggtccatttaaactactcaatacgtattttttattccataattgacagcacactgtggatagctgagagaccacatattttatttctatactgagtattacttaagtaatttcttaagctattaaatattttttaaatagtttataatggggaggagaagcaaagcaaatggcagaatagaaggctccactaatcatttccccataccccacaaggccccaagttaacaactacacagaaaaaataccttcatgagaaccaaaaatcaagtgagcactcatagtacccggtttggacttcatatccctaaaagaggcactgaagagatggaaaaaaacagtcctgaatcaccaacccccctccctctcaacctcagtagcagtcatgtggtgcacagtctatctctgggcacgggggggaaggaagaacacagcaattatgaggcactgaactcattgttgttatgttagacacaaaggaaaactagatcaaactcagctgacacctgcccctggaggcagagggagcatttaagccagtcctaacctgagaggaatcagcaatcccagcagtaagaacttcagtgcctgaaaacctcaccacagggggcctacagttctctgtgtttccaagtaaacttgaaaggcagtctaagccataaggactgcaactcttaggtgagtccagtgctgaataagtcccagaaattgtggactagggggatatttgacatactgagacaccagctgggtcagccaaaggagtgctgttatcacccctcccccaactccaggttgcatatctcgcagctcccaaagagactccttccttctgctggaggaatggaaagaaacagtaaggaagactttgtctttgcatatcagctgagccacaagaggataaggcaccaaacagagttgtgaggcccccgttccaggccactgctcctagacaacatttctagacataggctgggccagaagggaaacctctgcattgaaggaaagaattcattcctcagagcattcaccacctgttaattgaagataccttgagccctgaataacctaagcaatacccaggtactattaatacactgagggctttggatgagcatctgagactagcaggtttcaggtgagactcagcacatttcagctgaggcagctatgaggcaagattctttcttcttcagaaaaatggaaggagagtaaagagactttgttttgcaccttaggtgccagcacagccacagcatggtagagcagcaagtgggctcttggcatacccaattgcaggacttagctcttgaacagcatttctggacctaccatgggccacaagggagcccactgccctgaagggtgagtcccaggcaaggcagcctttactacaagctgatttaagagccctttggctttaagagaacactggttggtagtctagcaaccagtgggtaggggtcactatggggtgtggctcctctgcctttggaaagagaagagaaaagtgggaaggacttcatcttgtggtttgaacgtcagctcgactgcaatataatagaacaccaggtactcgtctaatgtttttgactctagtccctgacttctggacagcacctctgtatccacccagggcctgggggatctcactgccctgatgggaaggacacaggcctggccggctttgctgcctgctgattgcagatctccagggccttgagcaaacataggcagtagccaagaagtgattacagcaggcattgggcaagatgcagtgctctgtgggcctcaggcctgatgtagtgcagtcataatggtggtggccacagaagtgcttatgtcactccacccccagttttaggtggcacagacaagagagagaaatttttttttttttttcaagaaattaagggaagaaaacagagcagtctctgcctggcaatccagagaattctcctgaatcatgtccaaggccattgaggcagtacttttatgagtcttcaaaaaccacagtattactgggcttgggatgctccctaaagtagagagtttaaatcacgatacctatgtcctttcaaatatctgcagagcgttcccaaaaaggatggctacaaataagcccagacagtgaagactacaacaaacacctaactcttcagtgctcagacaccgaagaacatctactagcatcaacaccattgagaaaaacatgacctcagcgaatgaactaaataagtcaccagggaccaatcctgaagaaatggggatatgtgacctttcagaaagagagttcaaaatagctgcaatgaggaaacttaaagaaactttgataacacagagataacacagagaaggaattcagaattatatcagataaatttaacaaagagattgaaatagttaaaaagaatcagaaattctgcagctgaaaaatgcaattgtcataatgaagaatgcatcagagtcctttaatagcagaattgaccaagcagaaaaaagaattagtcagcctgaagacaggctatttaaaaagacactgtcaaaagatacaaaagaaaaataataaaaacaacaaagcgcatctaccgaatatagaaaatagccttgaaagggcaaatctaagaattgttggccttaaagagaaggtagggaaagagacaggggtagaaaatttatttaaaggaatagtaagagagaacttccccataccagagaatgatgtcagtatctgagtacaggaaagttgtagaacaccaagcagatttaacccaaagagtatctcaaggcatttaaaatcaaactaccaaaggtcaaggagaaagaaatgtaaaagcagcaagagaaaagaaataaataacatacaatgaagatccaatacatctgacagcagattctttcagtgaaaacctcgcagacagtggcatgacatatttaaagtactgaaggagaaaaaccttttacagtagaatattatatctggcaaaaatattcttcaaacatgaaggaagaatactttccctgacaagagctgagggatttcattaatattagacctgtctcacaagaaattgtatataaagagaagaacattagaaagaacagaacattcagtaagaaaagaacattagtgagcaataaataatcatcagatgtttaaaaacacactgataataatcagtacgcagaaaaagacagaatattataacactgtagctctggtgtataaactacttttaccctaagtagtaacaccaaatgatgaaccaatcaaaaataataactacaacaacttttcaagaaacagtacagtaagatataaatagaaataacaaaaagttaaaaagtgggaagacaaaattaaagcattgggtttttatcagtatactttgtgcttgtttgtttatgcaaatagttttgttatcagatttaaataatgggttataagatggtatttgcaaacgtcatggtaacctcaaacccaaaaacatacaatggacacacaaaaaattaaaagaaagaaacaaaattttatcaccagagaaaatcactttcgctaaaggaaggccggaaggagaaaaacaaggtagaggagttcacaaccagcaaacaaataccaaaatggcaggactaagtccttacttattaataataacattgaaggtaaatggactaaactctccaatcaaaagacatagagtggctgaatggatttaaaaacaagacccattgctctattgcctataagaaacacacttcacctatacagatccacatagactgaaaataaagggaaggagaaagttattttgtgacaatagaaactaagaagagtaggagtcactatacttttgtaagaaaaattgatttcacaggtctggcagccaagatggccaaataggaacagctctggtctacagcttccagtgtgagcgatgcagaagacaggtgatttctgcatttccatctgaggtacagtgttcatctcactggggagtgccagacagtgggtgcaggacagtggatgcagcgcaccatgcacgagccgaagcagggcgaggcattgcctcactcaggaagagcaaggggtcagggagttccctttcccagtcaaagaaaggggtgacagatggcacctggaaaattgggtgactcccaccctaatacggcacttttccaacaggcttaaaaaacggtgcaccaggagattatatcccgcacgtggctcagagggtcctacacccatggagactcactgattgctagcacagcagtctgagatcaaactgcaaggcggcagcaaggctgggggaggggcacccaccattgcccaggctcgcttaggtaaacaaagcagctgtgaatctcgaactgggtggagcccaccacagctcaaggaggcttgcctgcctctgtaggctccacctctgggggcagggcacagacaaacaaaaagacagcagtaacctctgcagacttaaatgtccctgtctgacagatttgaagagagcagtggttctcccagcatgcagctggagatctgagaataggcagactgcctcctcaagtgggtccctgacccctgacccccgagcagcctaactggaaggcaccccccagtaggggcagactgacatctcacacggctgggtactcctctgagacaaaacttccagaggaacgatcagacagcagcattcacggttcacgaaaatccactgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatgaggaaaaaagagcagaaaaactggaaactcgaaaaagcggagcacctctcctcctccaaaggaacacagttcctcacagcaacagaacaaagctggatggagaatgactttgacaagttgagagaagaaggcttcagatgatcaaactactccgagatacaggaggaaattcaaaccaaaggcaaagaagttaaaaactttgaaaaaaatttagacgaatgtataactagaataaccaatacagagaagtgcttaaaggagctgatggagctaaaagccaaggcttgagaactacatgaagaatgcagaagactcaggagctgatgtgatcaactggaagaaagggtatcagtgatggaagatgaaatgaatgaaatgaagtgagaagggaagtttagagaaaaaagaataaaaagaaatgaacaaagcctccaagaagtatggaactatgtgaaaacaccaaatctatatctgactggtgtacctgaaagtgacgggaagaatagaaccaagttggaaaacactctgcaggatattatccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaagggcagccagagagaaaggtcgggttacccacaaaaggaagtccatcagactaacagcggatctctcggcagaaactctacaagccagaagacagtgggggtcaatattcaacattgttaaagaaaagaattttcaacccagaatttcatatccagccgaactaagcttcataagtgaaggagaaataaaatactttacagacaagcaaatgctgagagattttgttaccaccaggcctgccctaaaaaagcttctgaaggaagcactaaacatggaaagcaacaaccagtaccagtcactgcagaatcatacaaaattgtaaagaccattgaggctaggaagaaactgcatcaactaacgagtaaaataaccagctaacatcataatgacagaatcaaattcacacataacaatattaactttaaatgtaaatggactaaatgctccaattaaaagacacagactggcaaattggataaagagtcaagacccatcagtgtgctgtattcaggaaacccatatcacgtgcagagacacacataggctcaaaataaaaggatggaggaaaatctaccaagtaaacggaaaacaaaaaaaggcagggtttgcaatcctagtctctgataaaacagactttaaaccaacaaagatcaaaagagacaaagaaggccattacataatggtaaagggatcaattcaacaagaagaactaactatcctaaatatatatgcacccaatgcaggagcacccagattcataaagcaagtcctgagtgacctacaaagagacttagactcccacacaataataatgggagactttaacaccccactgtcaacattagacagatcagtgagacagaaagttaacaacgatacccaggaattgaactcagctctgcaccaagtggacctaatagacatccagagaactctccaccccaaatcaacagactatacatttttttcagcaccacactacacctattccaaaactgaccacatacttggaagtaaagctctcctcagcaaatgtaaaagaacagaaattataacaaactgtctctcagaccacagtgcagtcaaactagaactcaggattaagaaactcattcaaaaccgctcaacaacatggaaactgaacaacctgttcctgaatgactactgggtacataacaaaatgaaggcagaaataaagattttctttgaaaccaacgagaacaaagacacaacataccagaatctctgggacacattcaaagcagtgtgtagagagaaatttatagcactaaatgcccacaagagaaagcaggaaagatccaaaattgataccctaacatcacaattaaaagaactagaaaagcaagatcaaacacattcaaaagctagcagaaggcaagaaataactaaaatcagagcagaactgaaggaaatagagacacaaaaaactcttcaaaaaattaatgaatccaggagctggttttttgaaaggatcaacagaattgatagaccactagcaagactaataaagaagaaaagagagaagaatcaaatagatgcaataaaaaatgataaaggggatatcaccaccgatcccacagaaatacaaactaccatcagagaatactacaaacacctctacacaaataaactagaaaatctagaagaaatggataaattccttgacacatacaccctcccaagactaaaccaggaagaagttgaatctctgaatagaccaataacaggctctgaaattgtggcaataatcaatagcttaccaaccaaaaagagtccaggtccagatggattcacagccaaattctaccagagggacaaggaggaactggttccattccttctgaaactactccaatcaacagaaaaagagggaatcctccctaactcattttatgaggccagcatcgtcctgataccaaagcctggcagagacacaacaaaaaaacagaattttagaccaatatccttgatgaacattgatgcaaaaatcctcaataaaatactggcaaaccaaatccagtagcacatcaaaaagcttatccaccatgatcaagtgggcttcatccctgggatgcaaggctggttcaatataagcaaatcaataaatgtaatccaccatataaacagaatcaaagacaaaaaccacatgattatctcaacacatgcagaaaaggcctttgacaaaattcaacaaccctgcatgctaaaaactctcgataaattaggttttgatgggacgtatctcaaaataataaggggtatctatgacaaacccacagccaatatcatactgaatgggcaaaaactggaagcattccctttgaaaactggcacaagacagggatgccctctctcaccactcctattcaacatagtgttggaagttgtggccagggcaattaggcaggagaagggtattcaattaggaaaaaaagaagtcaaattgtccctgtttgcagatgacatgattgtatatctagaaaaccccattgtctcaacccaaaatctccttaagctgataagcaacttctgcaaagtctcaggatacaaaatctatgtacaaaaatcacaagcattcttatacaccaataacagacaaaccgagagccaaatcatgagtgaactcccatacacaattgcttcaaagagaataaaataactagaaatccaacttacaagggacgtgaaggacctcttcaaggagaactacaaaccactgctcaagaaaataaaagaggatacaaagaaatggaagaacattccatgctcatgggtaggaagaatcaatattgtgaaaatggccatactgcccaaggtaatttatagattcaatgctatccccatcaagctaccaatgactttcttcacagaattggaaaaaactacttgaaagttcatatggaaccaaaaaagagcccgcaacgccaagtcaatcctaagccaaaagaacaaagctggaggcatcacactagctgacttcaaactatactacaaggctacagtcaccaaaacagcatggtactggtaccaaaacagagatatagatcaatggaacagaacagagccctcagaaataactccgcatatctacaactatctgatctttgacaaatctgagaaaaacaagcaatggggaaaggattccctatttaataaatggtgctggggaaactggctagccagatgtagaaagctgaaactggatcccttccttacaccttatacaaaaattaattcaagatgaattaaagatttaaacgttagacctaaaaccataaaaaccctagaagaaaacctaagcattaccattcaggacataggcatgggcaaggatttcatgtctaaaacaccaaaagcaatggcaacaaaagccaaaattgacaaatgggatctaattaaactaaagagcttctgcacagcaaaagaaactaccatcagagttaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggatatgaacagacacttcttaaaagaagacatttatgcagccaaaagacacatgaaaaaatgctcatcatcactggccatcagagaaatgcaaatcaaaaccacaatgagatagcatctcacaccagttagaatggcaatcattaaaaagtcaggaaacaacaggtgctggagaggatgtggagaaataggaacacttttacactgttggtaggactgtaaactagttcaaccattgtggaagtcagtgtggcgattcctcagggatctagaactagaaataccatttgacccagccatcccattactgggtatatacccaaaggactgtaaatcatgctgctataaagacatgcacacgtatgtttattgtggcactattcacaatagcaaagacttggaaccaaccaaaatgtccaataatgatagactgaattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacagtgcatgttctcactcataggtgggaattgaatagtaagaacacatggacactggaaggggaacatcacactctggggactgttgtggggtggggttggggggagggatagcattaggagatatacttaatgctaaatgacgagttaatgggtgcagcacaacagcatggtacatgtatacatatgtaactaacctgcacattgtgcacatgtaccctaaaacttaaagtataataataaaaaaaagaaaaatacatttcatgagaaaaactgtaaaaagacacaaataagcttactatataatggtaatggggtcaattcagcaagagaatataacaattttaaatgtatatgcacccccaagtggagcacccagatatataaaggaaatattgttaaagagaaagagaaagatagacccaaatagaataatagctggagatttcaagaccccactttcagcattggacagaccttccagacagaaaatcaatgaagaaacatcagacttaatctgcgctatagaccaaataaatctaatagatatctacagaacattttacccaagagcttcagaatacacagttgtatcatcagaacatggatcattctcaatgatagaccatatgttaggtcacagaacaagtcttaagatattcaagaaattgaaataatattgagaatcttctctgatcacaatggaaacatactagaaattaataagggttgggcactgtcctcacacctgtattcccagcactttgggaggctgaggtgggcagaccacttgaggtcaggagttagagagcagccttgccaacatggtgagaccctgtctctactaaaaatacgaaaaaaaaaatagccatgctggtgtcacgcacctgtaatcacagctacttgggaagctgaggcatgagaatcgcttgaatctgggaggcggaggttgcagtaaaggcgagatcataccgctgcactctagcctgagtgacacaacaagactccatctcaaaaaagtaaataaataaacaaataaaagaaattaataatgagaaattttgtaaactatatactgtatgaataaataaaaattaaacaatatgttcctgaaggaccagtgggttaatgcaggaattaagaagtaaattgaaatttttcttgaaacaaatgataattgaaatacaacatatgaaaacctatgagacacagcaaaagtagtactaagaggaaagtttatagctataagtgcctacatcaagaaagaagaaaaacttcaaataaacaatctaacagtgcatcataaagaattagaaaaggaagaccaaaccaaaccgaaaatttgtagagcaaaagacataataaagatcagagcagaaataaatgaaattgaaatggaaaaaaagtatgaaagactaatgaaataaaaacagggtcctttgaaaaattaaataaaactgacaaactttgagccagactaagaaaaagagagaagatccaaaaaaataaaattagaaataaaaaaggagacattacaactgatactgcagaaattcaaaggatcattagtggctaccatgagcaattatataccaataaagtggattttttttttgagacagagtctcactctgtcacccaagttggtgtgcagtgacatgatctcggatcactgcaacctccacctcttggggtacaggaattctcctgcctcagcctcccatgtagctgggactaccggcacacgctgccacatctggataatttttttcttctttccgtattttagtaaagacgaggtttcactgtgttgcccaggctcgtctcgaattcctgagctcagtcaatccacctgccttggcctcctaaagtgctaagataacaggcatgagccaccgtgcccagcctacgtaccaataaaatggaaaatctaaaacaaatggacaaattcctagacacatataacctactaggattgaaccaggaagaaatctaaaaccctaaccgaccaagagcaagtaatgagatcgaagctataccaaaatctctcagtaaagaaaagctcaggacctgatagcttcactgctgaattctaccaaatattttaaaaagaatatcaatcctactcaaactcttctgaaaaatagaggagaaggcagcaagctaacacaggaacagaaaaccaaacaccgcatgttctcactcataaatgggagttgaataatgagaacacatggatacagtgaggggaaattcatacaccggggcctgtcagcaggtgaaggcctaggggagggacagtgttaggagaaatacctaatgtagatggcaggttgatgggtgcagcaaaccaccatggctcatttatacctatgtaacaaacctgcgcattgagcacatgtatcgcagaacttaaagtatataaaaaaagataaacaattccaatagaaaaatgggaaaatgtaaaaaaaaaaatagagaagggaatacttccaaactcattctatgaggcaagtgttatcctggtactaaaaccaaagacatatcaaaacacagaaaacgatagtccaatatctctgatgaatattgatgcaaaaatcctcataaaaatattagcaaaccctagtgaaagtggacacccttgttgtgttccagatcttggaaaaaaggctttcagcttttccccattcagtgtgatagtagctgtgggtctctcatatatgtcttttattctgttgaggtacgtttcttttattcccagtttgttcagaggttttattatgaaggaaagttgaatcttatcaaatgcttttttgccatccattgtgatgattatacggtttttctctttcattctgttgatatagtgtatcgcattgattgttttgcatattttgaactatgcttgcatcccaaggatacatcccactcagtcatgatgaataatctttctaatgtattgttgaatttggtttgctagtgttttgttgaggatttttgcatcaatatatacacctactctgcacccacaaaaattattaaaaagaatttttaaaggaccaaaaaaagatagacaattcagttggccaacttccaaagaattgtatgacataatatttggacactgccacaaactccatacatgtgaaggacacaattactattgtatggttcctggacgtaccatcttcacttctgtagaactatagaaataagtgggtgacaggtgggaaaagatttgtaagttatgttaaggagtttctaaatcatcacaggggagatgtcaagccactggaaagttagaactggaaaaacatggtggagaggaggatgtctcttattgggatgcacaaaagggatgatggacatctgagctagcataatagcctattgagatgagaagagatacatagatttgagataattcaaaggtagagttgacagaatttgatcattgattgagaaagagtgagaacattgacatctaagtttctggattgatcctctagaagcaacaataatcttaattctttcaaaggaaatcatatgcaaattggtagttgacattttgcttgaagtctttaatataatattttcatgattgtaaaaccaaatgactctccatatttatgaatgtgcttacttttgacagaattttcataggctcactccttctaaactcagttcccttaactctcttcgcatgagatcatatgtttctcaataacaaattctgcagtaggggctattaggtgcccaaccccatctccacttttcactcatgcttcaggaagaacagtttgctatttaccagggaagtcttttaaagctgctatggacattcagctaaaggacactgagaatgtaactaagaaattcaatgatgtcttcaagttgcctgactataggttttgaataacaatgacctacacttattgagagattaacaatacgccaggtaccttctaacttctaagtatactgttacatttggtcctcacaacaattctatgcggtaatcattactattatccacattttatagagcaggaaattgacatagagatagcacaaatagattgctcaaaattacacaagatgaaaatagccgactcaggtttaaggccacagaacttgtgccaagagctctcacgtgagatatacaaacaaagattccttttctaattgccatcagctatttgagaccatattatctgccagtttccttgttgatctagaagcctctttaatcattaactacttccccagaggctctgtctccaaatacggttacattgagggttaagtcttcaacctgtgagttttgagggaacacagtatagtccttaaaagttgctctctgttcccaagctgagtgctaagatctttcctcaataatgaattctttttttgcctaagtcagccagagaagtgcttttaaccaacaatgctaatgagtaaagtatctatatatgatagcaatatatttggtatcctttatttgatgaaatcatttatttgatgttcctttcatttgtacatgtaatcaagaatcatttagtcatttattcaaacatagttttaccactgccatttaaccacctgtgtgactttagagaaattcatctaagtaacagttcccttaactataaagtatagacaattatactgaccccaagattgtttgaaggatttggggttatatgaatctatataattattaaatatcctgacaaatacagttgacccctgaacaacacaggtgtgaactgcatgggtccacttatggttggattttttgcaataaatacagtcaatagtccatattggtaggttccacatctgcaaccccatgcagattgaaaatacagtatttgcaggattcaaaacctgtgtacacagaaagctgattttcctaatggcaggttccacagagccaactgcaggacctgagtatgagtggattttagtatcattggggatcctggaaccaattcctccaggatacggtgggatgattgtagtattaactggcagtatcatatgtttgggtgggctctgacacctttttaaaaaaagatggccaggagaaaaaaaaatgaatatttaatttttggttttcaaaactgtgactgtgaaacaaagctaattccttctttttttcatagtgaatatgttttttaatcattaactatttctttacaaatgaaaattgtatatatttattgagtacaacatgatgttttaaaatatgtgtacattgttaagtgacacagtagagctaattaatatatgcaatatcttataaacttttaatgtttggatgagaacacttagaatgtattctcataacaattttcataaaagtatttttaaacatagtcaccatgcgatacattagatttattggactgctcctaccatctaactgaaattttgtgtcctgtgaccatctccccaatccctaccacctcctgcaacctctattaaccactattatactctctgcttccatgaatttaactttttccaatttcacacgtaagttacataatgtggtattcgtctttctgtgcctggtttattttacttaacacaatgtactccaagttcatctatgtggtttcatatgactgaatttccttccttttaaaagctgaatcgtattctattatgcgtatacaccacatttttaatgttcataaatctgttgatagaaacttaggttgattatatgacttggatattgtgaataattctacaatgtacatagaagtgcagatatctgtttaacatacaggcctatctcagtgattttgaggattcagttccagacgactgcaataaagtgaatatttcattaaagcaagtcacacaaagtttatggtttccccgtgcatataaaagtcatgttcacactgtactgtagtctattaggtttccaattgcattatgtttttaaaaagtacctatcttaatttcaaatactttattgttaaataatgcctaggataatctgagctttcaaagagttgtaatctttttgctggtgcaaggtcttgtttcaatgttgatggctgctgaccagggtgggacttgctgaaggttaaggtagctaaggtaatttcttaaaataagacaacaaacaagtttgctgcattgattaacacttcttttcacaaaagatttttctgtagtatgtaatgctgtttggtagcattttacccacaataaaatttcactgaaatttggaatcaatcattttaacccctgctactgctttatcaactaggttgatgtaacattagaaatcctttgttaccatttcagcaatgttcacagaatcttcaccaggagtagcttctatctcaagaggtcattttctttgctcatccataagaagcaatttcttatccattcaggttttatcttgagattgaagcaattcagtcagatcttcacactctacctctaattttagttctcttgttatttccaccacatctgcagttacttcctccatttaaatcttgagtgcttcaaagttatctgcaaggattggaatcaccttcttccaaattcctgttgatgttgatagcttgatctcctcccatgaatcatgaatgtttttaatggcatatggaatcgaaaatccttccaagaggtttccaatttactttgccctaatccatcagaaaaatcacaatgtattgcagctatagccttacagaatgtatttcttaaataataagaattggaaagttgaaattactccttgatctatgagctgcagaatgaatgtatgttagcaggcatgaaaaaaatatccttttacatctccatcagagctcttgaatgaataggtgcattgtcaatgagcagtaatattttcataagaatatttttttcctgagtagaggtctcaatagtagccttaaaatattcagtaaaccatgctgtaaatagatggtgctgtaatctaggcttcgttcttccatttatagagcataggtgaagtctatttaccataatccttaagggccccaggatttttggaatggtaagagagcattggcatcaacttaaagtcagcagctgcataaactgctaataagaaagccagcctgtcctttgcagctttgacggttggaattgacttcccctttctagctgtgacagtccttgatggcatctccttccgatagaaacctgtgtcatctaaatgggaaatttgttgtttggtgtagccacctccatcaattatcttagctagatattctggataacctgctaccgtttctacatcagcacttgctgcttcccttttgcacttttatgttatgaaaatgggccaggcacggtggctcatgcctgcaatcccagcattttaggagactgaggttggtggatcacctgaggtcatgagcttgaaaccagcctgaacaatgtggtgaaaccccgtctctactataaatacaaaaaaaaagtcagccagctgtggtagtgggagcctgtaattccagctactttggaggctgagggaggagaatcacttgagcccaggagcagaggttgcagtgagccctgatcgcctcaccactgcattccagcctgagcaacagagtgaaactctgtctaaaagaaaagaaaagaaagaaagaaagaaagaaagaaagaaagaaagaaagaaagaaagaaagaaaagaaagagaaaatggcttctttccttaaacctcatgaactaacctctgctagcttccaactttttttctgcagcttcctcacatctcttagccatcaaataactgaaaagagttagagtcttgctcgggattaagctttggtttatgaatgttgtggctagtttaattttctatccagagcactaaaactggctccaaaacagcaataaggctattttgctttcttatcatttatgtgtacactggtttagcactattaatttccttcaaagatttttccttgcactcacaacttggctaactgtttggtgcaaaagatctagttattggactgtctgagattttgacctgccttcctcactatgcttaatcatttttagctgtttgtttaaaataaaagactcgtgacccttccattcacttgaatacttatagatcattgtatggttaataattgatgtgatttaaatgttcttgtgtctcagggaatagggaggctggaagagagggagagagtctgggaacggtcagccggtgatgcagtgagaacactcacaacagttatcaattaagtttgctgtcttatatgggtgcaattggtggtgctccagaacagctaaaatagcaccatcaaaactcactgatcacagatcaccttaacagacacaataacaaggaaaaagtgtgaatattctgggaatgaccaaaatgtaacacagacaggaagggagcacatttgttggaaaaatggtgccagtagacttgcttcatgcaaggttgacacaaaacttctatttgtaaatagaacctttatagtacctctgaagtatgataaagtgaagtgcaataaaatgaggtgtgcctgtactgatttcatttcctttaaacatatatgcagtagggattgctggatcatatgttagctctatttttagctttttaaggaatctctgtactgttttgcataaggctgcaatagcttacgttcccaccaacagtacacaagggttcccatttcctcacattctccccaacagttgtgatctttcatcttcttgataatagcaattctatcgagtacgaggtggtattttggttttaatttgccttttcttgataatgagtactgttgagcattaggaaaaaaaaaacccttagttatttatatgtcttcttttgcgaaatgtctattcaggatggcggtgggaagctagctgcagccggctggggagggggtgtctgcacaccagagagtagtgtgctggatgattctggcacccggaatagcctcctcctcctcccactgcctagacctggagaagccccttctcatccttctcacccatccccttgtggcagggcaagtgggctgagctgccccatgcttgcacagcccagagcccgaacctgcaggacaagtgctgcagagtgaacttcacctcctttccagggctcacgtgtgagccactaccctaggttgtgttgatgtcttattgctgtttctccaaaactgtaataagaccatttttctacttatcattcctgtttacactggactagtacttttaatttccttcaaaattttttcattgcactgaaatctgtttttgtattgacatcctgactccagacttgcctttccaaatctagataagcatagtgaccattccccataaccaagatccctttctcactgttgcctctctcctgacatacctgctgccgtattccctactcttccccctcctcaagaaaataaataaataaaaaataaaataaaaaaagcaaaacaaaactacaaacaaaaaatagcttactcaaggaattaggtaggtagggaatgatggatcacattggagtctgggattaaaaacacacacaaaaagaaaaaagttaaaatgcacttgttttctctacactggctaagaatattgctctacagtataaattttaatgtcatgtgtctgaatgtagtgtgcatttgagtagcattgtgtgtgagtggctccacaagtaccttctagtgcagcccctcagtttaaagaagaaagtggggggaaaaagaaactccagaaagctttaatgttcttgagtgattcctttacctaatgagcatggttttaacaactggagatgagcctactttggaaacagcccctcttaccccatatttattcttagggcacccctttatccactccatgcccattatgtctcattctcaagtggcaatgagttaactagaaatttaaatattttctgtaactttacacttagattatgctttgttatgaatttttacacccttcttctcttaaagatgcagaattgggctttaaaaaaaattattggctcaaataagcccttccccttccacttgtctctcgggaatgtgagctgatggttcttaagatgttgagttttgtttactattcactgctctttagccaggaattctctagtgatcagaagcaatgcaactgaagaccagtttttaaattatgtgttgacatgttaccttatatttaaaaaggaaaaaaaattagctggcttatattatgccagatgtcagtaacatgaagtcctaatttattgttctcagttgttttcctacctaatgtgaacttccgtgtccctgagccctcaggagtacctacagcttatggtgcaatgtcttctcccaaagtgttggccaccatttcacccaaggccctcttccaattcttgcttatctgagtcagatttagagagtaccactgtctccccttatcccttacttcatctccaaaccacatactcgtgctatacttttcttctcagtacctctccctgaatgatgagctgccattttaggaaattggaccagataccaatttgggagctttcagtcaaacagcctcaaacccatttcttcctatgaaagggtgcaagtctctgaagctctcactcacccctgtagtctgtgtagaaaatgtacttaatccccctggccccctactgtcattgcctttggtgtgagatgttccctatttcctagtttagtttgagtccctctctcctctgctagccaacacccatccagcaataaggaaccaagcgacagcctcctattcacactccctgccccctttccacactaccctagggaatacctggattgccccactctgtccacatactgtagcattcattctctatcatcctctcacctgtggtggtttatggatgtgatagagtttttaagattactacaaactagtaaagaggaaaagcaactcaaagagagagaaagagagaaagaaagaaagatctgttcagggtctttgcccatttttaatttggattatttgttttcttgctattaagtttattattattttaaaaattaaccccttatcagatgtatggtttgcaaatattttcttccattccataggttgcctcttcatcctgttgattgtttctttgctgtataagactgttttagtttgatgtaatcccatttgtctattttgcccttcattatctgtgctttagggattctatccaaaaatcattgccacaactaatatcacaaagcttttctcccatgttttgtcctagtggttttgcagtctcaggtcttacatttaggtctttaaaccatctggggttgagttttgtatgtggtgtgagataaagtctaatttcaattttctgcatgtggatatgcagtttttttcaacagcatttattaaagagactgtctattccccattcacgtgttcttgacaactttgtcaaaatcaatcatcttaaatgcatggatttatttctggacgttctattctgttccattgtttcatgtttctgttttgatggtagtacaatcctgttttcattactattgctacatagtacattttgaaattaggtagtgtgatatctccagctttattcttgttgctcatgatcgattttgctcttaaggatcttttgtgataacatatacattttttggtgtgttatatttctttgaagaatgtcattggtatttacataggaattgcattgaatctgtaaatcgcttggggcattgttgtcattttgacagtattaatttttgcaatctataaataataaatagctttctatttatttgtgttttcttcacttttttcatatatgtttcataattttcactatataagtcttttaccacgttatttacatttactcttaagtatttattttttgtagcttatgcaaacaggatttttttctttgtcaggtctttcattgctagtgtatggaaacactactgatttgtgtatgttcattttgtatcttgccacattacggaatttgtttagtagttttaacctagtttgctgcagtctttaggattttttacatataagaccatgctatatgcaaacagggacatatttagctacttcctttccaatttggatgctttttatttttttctcttgcctaattgctctgagtagaacttccattaatgcactgaatagaagtagtgagagtgagcatccttgtcttgttcttaatcttagaaatatgtttttcacatttcaccattaagtgtaatgttagcggtggatttatcataaatggtctttattgtatgagctacattccttctatacctcatttgttgagagttcataatcaggaaatcatggtgaactctatcaaatgctttttctgcttctatcaagtatcatatggattttgttgtttattctgttgatgtggtatttcacatttatagatctgtatgttgaattatctttgcaaccctacgttaaagcccactgtatcatgatgaatgaactttttgacatgctgttgggattagtttgttagtattaatatttattgatgcacctatgttcattagtgctattgcctaatattttcatttgttgaagtgtccctatctttggtatcaggattatgcttgccttgtaaaataactttggaagtattccctcttcttcaattttttggaaggcttttagattggattgacatgagttcttctttaaatatttggtgaaattcagcagtgaagccataaggtcctgggctttcctttaatggaatattttttattactaatttaaccaccttactcattattggtctgtttagattttcaatttcttcatcttggtggggtttatgtatctaggaatttacccatttattgtagattatccaatttgttggcatataatttgtcataatagtctcttctgatttttttgtgatgtaagttgtgatgtctcctttttgtttatgattaactttttttttcccccttagtctggataaaggtttgtgaatcttatttaacttttggaaagatcaaatttcagggtttttttttttcattgttttcatagtttctatttaatttacctgccccaacctttatttattccttcattctattacctttggacttagtttattctttttatacctccttgaagtgtaacattaagttgtttaagatctttcttctttttcagtgtgaaagttttgaggcatctaacaagttttggtattttgagtttccatttttgctgttctcaacatatttttaaatttccattttaatttcctctttaatccatctgttgttcagaagcatgctgtttaattttcatgtatttgtgagttttctaaaaaattttcctgttattaatttctagtttcatgtcattgtgatctggaatgataaatggtatgatttcagtcttcttaaatttattatgacatgccttgtgtcctaatatttgttctctagcatttcctgtaagacagctctgatggtaataaactcccttaatttttgtttttctggcaaagattttaatctttccattacttgcaaaaaacagattttcccgagaatcgtatttttggttgacactttttttttctatagaacattgaatatatcattccatgctctcagcctataagtttctcctcaaaaatctgctattagccttcttggaactcccttatatattatttgcttgttttctcatttatttccagaatcttccttttctttgatttttgacagtttaattaaaatatttcttgtactcttgatgggactgaatcatatcaaacatcttcaatattcctatacctgtatatttctctttccccagacttggaaagtattctgttattatttcatcatataagatttctttccctatgtgtttctcttctctttctgggacacacatgatgtgtgcattggttctcatactgatgttctataattgccataggatgtctttattttttctcatttttttccttttgtgtctctgacagtaaattcaaatgatgtgtctttgagtttattgattctttattctacttgatcaaatctgctttcaaagaagtctatgaaattttcagttcaaccgttgtgtcctttatgtccagaatgtctcttttttaatgatttctttctgtttgttgaactttctattttgttcatgtattatttctctgattctttttagtcatctatctgtgttctcttgaagctcactgagcattttaaagaccattattttaaattcactgtcagaaagttcataaatctttatttttgggggtcagctattgggtattcttttttttcctctggtggtatcatttttctcttatatttcttgatttttaggctgtgcattggtgtctgcacatttgaaaaacaagaaagttattccagtctttgcatactggctttgtctggaaaaacctttccccagtcatccagcaattcttggtagggtgtctgttgtggtgtgcaggtgaacttgttgctgaagtcttcaggcaggctggcctggtgtctgtgtcagcaggtggtaggcttggttcctgggtctgtagagttgggcctgaatcctatatccactggctggatattttcattgggtatgtggggatgaacataaagcctatgtctatcagggcaggcatacagcctgtaccagtaggggctggaatgaagcccatgtctacaggggctgacatggctctgatgtgggcattgaacctgtgtctacaagggctggctaggttgtggaatgggcctaattaaggacattaatatgaacgaagcatcccagagatccttgacacattgtgagaatacacagagggagcatctccaccagcctcccacagacactcagccatgcagtccccattccctgccatgagcaacagtttcaaggcttcacaggggttcaaagatggccagcttattgccactctttgtagtatgaagtataccaaaaaataaagatagatcaaaacattgataatataatggctttaaaatctgtgtattttataaatgtatgcttacaaccacaaaaatgccatgcaatactgttgttctactcacaagatcagtacaggaattataaagcattgattcagggttgacttctgccagcatgtaactgatggtgaatgtgttctcttcattctgcctgagtttcaatgggtgatatcattggtgatacagctggaatctcatatttgggaccctttttgaaagtggggccatgcctaaattgtatcctaggtgtctactccaccatgaccccctgaaggacctgtggtttcccaaaggttggaagaagattcagggctaagcagttggagagacctagaatcagagatctctcacacagactgaaaaccccaaaactgattagcataacctcagcaccagtaaaaccagaattcattgcttccattcagagatcccatgtttgtgccagaatccaagctgcaatgagtgtttcgggaagtcacttatgactaatactgagtatgatgggactgatatcagagctgagctaggcccagagggcccagaagcagtgacacagaaggctaaacctttcagttttgatccatagattagctacatcagagaagtggacttggagaatcccctgctggagtcttgcagagtaaccactctgtcagatagcatgtgtttctgggaggaagtcataggggtctagttccgccttatacccctgcacaccataagcatgggctgagatctagagagagtccagagctggtctgaaaggctgatacaaaggagtctgctctggaactgaggtattctaagaacttggctatctcagcagccctacagatgggagaggagcccacagatgggagaggaagctattctcctggccaaggtcctgagacagtttgacagaagcctaggcagacttgaggccgactgcagctagcactggcactcgaaatgaaacctcccctgtagtcccatggatagttttttgtataaacatagaaattgaccattctggtcttaaagcttgaaacttttatttgttttctatgagtttcatccttggtaaaggacccctaggtccctcaaaaagtataaaagaactgaaattcaccagatgattccatccagatgatggcacaccagacccctcatacattatgattgcttccttaggtctcctgagttcctgtttttctacacatggttacttttcctccctgctatgtaaactcataattttagctggtcagggagatggatttgacactgaactaccatctcctctcctacagcatctgattcagccttctcccttggcaagaattgttgatatgaattggttttctgtgcagtgagcagctggagctagaccacacccctggtgtttcactaacagattttgattccccaaccaggaacactttggctcagctaccatgggcggggaatctcaaagtcctcctaagcagctgcttacccaattttggctagagatgagtaccctctctctagggccagccacagctggccccaaccatgttcctgattgccttgggagaactgcctttgaaatttgatatttgcatccagataggtgactctcctctgtgggcccagacagaaagatctcctcctcacagtttgggaaatttttaaaggaatttccacttgcaggttgaacaagcccaattgatgaagagagggaagtaccctgactatttcagtacggacactcttaggagcttgtttgtcattgtgtgtgtatccaggcaagtgagtgtcatttgtgggaaccagacagtgggatctgctcctctccatctgagaaattctgaaggaatttttatttcaggtcgattgagcccaaccaatggagagaggaagcaccacaactctttcacatcgtagacttttggggcttgtttgatgctgcagcagttggattgtgttttagtaattgtttgcatgtgtctgatacagtcatgggaaattcgaatttgataaactggtactcttttgtgacactgtttggctccagtatagtttggaatctggagtttgctgttgaatgggaaagtgggattttgtgctgctgttttaagcagggtcgggccaggttaatatgtgatgatctcatgcggtgccgtttttgaccccagtgttttgggagtatagggagttttggcctttaaaaatcaaactgccacagaaactcattttatttaaaatttgtttcacagccttccctggattacctatcaaggctaacaaagttcagccatgtggacatgtttgcagacagttgagactgtattactatctcatggctagagttccaaggtaaaagcttttggatctttgtgtgtatatacatctagatgtgtttatgtgtatgcacatgtattacattatatgttgtgactaccaaattggcttatacataaaagaacactcctagattaagtaaataagtccaaagtattttttacattcacgttacttaagtaaatttttaagaagctagcattaaaattattgtaagataaaaatagaaatgtcttcagaattgtcagcatacattttttcggggttttatgtttgtctctgctagatattttggggcatcagagtgtggcacagaaagttataaaactataaccagtagtttgagaccagtctgaaaaatgaagacccccccccgccccaccatctctataacataaaaataagacaattagccaggcacattgattcatgcctgcagctagtcaggagactgaggtgagaggatgcttgagcctgaaaggtcaaggttgcagtgactcatgatccagccactgcactccagcctgggtgacagagtgagaccctgtcaaaaaagaaaaagataagaggcagagaatgacaatggggcacaggagcattgcagagaaactaggggaacagttgtaattgttaatacgatggtcagaggaggcctcattgagcaagtggctttaaggtgaagatttaaagagggtaataaggttttctataggtataatgagaaaacagaatgcaagcagaagaaaaaggacagcaaagtgcctgaagcagagaaggcaaagagattgaagtcagggacatgactggagggatgtcagggaggtgactggattctaagtcatggagaacttagagggctgttataagacttttatatatctttctctgaatgagattgggagtgacagcaggacttgcacaacgaataacaaaatgtggcttttgttttaaaaggagtgttctggttttacatagagaaaagactaaagacattctccatccagaaaagactgccaagaactctgaagcatctaaaagtttacaggggcacagatgcagaaatgctggcagatgacacaagcttccaggtaaaggcaggattttatatgccttcaacaggcagaatgatttatatgtttgtgtcagtcatctttgctccacaagtcctacagaggaaatacaggaaggcagattaatgtcacaaattcaatagatgtgtgttgcagcaaaactgccttctgcttcagaagaaagcagtatctccagcttccaagctgtactctttacaaacatccttgaaaggataggagcaaaggctgtcaatgtctctgctcctaagacatgcagaaatgtgagaggccatgaagacttttctcccaaccagaatgagcagaatgtcataatggattggatgtaaagtgggaggggaaaagatacttaagaataattccaagagtttttatttgaataggtgaaaaggtggagttgccatcaacttaattgagaaagactacaggtgaagtaggctgggtggagagggtggataaggagtttgatctgagacataatgagtttgagatggctattgggtggaatccaagagatatcaaacaggctattggatacatatgtcttgagtttggaaaagagttttaatagtaatataaatgtattagtcattggcaagcagattgattttaaagccatgggaacagatgtgattactagggagtaagtgtggatacaaatgaaggccaatgattgaactctaaagtgatgcaaaattaagaagttggggagaaaagaagggtccacagaggagactgagaaataaccagtgaagttaaaggaaaagaagagagtgtgttttctcggaaaccaagtgaagaaagtcttaaagaatgatctattaagaacagaagcaataattgaccactggatttaataacatagagatcactgatggatttaaaaaatgtttcagtaaaatggtagcagcaaaaacccagttagataagattagggggaggattggaaatagcatttgtagacaatcctttcaatgaattttgctacagagtgttaaagcaaactaaatatggtctgagaaggactctgtgcttcatttgagcccttgtgggtgtagagtaacctagcttaatagacaaaattgaaaacctaatttaggagtctgcacctgtaacaatatttgaatgctggccagtcccagcagccttacatcaccactcatagactgctgaatgctcaaactgtgtttaaataaggcaaacgcccaggtgacagaaatctcactgtttctgtaactcatttccggttcctggatgtcactttaactttttttccctataaatttgttttgaccacaaggcacccctggaaactctgtgaatctgctgtgattctgaaggctgctggatcgatgaattgttcattgctcaactaatctcctttaaatttaagtcagctgaagtttttattttatcagattgtgtcagaagcagaatctgaagtggagcttctagtatccccaggagcactgagtaaacacagaaggtacctgcgggatccacttgtgtccactgatctctcagagcagctgaggatcaaaggtaagctccctcttgcattttggagcttcacacatttgtgttttgagctctctgagtttccttgtgcaaatttgtgatccaaactggttttggagttgcaacagaaaatggactgggtctaggaatgaatttgatctgggaattaactggcttggatccacttagaggccactaacagtagaggccactaacagctgactgggtcataaaggaagtggtagtaagcagtaatgtcgcagcagtcataaaattcggctttgggaaattcacagggatttttgtgttctacccatttgtttcatttttcttgtgtacctagataggaaaattcattggttaagttaatcaaaagaacctgagagtaaagtcagtattttatgtaaaactggaatccttaatttctgaaaaactgagttctttctggcttatacattaggactggaaggcagagaagtcttacacaaatggcaaaatcttactaaagataacttagagtggaacattccaaatgaaaaacaatgcattgaactacatttaaaaatgagggctctcagtaaagtcccttttggctaagaaccggtttggcactatagaatgtcaactgttatactctttggcacatttgtaagaattccaagtgttaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaaaaagaattccaagtgttatttcaaaggaaatttacagatatgtttccaaattttctatgcttttttcttatttttgtaatgaaactgggaaaaatttcaaaatggttatagatctgaaatatttggccctaagaaactaaagaaaatctttgccaactcctgctctgaggtttccagtcacaactgttcttagatatttcctattccagaagaaagaagactcttcaggcatctgatgaccaaaataaaagaaacattatgatggtggtggtggagtgttctgctacaggcatgtgggaggctcacagaactcttaatattcacttttaattcattccaccagagaggaaatgcatgggttttggataggactctgtcatttatccctgtaagaacttgagaaatttatttagtctctctaagctttggcgtattcaaaatgaagacgatactaacagtacctacatcatgagtgttacttgaatggagatgtgtaaagtgcattttaatttcatctggtcctttaacattttcccttcacttctcttcagagttttttcttgaagggctcgaggactgaagcatcccacaaaatgattctattgaataattctgagcagctgctggccctattcaaatctttagcaaggagcattcctgagtccctgaaggtgaaggaacagtgggaggttggggtatgggagtaggggtgttgaggatgagaaaataacaggcccaagaatctcgtccttcctgactttgtgcagagggttggagctgggaaacaggatggggttggggacaaaggaggcatgttaagagctgctgcttctcctcggcaacaggcaactaggccgactctgcagattttatcactcatttggagaggtggtgaagaatggtggctacgaacatcggtttggggccagattcaataaatatgcattgcaaggctgccattttttagtcagatatcattgtgcctgtgtctttagctttctatgcctttatctttggtcttttcattaataaaatgggaataatattagtagccacctattaaagttgttgtggacactgaatgaatccatacaatataagtgctaagtgcattgtcaagtgcccagctactgcacagtagctctgtggtatcacaaggacacctccctgggagttctgcctgtttgctggtgacttcacgtccatcagtatggtcctggagatgctgctcatcacactatcaccaacttggtcccagtgctgtctcctgacttccatttttctcttcctcttcacatacagacccccatctctggggatctcaacctctcctattccctttcatccctccttcaggtgtatggctctctgtttcacatcaatcacgggaaccccttcaacatggaggtgttggtggactcctggcccgggtatcagatggttattatccgacctcaaaaacaggtaggcacacagacagggactggtggagccaggcaggtccaaagggcctgaggaactgtccaattcagacaccatggctgctttcatagggtgaaaggaaatgtgagtattttaaaacactccttcgttaatgagcagcttgcatgaatgccacatgttaacactcttcccgtaagcataagactaatttgggaaaggggttcaagggggaaggggaggaaaaggacaaggctgacactcacagattaagggccctttgaggtggcaggggtcacctgcaggggctgaatggaggccaatttacagggaaagttgtgtgtctgagatatcagaacagtgatttagaaacaaaaaccaaggcagtagtctaccagcaaaattacctctcatggccaggcatggtgtcttttacctgtaatcccagcattttgggaggccaaggcaggaggatcgcttgaggccaggagtttgggacctgcctgtgcaacatagtgagacctcatctctacaaaaaaataaacaaaattagcagtgcatggtggtacatgcctatactcctagatgctcaggagatggagatgggaggatggcttgagccccagaaggttgaggctgcagtgagccaagatcacaccactctactctagcctggccaacagagtgagaccctgtcataaaaaaataaaagttgcttctcaggaaccagggaaggggcacacaattactgtgtgtcaactgtttggaagcacctcactcattagtgactgtcatcatcagaacaattttacaaagtgagctttaatatcttcaatttagagatgaggaaacaacactgagaaatattaagtcctgtagctgctggataccaactgttaaagcattccccaatctgaattcaagttcaacggactctgccacttttactagctatataaccataggcccttctgtgagttttatcatctgttaaaatgggaaaaattggaggacactcttcagaggatcacagaaggtttaaatgagataccatatgtcaaacacttagtacatagcacataattctaaatagtatttaccataattagccattgttggccgaggaaacacaaggtatacacgattaagctgaaatagtaatacaaacctaggtctattttttggccctaaaggcttcccctttttgtatctgtttcatgcacatctggttagtgaactgaagcctcatggacagcccagcttcaggtgggtatagacgctgagcccccacataataataagctgagcctaacaccttcccagggatgttcttttgatctcaaggtttcctgacaatttcagatggaagattaatgcttagtttatttgatccatggtccaatttcttcaaagtgtgatatgctaaataactgtatgaggtcaaatagttctttttacttcagtaactttgtagttactatgtgtattttaacaatgtaactgcaccatcaagctgtaacttcatatatgcattgctttgaacaaggctagtttttataaagtgagtcagtaaacaaaaatattaaaatataaaagttccatgccacacatacatgaccaaaaaaatggaaagaatgaaatatgctgcaatttacttggaaatacattcacctagtctgattccatagtataccacgtttctttcagtattgaaaatcgatgcaattttgaagaagacctttttaaggtgagatgcaggagaatttctctagaaaaaaattaattttttctttcttggtttttaatcagaaagataatatatgctgattatacaagtggaaaaatccaatatgattttaagaagttaataacctctcacctcctttgccctcctctcctccattcctaccctttggggtaatcagtgtccttgcccatattaacacacaaactgtcatcactttttaatttgcctttgacatatggacattgctttgagtgaatcaatacagcactaacgttttcgttttagtaactgtggtgttccatagagtcaatgcaatgctagtcagtcattctcctcctgttgggttcaaattgttcatacttctttgccattacaaacaatgcttcagtaaacatccttgtatacatgtctttacatcctggaaacttttctcaatgcaattggtttccaaaagggatacgtccaagtaagagcttctcttatcctaagtaggcactgccagactaccttcccaaaggattccacagtattatttccattagcaatttgtggaagaattgtttcccacattctcaccagcactgaatgttatccttcttctaatttctgccaaactggtgggtgaaaagtggcatcttattgtagatttaatttgcatttccctgactagtgatattcaacatatattttcatatgattatcagtcattttgggtttacttctgaactgtttatattgtttgaccatttttacactgggattttgtgtcattcttaaaattctctatgtgttttggatatgagggatactaacacaaggtgtatgctacaaatttgttgcccaattgagaattattttctattttattgatagattttcacatgaagcaatttttaattttcatgtaatcaaatatattatctttttcactatgattcctgaggctttgggggtttttttgttaataattaggaagatttttcctaatccaagatcatacaagttgtttttttcattttgtcttacagtgagtttttacttttgacatttcaaacttcattctatttgcaatatatttttgaatagcatgcattaacattcttttatatttattcaccttatggctggctaattacattagtgctatttattaaataagtcactctgctactgaaacataaatgtctattttgtcatgtaacatttttatatatttttgtagctatttctgtatttgttttagtcttttctcatgctatttcaatgttttgtggtaaatattaatatctaataaagcaaatcacccttcactaatgtttttcttgatttcctatttcttataaacttaagagctatatgaacaaaaactaatttttcagttccccaattcccccaactaagtattgcaattgtgatttgtattggaggagttttttagacaattgtggaagcattaatatttttgtgatactaaatatttttatcaagaaatatggtctttctctcacttttttcagtttctgttctatgccatctggtaaaatattagtgttttcctgaggtaaactacattgttttctgtcgaagtctcttatattttctaaatgtgtaatactgtaatctataaacaaagtaatttgctgcttctttgccaatatttgtatgggtttttagtttcttgccttattgtataatgtacaacctaagaaaacaatatcaaataaccataataatagttctattcttgtctcattcctgattctaatgaaatagctataaacacttacctttaaaattacatttaattctgtctttacaggcttagagcactttcctgttttcccactttcatagaaattatatttagaatgaacggtaaattttatgttatttcatttttgtctttttatggaaatttatatactcatgtaattttttcctcctttaatttattaccctaaaagatcttctgatcaaactcattctggcctttctaaaacaaactgttcatgttcacattcttttcatatgctactgaatattttattcagaatttttgcatctgtattcataagccaatatggtcagtaactctctttttgttatttctttaccagatttggcattaggatcttttcatcttttaccaaacaatacaattaaaattatgtgtttggttttgtcttatgtagaattgaaatgtaaaataatctaattttggctactttttagtttgtaatttcaactttccttttagataaagggggtacatgtgcatatttgttacatgcaaatattgcatgatgctgagtcttggagtacggacagatcccatcaccctggtagtgagcatagtacccgataggtagttttctaacccagcccctttccctccaccctctagagtccatagtgtctattgttcccacatttatgtccatgtatggtcaatgcttagctcccagttatgagtgaaaacgtgatatttgattttctgttacagcattaatttgcttaggattattacactgtggaaagtagtctggaaatttcttagagaacttaaaacggagttgccattagacccagcaatgccattactaggtaaatacccaaaagaaaatgaatcatcctaccaaaatgacacatgcactaggatgttcattgctgcactgttcacaatagcaaagacatggaatcaacacagatccccatcaaaggtgcattggataaaaaaaaaacttgctacatacattcatatggaatactacacagcagtagaaaagaataaaatattgtcctttgtagcaacacggatggagctggaggccataattcttgtccacttttcaaatggtagatgtttaatttcatttctgatatttctattagttcactgaagttttctattttttgaaagtcaattttgatagtttattcttgagggataacatccatttctttatcagtgaatatgttgccttggagtatataatcttctattataagtcttttttcttttctgtttccgttctcatggctcatactctatgcctttttttctcttttctctttctcttctatttcctttaaatgccttaccagaagtttatctctctcttctgctctttctctttttcccatttaataatgaactttctacatttcagtatttatggcttttatttttacaaattgttccattagttattttctggtttactttgatattctctttataattctttgaatatttacttggctattttaagacattcttttaaaatcgggtcttttaaaacttctactcttttaaattcactgaggtgttgtgttttggccatattcaggaacttgcatttataaaagcacccccaaatttttgaaggtttccttaaaattagttacactattttctcttttactccttaacgataaaattttcaacatgatattaatacattcactgctaaaactctcacacttattgtttatatttcccctgataaacagatacacatcgtcccatgaagtttgtggcttgtcagaatgggatcacaagtctctttctttaaaacccatgagtccaacaccacataaattgtgcagagtgctaccgaaaattcagttacttcattctattttgtgggcttctggctgtaaaggccatgtcactcttcaaagaggctgatatcctgtagccttgggaaaaggcaatgtctccttaatgtttctattcactaaagtatcttgctcaaaccctggacactgcagattctaaaacagtatagattgtaggtgtctggtgaaacagtaggcactaaaacttagagaaatcacagttaaattcatcttgtgccaagtttaagaacttaaccctatcaacacggactcagtacaacgcagaatatgtcccacagggggttatgtggggcacagtatatataacagggggatatgtgtggtccaggaggtgagagaagcagggagagaagcaattgttgcattcctttgcttctgctgggcgctctgtgatgctatatataaaataaggtaagtgtgcggttgagtgggtagggagaaaggtgaggcatcttaaggcctggtggaaggtgactgatttcatcctgtctttgttatgcatctgataagcaggtttataaccagtacctgtcagtgttcaatatttaacaaactccagttaaacaggtaagaggtcagcagtagcttataggccttggttctattatccatgtgcccaactgcagccatcgtgggctggtgttaaaattttcctttcaattgtcatttttctaataattgcaatcagtgagaggagaagaaaaagttcaagggaatgacctgacctttcaccatcctacacaggagatgactgatgacatggattcatacactaatgtatatcgtatattctccaaagaccctcaaaaatcacaagaagttttgaaaaattctgagatcataaactggaaacagaaactccaaatccaaggtaacaagtctgaagaaatgggcaagcagctgtgcttctcaaattgtgtcttcaactaacagcattagcatcacctgagagctcattagaaatgtaaattcatagaaactctctgagctgggagaggtggagcaatctgtggtgtgccaaggactatagctgattgtggtgtaaactcaactttgaaaactactaagcactgaggtattaatcaggtgggagcaatgtaagtagagaactgcatgtctgacaatattgctttcttggctttctctcaggttttcaagaaagtttaggtgaggggataaaagcagctgcattttcaaattcagtgaaggtagagcattcgagagcactcctctttgttacggaagatatcctgaagctctatgccaccaataaaagcaagcttggaagctgggctgagacaggccacccagatgacgaattggagaggtacaaaaaacatgtgctgatcatttataattgctattccttgtacatttttgtaattcacataaatcagttttggaatgaagagacgatgaattcattccttgggatgaataaaggttgtcaatggtcaaaatacgccactttgcaatggtgggtcttttaacaagaagagggcctgggatctctagaatggaagggcacctagaaattacaggagtggggatgaaagttgttgtctttctttttgttttctacagcgagactcccaattttaagtatgcccagctgaatgtgtcttattctgggctggtaaatgacaactggaagctagggatgaataagaggagcctgcattacatcaagcgctgcctaggagccctgccagcagtctgtatgctgggcccagagggggtcccggtctcatgggtaaccatggacccttcttgtgaaataggaatgggctacagtgtggaaaaataccgaaggagaggcaacgcgacacggatgatggtgcgatacatgaagtatctgtgtcagaagaatattccattttacggctctgtgctggaagaaaatcaaggcgccatcagaatgaataaggcactaggtttccttgaggcctcctgtcagtggcaccaatggacctgctacccacagaatcttgttccgttgtagacaatgaagctgcttagcaatcttgggcaagccatctcttaatattaaagcagacaccacagaatagctttcttcacttacaaatgttgattgggcatttatgatatggcaggaactccttctcacatggagacctgatgttaaaggacacagccatgctcttgaggagcttacaatccaagctggaggcaggggagggtatagtctttaaatatgcttaagtgttgtagggaaggacagagttaccaataaacatgtaactagaaagccaggctcagttcttacctctgggaatcagaactctttatgaaacttgattgatagaatctactatctggaagataattgaagaactttaataaaattgtcaatagaatatacctaatctatatggatactttattggaaagaaatacccctgctatgtatagatttatgaggcaatggctatactaaagaatggaatcagtctcttagtttagtgactagcaaggtatcaaaggtgaagcctcagacaaatggctttcctaggctacctttcatcattgttatgcagaaaaggatctccagagaatcaagtgggctggtcttgcggcctctgctatggaaatgacatttgttgtgcctcctttcccctactctttctcacttcctcatcattagtgaagcatggcacaggacaaggtgttgcctgtgagtctggttataaattcagcttttgatgtttgcagcactgctatcttaaggggtcaagggcattccagggagaagagaccactaaggtgaagactggagagtgagtaagagtgagccatacagtaaaagtggaaaaatccagatgatggaaagggcacgtgccatgcactatcataataactttataattgaacacttatattacaatctgaatccctgatctcaaaaaaaaaaaaagaaaaatactcttcatgaaaaaaacgtggcctcatttggctctgctctcccaccctgtcattggagcttggattactgtgaacattgtagccacagcaaaaagaaaaaaaaatggcatttttactccttctgatagtctagattttaaaaaaacaaaagaaatcttaatagaattgtcttttggagtaaagtctaccagtattaaacaacacctcatctctccataaaaaataaacctccacaaaattgaatgtttatacttgatgcgatttgaaagtgtgcaattccagcacctaaagaatagtgtaggtcatggagtttttaagaaactccaattcatcttagaaggctatggtagatctgttacatcttagtataaatcaatccaatcagatttctaaactcctgagacctggctgatttgttacattgactgaaatgaaagcatggtctgagagagagagtaaacatgtcatttgggatttcaaagggtggaaaattcttacctaaaaaataaactcaggaacttggagtcatataaaaacagctatattttggcactcaagaggcaaaagctaatacagatgatgaaagaacacaaagaaaataagatttgcctattcaaaatggtgcctcgggcaggtcctgtatccagaagaggatgttcatccagggtctggggctaaggtcatcttagcacagcccagctgccagcttccctcctctgccgcttccctgaacacaagccagcttcccttatctagcccttcttggccctgttaaaaaagtgattcctaaaccttatcatgcacttggattgaaaaaacaacaagaaagcatgggaaagaggaaagaggattccttaaatatggcacaagtaagtccaacattatcaataaacgcactaaaaatgaatggggtaattttcttattaaaatatatgtttttcatactgagttaaaaacaaagtccaaaaagcatacatctctgtgccctcacatggtagagacagaggagagctcagactctcttccttttcttagaaggacttaataccatcataggggctccacccttatgacttaatctaaacccaattacttctcaaaggcccacctccaagtccattgggagttgggtcttcaacatatgaatttgggggtcactgtcagtacataagaaagcatatctgaaataacacacaagtgttcacggaaaggaaaaagatatactaaatgaatgtgaaactgaaaagcaaagtaataccatcaacacttggcaaaatagaacgtaagttgaacatctgctaaatacagaaattctcccacaacatagatcatgaatctgcctcaacacaacacaactacaaactatacatggcaaaagctgacggacatacaaaagaaaaatgcaaatccacagtctcagtgggagaactcaaaaaacttccctcagaaagcaacagatgatgcagacaaaaaataaagacaatttgccaaaatgccatcacaacttgatatttctggtgatgttggggttatctgcttactgtgtatttgagaacttctgttcacctgcttgtcaaactgaccagcagggggtgctgcggagggaaacactccatctggagaatgctggcaacttgtctcttaagtctagaggctccttgtccccctcatgatcatcacctatgaggtgcaagcactgctgatacaggagctaaaaagaaattattaagcagttagtgtaggtaagagagtcctcggtaaggtttttcttttaataaaaagcagcccccatataatttcttttctagcaaaaatcagcctaaaaaatcaagccacaagcatacataagcaaactaaaaacttgcatagctaaatgctggcacctatgcaaatagaaaagggatacttggaagccaggcatcctcaacatagaggtttcctcttcctatttttttttgtttgtttgtttgttttttcagatggaatcccgctctgtcactcaggctggagtgcagtggtgcattctcagctcactacaccctccacctcctgggttcaagcaattatctccctcagcctcctgagtagctgagattacaggtgcccaccaccacgcatggctaatttttttttcgtgtttttttttttttagtagaggcggtgtttcagcatcttggccaggctggtcttgaactcctgacctctcgtgatccatcgtccttggcctccgaatgtgctaggattacaggcatcagctaccacgcgtggcctcctattcccttttctttgtattcacgtgtgcaggcgacatggcacaggccaggtagaggccccgtttgcatactaaagattcatgtgggatggccaggctcttcatgcatcacataaatggcacacctgctccaaccaaccctctgagccctatgtaaatcagacactgcctcctcaagctcctctataaaaccaaccacaactcgccccaaacccggaaacctgctcaggcacctttccaatgcatgaggaaactctctcttcattcttttgcctattaaacttttgctcttgaacccactcctttggtgtccacatctcaatttccatactgtgagacagcaaacctctggcatttccccagacaaacgatgccgcttcactgccatctcaagcccaagtgccaaaaatgaccactttagtctgaagaatgccacagctgccaccatgctgcttaggataagcaaggacatgaagatggagtggggacgggtttattagagaggccgcaataaaagcatatcccaggcaactttccacttcttaacttctgtcattttcaaacttaaaggtgttttttattgttgttggtttgcttttctttttaacagtttctatttctggccaaaagactgctttttgttttcctgctatgacatatttattctttgttcaaaagtcttttccatgatttcatataggaactaagaagacagccatgtgtttgctcaacacattgatcccctctccacctagaactctctttactgtttctcccaggaagattccacccctcctgttctgccagtttcctcatatttgcctcatacaattgcccttgtaggcagatgaacccgggctagttctactttactatggacaccaaagcttctgaaataacatctgagtcttgggatttgcatatgaatcttcccttgacacagcaaacagtctttccttttaccttcactaaagtcatctacttgggagaatggagagcactaaaattctacagatttcaaaaacaaacctgctgtgcctttccagagtccttggaatgcaaaagagaaaataggttagaagggatattttctccttcctttcttaccttgaaggagctcctatttttaaagggaatcattggggacaatccaaaagaaactcttgcaaatcaagctttgccatgccatcacgagaagggtaacatgtgtgcccagtggtgaaatttttaaattttggtaatgatctccagggtcacccctatggataacaaaaatattttaaaaacctataatggtgccagcctttcagaaccctgtctctttgcaaggacctaccaaggtctagagatcatagcacctcactagcagcctacaggcattctccaaaggttcccacctgccccacccaacatacacacacacatacacacacacacaccctcctgctatcctttggccctagatttcacctaactttattctaaatcttaatcaccctgtgcccccaaactcatgtgttatagggccttggtaatccctttctaagcatattccctgacttcttaaattctatttatgagacatatatctaaagtaaaactatatttcaggccagatcagcacgcttcttattacaattataaacactgaacttcttagttgctgggaaaatatattgaaaaggcattattatgcttgtatagccatagattatctagggaaaagtattgagtgtctcgagaatgagtgaaaattgtttccccaatatacacctttttttcttttgaaaagtatatcctgcgtatattcaaaagataatgtttttcaaaaggggaaattgcctccactgtggactcttattaattcacttatccatcaagttctcttattaactcacttatacatcatattcccttattaactttttattcaatcactggtatttgtttctagtgctcataattgaacacaaatttgtttactattatataaaataaagtaacagctattcaccgtttcctcctttacctcaataagttgacatcttccaatagatttatttccctgttttgctccctcctcagatccagatgagtgtgctaagtgatacaaaatgcttttattcctctaccgttcaaccccctgagcccgatgttttagttccacgtgttttagttccaggtgtcacagaatttcccttgcagtgtgtctcatcaatttaaagaatccttctttaaaacttttcttacacattcccagagagcctatcattgtccatttagagttaactctctacataaaatttgtcaatttttttttactcaccactgtttcctctccttattttctgctcctatctgaaatctcttttcctatttgattaaattgcttcttcagtatttcctgcatgtacatatgctaccgatataatatctgaagactctcaaatccacaaatatctttctttgaccctcacaagaatataatttctgcagccttatacattgacaaatgtttgtcttttaccctcaagtgactgattccctatgacatcacattttaggatgaccaaatataattttccactttatacataaggaaactgaggtacaaagaaacaaggtagccttgaactttcattcaaggtcacaaagctagcaaaaagtggatgactagcgatgaggtcttcaggttgagattaacaaacaacatcacaggatataataggatttaacccaacttcaacttcataaaatgaatggacattccctgatcttccctccactcccacccccacctcaggggatttcaggatgcactgggcaaaactgtctccctccatccccaaccgtttctcaggcagtgacaggtgtcaagaactcctcgccgcccttcttgaagcttacattctggagcagggaggcagaagctaaaccaaaaattaaaacaactgtgaacatattccctataaactcagatgtagtatatgaaaacaacacatgatttgacgacagaagatgatggagggagaaagaacaacaaataaataggaaaagaggcctcagataggagcaggtaaaaaggagagaaaacaggaaggggtcaggactggtttccctcaaagcctgtcatttgacagagagctgcagaaagaaggaatagagccaagcacataacaggagggtagagttgcagtctgaagcacccaaaatggtccactaggatggacaaaggacatacttgaaccaccacttagattcatcttcatctaaaaaataagaaattaagtgtgtgtaatatttaattatttagtacattaattacagtagaatatatagagttgatgctcaatttgttaaaaaatagatatctaaaattaaacctcagagattactcttgcctatgacaacgagcttctgaaaggcaaggataggtctcacccatctctgtatcttcagaatccatcatattatgtggaacataataggtatcaatagtatgttggggaaaaaaatcgaaaccatgctgagcaccggaattctgtgtaaatctttttaaaaagtctcttctactttacatcagagtcccttttgtatttttagtatcatccagccccacgccttgcagataagcccctaagaaatgaatgggtgaatgaatgtgtggacagcgggatggatcattgagtgaggagcagtgattcgcaggacctgcatgcattgaaatcctgccaaagcagcctctgcaaaataaaagaccttgggctttggtttctgacacaagttaaaattatccaaggactctccttgggccacttagttgaggtttcctaatctgtgaaacagaaaatgaattcaatagaaagatgattgagacaaatttctggaaggtgccaaagcaggatgcctggcattgagggacgcttcacacctgttatctctctccctattctctcttcacccctactcccgcccggcaactccccgctgtcagctccaggaatacttacctgctgagaaaaggaaaagcacaacactgactttaccccgcgacgcttttaaaaactccaaaacacccagcgcgatggggagtaggtttccctaaagacaggtggagcagccatagttaacttagaggaaggtgaattgacaaagagggttgagccactacgagcgggagttaccttggactaacagttgtatcttcagcgagcacaagtcctggaatctcccacgcccatccctttttttagcgccacaaatgc

SEQ ID NO: 1618 - DNA, 45739 bp, Homo sapiens
ttaaaataagatgaattattttatttctgaattctgaaggtctgctgggcttggccaggtgattctcattcttgtggtctcttatgaggtcagtggtggctagggctgaaaccatctcaaagccttcctcactcacatctcatgggtgatcccagctgttgctggaacctcatctgggactatcggccaaaacactcagaacttctccatgtgtctgggcttcctagaagacactgttcaagtagagggcaagacaatcaagaatctcaagctctatttcaaaacatttcttcccactccactactgctctatatatttttcacaatactttataccttctaacgtaatagttattatagaggtacacgtatgtcttactataacataaactccatgagggaagatatttttagttttgctcaatgaaatatccccagtgccaaggaagcactgccctacacattcatccaaatagtaaaataataaatatctatttttaaacactttgttaattctgcacacatttactttttctaaagggagaaatgtggaacactgaaaagctccttgaatcttagaatttgtttttaattaatagacttaatacatggcataacatgttgtactcaacttactcttcatgcaacgtgtaagcataaatgccaaagatcttactttcaagcatcagcattaatatagcaagttaggaaggtagacggtttggtaattacaaaagctcttgaagtaggcaaaaaccattgttttacatggtagccaagatcacactaatgataagtatttctggcttaaccagtcctcacagcaatatgctaaattaatgaaaacaaacatgggcattgtttgggtgttactgacatcaactacaaaacagaaatgaacagaaattgaaaactatattgtcaaatacaattaaaatagccaaatacatttctaggtaaaatctttataacttcaaatactgccagttttctttcaaaaacttacagtacttgaaagaacgaaaatcagcttaatccagcacaggggaaagaaacacatgagataactgaattttacaaccaaggtcagagaggatatcacactatcaccgtgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaatttttataaaattcctctgataagtatgcttaaaattaacatatttaccaatgtcaggatgaacactagtattttccaattaacttcccagcttccagacttttgatctattactttgctgtgtacttactttgatttgataacttggtgatttatgtttctccctatgcattcctgtttgaaagcgcctatgtcctccaaccatgtactgatagagctgctcaggcacattgagatcagacatacctatcaaattgctgccgtgctggaaaagacaataacagacgagtgaaaagaaattttatggaggaagatccataacacatacccataacaaatataaaaatgaactaacttcaaagcaggttatttcgggttttgttttttttatttccaacttaaagcaaacattaatcatgagttaataaatattaataattctcataaaagttttaatacatgaatgttcaactttaagtactgtcttaaaatacataagagctttagagttagttacatttaacaataaagaaaaatattagttatataattgaaacctgaactgtaaatatctgaatactttcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcaaagagggattaagcccaaggttatacagctattatagtaagttgcagggctatatataaaacacggccatctggttcaacaatccatgaagctgattaagcaatagacaataatgtagttaaatgacttgactcactagttaggaccagaattcaagttgcaattccctgtgtgattcctttcttttttttttgagacggagtctcgccttcttgcccaggctggagtgcagtggcacgatctcgactctctgcaagctccgcctcctgggttcacaccattctcctgcctcagcctcccgagtagctggaactacaagcgcccaccaccatgcctggctaattttttttgtatttttagtagagacggggtttcaccgtgttagacaggatggtctggatctcctgacctcgtgatccgcccatctcggcctcccaaagtgctgggattacaggcatgagccaccacacccagctgattattttccattataccaccagcctctttagctcacgtgccaatgtgaattcaaggccctaatagatggtcaaccacgaggtggattttcagaacacacatgagaaaaaattccttccactacaacttttttttttaagatggagtctcactcttgttgcccaggctggagtgcaatggtgtgatcttgattcatcacaacctctgcctcctgggttcaagcgattgtcctgcctcagcctcccgagtagctgggattacaggcatgcgccaccacacctggctaattctgtatttttagtagagatggggtttctccatgttggtcaggttggtctcgaacccctgatctcaggtgatccgatcaccttgccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatctgatactgcattttgtcacaaggaagatgctactgggacaacattctgggatacacagtgaacatcactatggcaaaagggggttagggtttgtttcaagcagctactatagactcttaaggctcctgatcatatacattttcactattctctgttttcagtcatagtgggctgtcacttattcattctatgtcttgaacactttaaaaaaaaaactttattccctttagtttgttcatgaacactgtaagctggaggaaaagaaatcttaaagtctcactcttgaccacagtttctctcaatttgcaaatctggtaccttgaaaaatatccaaaaagacaagagagctgggcagaagattaagtcgtagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactttctgtcagtgcagtattccatttcaggaccaggaggccgtcctgtaaaaacaaaagcaacacagttcaaactagcttctcaaaatctcatctcataaaaatcttagagttaactttctagcaagttgcactggagatacgaatgggatataactattcagaaagttatgacactataataaatgatgtccacaactgtaggtttacctaccaaaaaaaaagggcccaaaatagttctttttaaattgccaatttaagtctttataagcaatgatattcaaatactgtgaaactttgagtcttatcaaaaaaattaccaagtagtagaaaaaaattttaaaggaaaaaaggtaagagtattcaaaaaaaagttttattattttttttaaaacatctcggccaggtgtgctggctcatgcctgtaatcccagcactttgggaggctgaggcaggtggatcacttgaggtcaggagttggagaccagatggccaacatggtgaaaccctgtctctactaaaaatacaaaaattagccagggtggcaggtgcctgtaatcccagctactcgggaggctgaggcaggagaatcgcttgaacctgggaggcggaggttgcagtgagccaaaatcaggtcactgcactccagcctgggcgacagagtgagacaccatctcagcaacaacaacaacaaaatatcttacattttgttttcattactttcaaatccacacatcacatgtggtgaaacatgttcgaatgatgataatgaataaggaggtcacttacttacgttgttaagctgttaaatactatgtttagacatttatttcgagtgtatataataatgagccctactatggtagaatttctgtgtactgatcctagaagtctgactggatacaaaattcacacttttaaaagcaccctataactctaacactaccttgttgaaaacgacaaaatgtactatgtattaaaacccttccctctgaaaaaatgttcacattcctgaaattttatccctataggaaaaaaatgcaatttaaaaaaaaagaaaaaaggctgggcgtggtggcccttgcctgtaatcccagcactttgggaggccaaggcaggtggatcacttgaggtcaacgagttcgagaccagcctgtctgacatggagaaatcccatctctactaaaactacaaaaattagccaggcatgctgacagacacctgtaatcccagctacttggtaggctgaggcaggagaattgcttgaacctgggaggcagaggctgcagtgaaccgagatcgcgccactccgctccagcctgggtgacagagcgagactctgtctctaaataaataaataaataataaaaattaaagaaaaaatcacacacaaaggtaatcagtgtaatgtttatacataacaacaaaggattattagaaacaatctaaaaggttctaaaagttaaaaaaaggcattttacagaccatcaactcaatgaatattatacaaaatgtgttttaaaacccatttataacaatgatctataaaaacaatttttaggctgggcacggtggctcacgcctgcaatcccagcactttgggaggctgagacaggcggatcacaaggtcaggagatccagactatcctggctaacaccatgaaaccctgtctctactaaaaatacacaataattagccaggcgtagtggcgggcgcctgtagtcccagctactcggaaggctgaggcaggagaatggcgtgaacccgggaggcggagcttgcaatgagccaagattgcaccactatactccaggctgggcaacagagcaagactctctcaaaaaaaaaaaaaattttttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcctaggtttctatcaacaccacgagagaaacacaccctccagcctgggtcccagaatgaggcaggtgaggcagaacggcagcagaacagccggctacacatctacagcctaaagcagagctgcctgggccaatgctatgcctgtatgtatgtagcatcactgtggcaatagctatctgatacaatgatactaaagaataatacatctttaacaatatattcacaaatccatatagaaaagatcttgaataggacatataagtatgtaactaaattgttgagcatattaataatgccaatagcatttccatttggcagaaaaagatgacaacacattaagatttccaaaaagtttggacccaataaaaaacagagacaatgttcactaaagtgagtgtgtggaccttaccatttccaggttcatcaccaacatacccaccagcatgtaaaggaggaaagcaggagtccattacttgacttctattggaagtgctgttatccaacacagtaaacactgtgatgtgtttagtttagtgtctctcagggaccaaaacaatctactctgagttttaagtgcaggccactgctagacactgctggtaaagccggataaacagcatactcatagctgattaaaaccacaggtacctcattaaatgtgaccactggaattcagtaatgagctagcaaataaacatggaggttaataacctgcagttacattagccttggataacattacttagagttttgttgttttttttaattagtactagatcattctttgctcacaaaagctaccattgtctttccttaatttttataattttactatttaattgggttaatgtggagtggagagtacatgcctatgaagattcagcactattaatcccatacctatctcagccaacaggacttctgcagtatgtctgtgagctgtcccttgatatacaaggccaatgccaaccactgcagccacttggacattgtgaggaacatccagctctgtggacgttgggggtaagagagcaggaatgcgaatgctaagaagccgagtaatagacatatccatggtgcctagttttgcagcagaaacaccaagtagcagtccaatgcttgtcatttcatggccctaagatagaaacaaaacaaatacatagtttaaaataaaatactgcctgccactttcaagaagtacttttatgttgacaggcaaggtgagaggcactgagaatacagcagtaaactaaacaaacatggtccttgctctcatggacctaatgacttaataggaaaaaaagtgttaaattaaaaaacataaacaaatatattattaaaaagtagtacaataagaaagtacaaagtattatgaaagagtattttaaaatagcttaatttagattgggagggactagaggattattagggatgaaatctctaaagattatacaaagaaatttatattaggacctgaaggatgaaaacaaattagccaggaacagtggcaggaaagaggacactcaagtttagaaggtgaggaagactgtttcaggtgataaaacagcatgtaaataaatggctctgaggcgattcagaaatgaaccctcacattaacatcaactgaccacaagggtgccaagacaattcaacaggtaaagggcagtcttcaaaaaacagtgctgggacaagtggaaggacacattcaaaagaatgaggctggactcaacacaatataacaagtgttggcaaaaatatggagagattggaactctcatgtattgctgatggggttgtataatggtgcagtcattatggaaaacagtttacagttcctcaaaaagtttaacagagttaccatataacccagcaattccactcctaagtatgtaccactacttaccattacttcattactcttgagtaatgaaaacatacatccgcacaaaaacatgtatacaaatgttcatagcagtattattcgtaatagctaaaaagtacaaataacccaaatgttcatcaacttatgaataaaatgtacattcataaaataaaacatttattcaacaataaaaaggaatgtattgctgatagatggtacaacatggatgaaccctaaaattatcaggctaagtgaaagaagcccatcctaaaataccatattttgtatgactccgttcatatgaaaggtccagaaaaggcaaacccatagacacggaaagtagattagtggttggcaggaagtgaagtgaaggtgggggggtgaggtagaggaatggggagtcaccactagtgggtacaaggttcctttatggggtgaaaagatgttctaaaattaacagtggtgatggatgcacaactctgtgaatgtactaaaaaccactgtaccacacactttaaacagtgaattgtatggtatgtgaattttatatatttatataaataaagattccttaaaaaaaaaataacgctgtgaagtgaaagagtttagtttgccagagagctaaaatagccaatctgtatggttagagtgtgggggagcaagaagagtggggctgggtgcagaggctcacgcctataatcccagcactttgggaggctgaagcgggcagatcacctgagatcaggagttcaagaccagcctggccaacatggtgaaaccctgtttccatcaaaaatacaaaaattacgcaggtgtggtagtgtgcacctgtaatcccagctactcagaaggctgaggcaggagaattgcttgaacctgggaggtagaggttgcagtgagacgagatcacaccactgcactccagcctaggtgacagggtgagactccacatcaaaaaaaaaaaaaaaaaaaaaaaaaaaacgaagaacagtggtaccacctagggctggagaagtgaacaggatcacaccagctcctagaatgtatattaagagcaatggtcgatccccctttgccctctggtgttgggaattttggccttgttctaaaccagtttcccttcacagaagttcagccatcgtgtgggatcagaataaggtcctggggcaactaaaggtatctggccaagggtacatccgaaggaccctacaccggcccccagtccccaacagcctgttcaggtgtcggacaaagacttccaatctttcctatcatgtttttcctactgctcttctgagaaatgttacttagttatgtgtctctttgagaaattgcttcttttcagggcaggatgctgggttatgcttgatgaagctaaataaactgccagccagatgagaattatagacaaataatatgcagggacccccccggattcatcttagtcttgagctcatatagaattcagagaaatcaaaggcagttgacaaggagggtcaaggctgagtgcaagtgaacgcaactactcctgctggcttgatccccccctggtcatgaatggtggctgcgcgcacatccacgaccaaggtaagcctgagagacgccttggactctagcacagcagagggaaagactaaggatgcctttttctcccctctctctttctaaatgggtagcctgcactcctctcaagtgcgagacattgggactcctttgatcctcagactctgaagaaaaaatacctggtatttatcagtagcaaggcttggcccagctagaagttggaagatggggagacctagtcagctggggaaaataacaactataatactatcctatagctagatctcttcaaccacagagaaggaaaatggtccaaaattccatatgtataggccttttttgccctgcagaataaccgcaagctctgtcagcaatgtataatagaccttgcacttatagcagtgatatccagccagacttaatccagacagaagggaaaaaacagtctgcctccttagaagaggagacagaggcccctgcaccagcccaggtcccagctcctcttggatcatctcgtcccccttatccaggcccccttttgaacctcatcctgttagaagagttcgacctggatgcgctccagcatcacttcttcctttacaggaaatgcatagtgaatatggtcctatcaaagtacaagtccccttttctttacaagatttgaggcagataaaaagaaatctaggacaattgtgtcgacctggataggtatattgaagcctttcagaaccttaatcaaatgtctgagctttcatggaagggtatcatgttacttctcaactagactcttagagcttcagagaagcaggcggctttacaggtcactgagacatttggagatgaaatgtttatcttattatggcacctaccaaaagggggaagaaattagggagccctttctgacagccaagcaggcagcatccaccaataatcctcaatgggactcagacactgctctaggaaagtggccgagaaaacatttttagggatgcacagtggaagatctgaaaactagaggcaaatctctcaattacattaagttatcaaccataaaccaagggtctgaagagaacccttctgttttcctggaaaaaactgagagaggctttaattaaacacacatctctctcctgactctataaaaggatagttaattttgaaagacaagtttataacccaagcagccccaaatattggaagaatgctgcaaaaagttagctattgcaccagacagtactctaaagaaaatcctgaaagtcaccaccttggtcttttataatcgggaccatgaggaagcccaagaaaaagggagaaaaggaacgagaaaaaggcagaggcactaatagctgccatacaggcatataaacctctcgatcccagggagcttctcattctatgaccgactgttatcagtgtgggagcactaaaagagagtctgcccccgaaatcagaagcagcccccacggccctgtccaatctgtaagggagactactggaagacaaactgcctccagaaacatacgtcccaaggttcagagccggcttctcaaatggtccagcaggactgatgggtcccagggctctcctccccagctctgacagcccaggctgcattaccatccaggagtcccgggtgagtctggaggtcaaaggactcagaggacagacttcctactcaacaccagagcagccattcctgttctcctctccattctgggcctcccctcctcccttagcacaactgtgaggggcgtctcaggaaagcctctgactcgatatttttctcaatcccttagctgtacctagggagacctttcgtttacctatgcctttttaatcatacctgaaagcccgactcctctgaggtagggatattttagctcacatgggaaccaccatccttatggctccaggacagactctttgcctccctctggtggagactgatattaatccaggtgtttgggcaattcaggaaaatactggctgagctacaacagtctcaccagtccaaatccatctcagggatctcatctccttccctaattaaagacaatatcccctaaaaccagaagctaggaaacaactagaagccatcattaataacctaaggatgcagggccttgttaaaccctgtgacagtccttgtaatatcctaatattggaagtacagaaagaaacccaacagggaatggagactggtccaggatctccacctccttaatgagtaactggtgtaattaaccaatttacccagtggttcccaatccctatactttgttaacttagatacctgaaggaactaaatggtttgcattcttggaattaaaagatgctttttttctgcataccattataccccaactcccaaaacttgtttgcattcagggatccctccaaccagactacccagctaacctggatggtgttaccacagggattccaagacagcccccacctgtttgggcaggcaatctcaaaaagatctctctgagttctttcaaactcaagttagtcttaatatgtagattacactctactctgtgccccaactgaggaaatttctcagaaaagcaataaggctcttcttaattttctaactgacagaggacataaagtttcaaagtccaaggctcaactccgtcagacttcagtgaagtacctatgcctggtcttgtcagaagggaccaggacactgggcgaggagagaattggatccattttctccttccttctccccaagaccctcagctaactaaagggattatcaggcattactggattctgcagcctatggatcagaaatctaattaaaagcattgcaatgcctaattataacatatctaataatctagggggacatgcccatgacaaccctattttgcaaaatcctggaatagaacagtccattttcagaggttttcttcctgtcctttctaggtgtccctaatatatgggcatggattttcccccttttagttcctctttgtgttctcattgtaatactcatatttggtccatgtgtacttaacctccttgtaaaatttgttttttctcgcctagaggccatcaaactccaagtggtcatgcaaatggaacctcggttgatggctctcttttaccaggggacacttagataggcctctaagagagacctgactgctgtttcccaaaacaacaccctctgtcagcatgaagcagaacagtcatcacccctatccgaacagcagttagatatacctcttcagagcggggattgatggcggtaggaggcaggtaaattctcagatgaaactcaaccttcaagccaaggacagtcgaaagcctgaaaaccaagctacaagttctggataaatccatggactagagagctctcattcctgtttggcatgctctctcctgattggtccttatccttcacctactttacatatacctgcccttccccagttggtcctctacactatcgtgcctatttctaaatggtgctttttcaagcatacccacagaccaatcagcatgcacttcccccatttcaagcccataaaaacctctagactcagcctcgtggctggcaacccaccttcgggtcccctctcgctgttgagagctttcttgtcactcattaaattctactctgccttactcagggaaaaaaaaaaaaaaaaaaagcaatgggagatcattaattaaatggctttgaccagggaagtgacatactctgatttatgctttagaaagattattccatgtactatgagacaaatggacttagaagtacaagaatgaagaaagaagagcaaatagagcaattaggagctactacaatagccagccaaggcacaaagccaggcactgggagcacaggtctcaccttggtcaagtagtcatggatattgagagtcgccagcttggtaaggtgcccattcaaacccagagccatgagaaagccagcatactcattggccaactcagcatgcttgggcttattgtaaacaatccaagctgagtcgatctgggaggcaggagctatcttcaggccagcagccacaccattatgaaagctggcccagcttgtcatgttgggaggcacatcgatgtttccactattaaggtctactgttgtgttccgaggaggggcacgccctatccagccaaacgaagaacattgagagaataaaaatccacaaaaccaagattgttaaatttagatctttgagactaagattacttacgttttctacattcaaaaccattaaccccataatgcctggaacgttaggtctctatgaccacttaaaacttttgtacatgtgagtcaaacttaatggaactggaaaaaccttcactgtctaaacagttcattgtcctttttgttaaaatgtatgaggctatataatgagataactgataccaatttaacattatacagagatgactgggataatcactcattttttctttcaaacagagagcttaaaaaccaaagtgaagactaacatcactgttaaactatacaagttataaatcccaacatctgatgacactgatgttaatttcaaatgttctatcctatattttcccctagacattaaggaaaaatgacatcttaagaaaagacaaaagccaggcctggtggtgcgtgcctgtcccagctacttgggaggctaaggcatgagaatcacttgaacctgggaggcagaggttgcagtgagccaagatcatgccattgcactcccacctgggcagcagacagagactgcatctcaaaaaagaaaaaaaaaaaggaaacaagaaccttaataaatctgctacaggtcttacctatatatgcccccttctctctctttttttctctctctctctatatatacatacagatatagatatctaattatatgctatcgtttaaaatgcttagagatagttttgtaaaaagcatccttttatagacttgagtcacccagggaacttcaaaagggcattcaccagattatacttttacggtccatttatttaagaacaatgtaaattatatgttcacaatgctatatgttccctacgaattttttcttgattcttttctttttgatctacattatacacagcaaacattgaatctttttaaatatattttgaatattgtcttaagtcatggataaaataattaacataaatattttaattactgcataaagttatccatttcactgcagctttaaaaataccatttttaaagagttctaagatgttatgtaaaataaattttaagtagatgcaaagtgtcttatttgtagcatgtacacatacacacacaaagcacaaagtaagacttatttgtctttactatatgctttttgtacctaaaagctaactcaactgctagtgttagcaccacaatgagtaataagttcataagttacacttgtactttctcaaaaaaggcagacatatcaatatgaaaaaactgagtgacctttctgaaacattcattcatcatatgcaagagacataatatttatacacgagagaaaataaaatgcaaagggtaaggtaaattttcttcaatgagaataacaacatacaaaagtacaacaggccacatcagtgtgggttaagcaactatttaagaaaatattctttcctaaattaagaggataacctttctttttggcctaccagaatgactaaaagaataaaatgttggattaatgtcataaacacattttaaatcatgcaaattcaattaaatgtattcagaaaaaaagatgcatgtatatattttttaaacccacccaagtatcacttgagtgctaaatcacccagattgaatacattttaacatttgccaattttgcattagattttctttttaatctgcacttagtatatgaaatctttcatataaacagttggaaagactactaaaatgaacatctatataccatgccttccatcaagaatcaataattgttaaaattttgccataggtgctttacctctgagacaatttaaatattaaaagccactctgctcactatgtccctcagtgagattagggctcagaataagcatggtatggagatgggaatgtgttctttcacttagtcaatctcatttcctgcatgctgctcaaagcacaagcttttcacaaatctgagtggaactctggattttttaaagtatgcaatttaaaatactgtataattatgtttgcatatattatgtactatttatcatatattaaattatacattatatgctaccacatatactatacactactacaacatacattatacatacattttgtataggtttcacaaaaccatatatactataatagagtttcagtgataatttcaactatgtaattgtcacctttagaacacattcaaatcagcattagggggacatgcactataaaattcattgtaatcaagattataactacagttatatatggcagaaataaaaacttgtgccagccagaaaggcaatttgacatgttccttaaaaccattcatcttgctgtcctaagagttctacttctaagcatttagcctaaatacacaggacgaatacgccccaacaatgtttataataccaaaaaactgtaatttccaacaataccaggctgcttctataaactatggtatatccgctgaatgaaatactctgaagcaaataaaaatgaatgtattgattaaaaacacgtgtatacaatacatacacataattataaacacatacatttatttgctagatataaaaggatgttcactgtaaatttttaaaaaaatctaaaatagatataaattttctgataattaaacaaatataaaattataaatatgtggaaataaacttagtaaacatatatactaaaatgttaaaaggagtgatgcagaagagtgggagtactgcaagtgaccattgtttctctttttgcttagtacatttcttgatttatacaatgatcatctgtttaaactatgacgtaagacattttaaaactaaatatttttacatattaaacttaagattatttaaaattcaagtctcatcgttatcaataatatctttctgaacttctccaagtgactttttagatcttgaaatcacctcattaaaaagcaaaaatgagtaatgaactatattctgcttctctcaaagtttagtttcacatggcatttgagctttgataaccactacagcagctattaggaaaattttaaatcactggggatagagggagcatttcttttgttttaactaatttaaagaactacacttaatgcatgtacttaatcattttcctttctcattgagcccagaatttaacataccagtcagattcaatttaggaataggcaatggctctgttggaacaggatggtacgaaaacaaggtaaacattcctcgtcctacaggaagagccatagttcgctgacacaattggagcaatctgtaattaaagtaaaaaccaacatgtgaaaatgtttaaagcaaagagcaattgaaatatcatctgtaagtatttcaaaagaaggtgtactgtataagatgaagttgtctcaaagtaaattcatacacagatgtgagtgaactacccaaacatgattattttcattttaatattcttgttcctattacactcttagggagagacatatttcctctgttttgtttcatatttacattgaatgaaaaccacctggcctataaaccaagccgactctctctaggcattcaaaaaaaaaaaagaaatttaaaattccactccgatggatgctaaccttctcaaaggaaaatacagtacttttggggtttttatcactgtgttaatttcagtctagctgtcctcagtacatgtgggatcctcctcccatcccttttgccaatacagcctcagaagtaccatttctgtggcctgtacacaagaaaagaaacaaggtccttgtgttagaggtgaatggatttcatggtgtctccaagggaaatacagattggtttcacttacatgatggctagatttataggactaataccattatgtatcaggtatgttcaaggttaaaatggtttctgttggctctactgtgaaattaatacaccactcttcaacttcttcctatgttaaaatagcttaacattccatatagccacttaaaaaaaactaacagaaattttggaagtagggcatttataactaagaaacgcctatacaagctatatctgaagacacagaaatatcccttcagaggctgacaactgacaaacattttctctgcagacaaagctattcataagcatacaccctccttaactggacacacataactgcttttctagctaactggaaagaaaaattttgctgtcttaaagattctctgggaacacaaccgcaacattaatttgggatcaggaaaattcaaagccaagagtctgttgcaacccatagaatttttttagaggaaatcttacacataattcacttcaactttgcacaagtaacaaaattataatgagaacaatattatatcccctgaatataagatgccactcataagatgtatcattatttcatgagaaactaagaaagaaaaagcactgccaattaaactatgacgcctgttcactgaaatacacaactgatttcagagatattaaaaagtgaaaaaacttgcatcttagaatcaatgaactctactactaataatggctgactgcactgagctttactatgtattgagcagtattctaagtgctatgtaaaaataattcacttgatacacagcaccatcccatgaagtatgcctacttttacaaatgaagaaactgaggcaacaagaggtaaagtaatttaaccaaagtcacccagcacagcatggccatgcctggctctagaggccatgctcataaatcctatgctctaaactcaacttctgtcactccatctttttattcacaggtgactaataactgggtacatgtggagaggaaacagttaatagggaaatcacaactaattcagatcttcagcagcctgtggctaagtgtgggtgatggttcccctcaaaacagtaccataaaaaaagtaaagagaactagaaaacagtggcagatgaatgatagatgatagagacaagcagataaaagaacaggagagaattttaaaacagaagtgtcccaagagaatagctctggaatgtcataggcatgtgagtcttataatgtatcaagggatgtatcctgtgcaggggagtggcagaagaaaggcttatctatttttatttggagtatcatctatcatatccaaaaaaaaaaaaatactcatataagtttaaactacactaaaaaccccactaacctcaaaatctattcctgatcaagacacagaaaaacaagtccagtgttttctttgtttgtaaattcttaaggtaactatcaggcaaaatagttttacattcaccttttctaaagagtaaagtgttatatgtatttcaagaggaggacgatatgaaatacaacaattacgtcctcaaaagccaaagacattttgctaacacacgtggtttgttgaagttggatgaaaacttaaaacacagggcatattttcacttgaaagtatcttttaaatctctttagggttttaagtgctaaaaacttgaaggaaaaacaaatatacacaagacacaaatgtaacaatgaaacatgacaagagatagtgcacgtgttttctttcacctgttttccttttcctcgatgaactcgtggtcactgagctctgggtactgcactacattgacacggacaggatgcgcactctgaagaagccttcgcacatcctgcacccttaaatcttcactccatattaatgacatgacctcgtgattcatgtcattcatgccgtcatcttcctcctcagtttctgttcctgaaggaacatctgatgagagcacctgagtaacagactttattgtaataataatttcaaaagcagttaacatgcacttgctgaacatgaggatatataggctgatgtgtcatgactatactagcacagagaaaatatgttttccaaagcaggcatgggttggagccgcaatgtatactgggactctaatctacaaatctttctaaaaagtactatattgctggccgggtgtggtggctcacactctgtaatcccagcactttgggaggccgaggtgggcggatcacccgaggccaggggttccagaccagcctggccaacatggtgaaacccggtctctactaaaaatacaaaaattagctagccagacacagtggcgcacgcctgtagtcccagctactggggaggctgaggctggagaatcacttgaacgcgggaggcaaaggttgcagtgagccgagatcgtgccactgtactccagcctgggtgacagagtgagattctgtctcaaacaaacaaacaaacaaaacaaacaaacaaacaaaagtactacattgcctacttggaaatatttggaaatgacggggagagtttaaatttaggacaacagtcaaggggctggatacaaacagagaaatattctgaataaactataaaaaaaaatctaactcatcctgatcattttaaaaaagaaattattgcaagtagaatatgaatactagtcactgctaataatgctaatttaaatattgtctgttcattaatagaaggagaaggaaaaaagcctgaaaggatatacaccaagggttgggggaagtcacacaatgaaatactttcttactttactacttttaatagacaggatcatggttggatttcattattaagtttttttttttttttgagacagggtcttactctgtcactcaggctggagtacagtggtgtgatcatggctccctgcaacctccacctcttggactcaagcgatctttcaaccttagcctcccgagtagctgggactacatatgtgcactggccacccagctaattttttttattttttgtagagacagagtcttgccctgttggccaggctggtcttgaactcatgacctcaaggagatccacccacctcagcctcccaaatagctaggactacaggcacataccaccacacctggctaaattttttaaaaaattgtttaagtagagatgaggtctcactatgttgcctaggctggtctcaaactcctgggctcaagcagtcctccgccttggccaccccaaagtgctgagattacaggcatgcgccaccacacccagccagttttcactattttttaaaaaatgtgtttccaataaaaatttcttagaaggaaaagtactgaactgcagcgaaacaagtaagagggtaaattccttgattgtcatcatgttctaagcccagcatgtgctttaatatggggcttcccagtccaaataattaaatctaactgcaacacagatgtgaattgcatggaatcatatcatattctctcaaaaacagtattatactcttttaacaaaagaataactccaagttgaaatgttaaagttttgcaacatttaatgtgaaaccaacaaggtcagcctgaaaaaaaagtagatacgaccaaataatcacttttagttcctaaaaattcatttttagttcctacaaaatatctaatttaaaaaaaaaactgtattctaatgggtgagttagctataaaacatagtctcaaacagtgacaaaataaatttagatgggattaattataaaatgtagcctcaaataactgaacaaactgtatttagacataattacttaaaatcacgttcaaatacagattaatgttttaatgctaatggtgctgaactgctctctctcacaggaaaatcattttataagcaaaaagatttgttttctgtttaaaacaggatgtaaatactaattcaacgaagagctgtgatagaggcgcagattaaaggagagagatgctgggatgaccctgctggagatcagatgcccatggaaactgactccggcatgggtacacattaggcaactctgaggttaggaataagttttgatataggctctgaagaagtagtaataagacctaaggtgactcgtagttacaatgtactgattattatgtattgattcaaaagctactaagaggcaaggccaaattcccactgtcttctcagggacatgaacataaaagagtcaccaggagtggaattattattcctgaatcctccttgatgagattctactgttcattttttaaagttacctagaattctagaataagttttaaaagtttcattttcaagttttgaggatgatttaaaaagataattggagagtaatgaaataatttaactttctacttgcaggattcctagaactcatttaaaaaaaaaaacagacttgatgactgatgaaagacagtatttcgggagggatagcttaagacatgtttttaaacaactctactgaaaaaaacacattttttccctggggctgcagttttatgtgattaaacaaatatgtttacacctatttaaaaggttaaattcaaaaaattcaacacatcaaaaaatatgcagtagaaaatacttatatataattactcatccaaattcaggatatatgtgctctcccttttcctatgtaataattacaaagtggttaattactaatatggtacaagtagggaaatagccatggtagtttccatgactaccctcaggacttgtcctgattcaaggcaaagaaagatccaggcacaagacagaacattcacaaaatctcctgctcctaatgctcatcttaacaattaataagacgcgtacaattacaaaccccgtctggcatataatataaaagacaagctaatatatatacttagaaaaagccttaaaggaaaatgaagaacatttctactttatgattttatttaaggctaaaattggaactctgaactttctatgttgatactcacagacttccctttgggtaagtttccttcgcaggcctgcttggaaagatcctgacgtccaatcaagagacagacagcttctggccagtctgaggcaggctgttcacgacagtgataaattgcatctctgatgggaagagcaattccaaagggaagagtttccaaatctcttaaagtgaatcctaatggttaaaggaagagagaaaaattttaatttagactcgccactgtcccaattatcctgactgaagttggcaacaatatctatcctgacaaataagttcattttattcatcttactaccagactaatgtcttgacatcaaggactagtataggaagtctctttgaaagaacttgtaaaaacctgaagaaaaaaagacaatctaatagaaaaatataaaggacaaaaagacatttcctagaaggggaaacataaatgggcaacatgcatatgaaaagatgctctacctaattagtgatcaggaaaatgcaaattaaagctactgagaaatataaatgtcaaagccaatcaatactaaatgttggcaactatgtagagcaataataattctttttattcttttttttttttttttttttgagatggagtctcgctctgtcgcccaggatggagtgcagtggcgcgatcttggctcactgcaagctcctcctcccgggttcacgccattctcctgcctcagcctcccgagtagctgggactacaggcgcccgccaccatgcccggctaattttttttgtaattttttttaagtagagacagggtttcaccgtattagccaggatggtctccatctcctgaccttgtgatccacaagagcagaagaagattctgatcatcatgacaggacaaaaaacataaactaggaaacagggacatacatggcatatatggtcaccctaccagctgcagaaagcataattggtgaattatttgcccaactgctccagatcctggtcagtagcccacacactagaattatagttgctgagcccatccccccttattccaagaatctctgattggctgccttggaagctttagctcttctcactgtcataccacctttggttctactgtccaaatgctgaccttctgttataactgcaggcagcctggtggtcaagcagatgtccccaagaacttcctggggttctctctgaactttgagccatttagaatcaccaggatgccttggtcactgtcaacatcaaaatgtgaatcttcttagacaccaccggtagttaccgtacctctagaggaactgagggttcttcacccacaaatgaagaccatctctaaagtgccccatcacattctagaaggatacagctgctggaagaaaataaagtgtcccaccaccactcccacagttcttaagctcatacacaccaacaaccactccaggaaccaactgaagacttcaaatatcatagtaccagagagggttgatgccaaacccacttctaaaactgtgttcactctcttggagttaccaaacaggcttcacaacctcaaagccatttcacaatctccccaaagtctcaatctccccacagtctccccagtcacaatctccccaaagtctgccttcccagactttgctggtgactgccatcactgacataacaacgtggctggaaccctgctgctgccaaaaccaccctccgactctctggccaagtcaaacccctcacaccactatgggagtagtgagaactctctgaaaggccactaacacttctgtaagccacaactaccaaaacaagtcctctgagcccatgccactcacagtcttgtcataccacacctaccagtgaacagtattgccttataagcatatagttctgactcaagcagcgtcaagcctagccttttcacaggataatttctaacagttgggtctacccatgagttacacgaaccactctccagattcaatgagcttctattacctctgttacaactatcactcttgtgagtacagactaagttaactcataagactgtttagaagatgcctttgctacaaagggcactcctcgaaagttcttcctaccctcccagacatttacgatgtgtgaagagaaatgccccaaccagtcacaatctccccaatgtttgaagtagtcagaggtatcacacagtaaccttgaactacttctcttaggtgccaataggactatgaactccatgaataaaatcagctggtactaaaaatggtaactgcttataagtcaaccaccaggtcaaagatggcttactcaaaaaatgtcacaagaaaaaaaacatcaaatcaaagtgaccagcctcactgcctagcaaccaacccactcactcattcacacagaaggcaaaattgaaaggtagctgggacgcccataggaagaaaacagttaggatgatgcaggggagactgatacaaggctgttattctaatcatcccataacagagacagagtcacagctagggaattattcaggaattaggaaaagttatttctggtaaacaaactcccacatactgggttaaaatttctttggaactttatttatcatgaccctaggagctctagtcatatatgcaaatggataaacaacaaagctataaaagcagagggttttaattttgcttttattttttaaataatagcaacaaggaactttagtaagaataacatagtaaaactagacctgtaaaagtcatcaaaagcaaacatgacaggaatagcataaagtaatttgtgaaagctagtattatcaaagcactgacagaagaaaaagaatgatgctaaaaaatacaaaacacttctttcaataccataccttatcaatggcttttccaacccgagaaacactgctgtggatgtctttgtggtcggaggccaatttttgaacagtatcctttattcttttacagcactgtgtcaaaacaagtcaaagtgtccctgataattcagcatcttggcctataaaaaaacaaaggaaggattggttactcacttaagcaaacccaaagatggcaagtttctaatgggccttttggaccatgaaagatggaagaaaagtgaagaaaaaccagtatctgctttgaagctgatggtcacattcatagatgtgatttttcaaatggatactcagaaagatataatttttttattttttggaaataagaaaattttactgtgaaaggaatcatttttatcattacaacaaccagcacaggctgtgaataatactgtcaaggcagtattatttttgagaaaatatgtctaagtgaataaactcacttattaaacccagttacactgttcaagtcattctcaaaacgttctggttgttactaaatttcctcaagagagatgatttagtgcaaatgcttcatattccatataaagaggtagaagaaaacaaacttccctgggtaccacgatgtgcagaaaggagttaacacagcaggtcatagactactacccttagaaagtcctgcttacaaagtcacctcttggctggcatatagaaacctgggagtttgggagtgttcccatcactccctaactcagtgttccccaacctttttggcactagggaccagtttcgtggaagacatttcttccacggacgagggctggggggaatggtttcaggatgaaactgttccacctcagatcaggcgttagttagattctcctaaggagcacgtgagccagatccctcgaatgtgcagttcacaacagggttcatgcccctatgagaatctaatgctgccgctgatctgacagtgggtggagctcaggcggcaatgctcgttcaccgctgcttgcctcctgctgtgcacggcctggttcctaacaggccacagaggggtactggtccatacccgggggtttggagacccctgccctagctgaaaagaatggctcattgtgcctaaactgttgtacagtgtgatttatggtgaacatctgctttccttctgggaatctagaatgttgatacatgctaggcagtgagtacctggctttctcctggcttggagaaagcttccaatagtcctctcccagtgaagtcacatggaatatgcttaattcctgcagccatggtttgtgagaagtgttaagtgttgcctaccagggaagctcattagaagctcagtgcccagggtttttattgggggctggtcaccagggcacccactgcctaactctggactgcctaactttggactttggacttctgccccatgagtcttttccctttggtgattttgctttacacccttttgctgtaataaattctagctaagagtatgattatatgctgaattgtgtgactccttttaatgaatcactggaacctaaaggtggttttgaagacccctgacacacatgagatcaaccaaaagttactacagtttacatcctttccctgagctacctccctccaaattttgttcctatagcaggaaaaaaaggaggagaagggagaaaaacagacagataaaacaaacccagttatggtatttgtcatttctctctctatctacgtattcccacctgtaagcaacaggcctggtttctgaaatcctaaccaacattatatagaagagcttcttgaattttaatttacatcagaatcacttaaagttaaaacaaagtagctggaccccatccccagagtttctcattcaataggtccgggatggaacctgagaatttaaacaaggagcccaagagtaaaacagccctaggatgcctgctcatttaaccaatatttattgagcactcactatatatgacaggtacagcagtgaaacaaaataaccaaaaatcccttcccaacaacttaacttctggcaagagacgtaacacacaaaataagcaaattatatactacgacaaaagatgatacatgctacctgggaaagaaaagcagggtaagagagatggggagtgtgtgtgggtggagcagccgcaacttcaaaacagtgctggcatggtaggcttcactgagtagatgacactggaggcaagacttgaaaaaagtgaaggaattaccatgtggctggctactttggggtaagcatgccaggctgcggggagaaaagccctactgcaaaaatacacctagactattcaaacaacaaagaggtcagcatgtcaaaagtggatttctggccaaggaaaatagaagaagaggtccaagagataatggtcctggtttggtaggatctctttggcattgtaaagacttatgcttttactttgactgaaagggaccactgcaaggttttgagcagagaaggcatgtaaactaattaaaaaaaaaacccacaaaaaacatttttttttttgagacagggtctcgctctgttgcccacactggagtgcagtggcacaatctgggctcactgcaacctctgcttcccgtgcttaagcaatcctcctacctcagcctcccaagtagcttggatgacaggcgcccaccaccacaccggataatttttgtattttttgcagagacagggcttcattatgttgcccaggctggtctcaaacttctgtgctgaagcaatcctcctgcctcggcctcccaaagtactcggattacaggcgtgagccaccatgcctggccgataaaacatttcaatatggtcagtctaactggcaacgggagtaccagaactgagcaggaaaataagaggctgtggcagcaatccagatgagaaatgacactggctcagtccaggatttcatgactggacatgagtgaagaaaaggactcacagatgtctccaagatttctagcctgggtcaactagaaagatggagttgtcttcagttaaaacaaaaacaatctcagcacttcaggaggccaaggcaggaggatcacttgagcacaggagtttgaaaccaaccttgggcaacagagtcagaccctgtctctacaaaacatacaaaaattagctgggcatggtggcacacgactgtggtcccagctacttgggaagctgaggtgcgaggatcacttcagcctgggacgtctcggctgcagggagctacagcactgcactccagcctgagtgacagagcgagacctcaactccccatcctgccaaaaaagaataaaggctaagcaggtatgaggggagaggagagagagaaagttcagtttggggcttgttaagtttgagacattgagtaggcaccgcagtgcataagtggaggagttggtgagatatacaaacctggagttcaacagcagtgttagtgctggagatacaaatttgtgagtcactgacattatatatatatatatatatatatatgatacttaatgcatgggactatatgaaatcaccaggggagtcagtacagacacagagaagtgataaaagaactgagtcttgagaactccaagtttatgaggctgggaagaaatagaactggaaaaggaggctaacaaagactactgaagcactaactgtgatggaggaggaaactcaagaaaagtataatgttggggaaaccaagagaagaaaatgtgtcaaggaaggaggagtaaccagctgtgttgatgtgctactaggtcaagtaagatggggactgagaattggccactggatttacaatgtggaagtaatcagtgacgatgacaagaatagtgtctctaaaattctatgaaaagaaatcctaaaaggttacagggaactgtgaagagggactatattaagtctggttcaatgacaactactgagataaatgaaaagataagaaaaaagctttccttatctctaaatacagttgcacaaagtttctatcaagtgtttccaacttccaataacacaattaggcttccaacttctaataacataatttaggctaaggcaagacttggtacttcaagaaaatttcaaaatctgtttaaaaggtgttccacagatttcttggaccaaaagcatctaattgcttcagcagctctgttctggccatttctgatctttctgtacctaaagcacacctaacctcaacagcctcatcttctctatgaacccatctgaccacagacttactccctcttctgaattcctggtaacttctgatctctcccctactcccccagcacttaattataacccattttaacaatttcatgtatatataccgtcatcagtctctactaaacataagcccccaagggaagaccaagtccttattataaattgtatactccagttttatattaatagtgcctgcaaatgtgcaagacatataagtatctgaattgatggtaaataaagtgaggaaaaaatagtttttgtttttgcttttgttagagccatattcaacaaatggtgctgagacaacaagatatccacatgcaaaagaatcacataatatataaaaactaattcaaatgagccaaatgcagtggctcaagcctgtaatacaagcactttgggagcccgaggtgggtggattgcttgagcccaggagtttgagactaacttgggcaacatggcagaactccatccctacaaagaatacaaaaattagcagggtgtggtggtgcacgcccacagtccaagcttctagggaggctgaggtgggaggactgcttgagcccagaaggtagaggctgcagtgaaccgtaagcatgtcactacactccagcctgggcaacagagtgagaccctgtctcaaaaaaataaaatcaaaaataaaaattaactcaaatggaataaagacctaaatgtaagagctgaaactatcaaattcttaaaagaaaacagatgcatttctgaccttgaattaggcaatggtttttcagctatgacaccacaagcacaagcaaccaaagaaaaaataattaaaatggacttcatcaaaattaaaaacttgtgttgcaaacactatcaataaagtgaaaagacaattcatagaaggggagcaaatatttgcaaatcacattctgataagggtttagtatccagaataatataaagaactcttaaagctcaacaataacaagacaaacaatgcaatttaaaaatgggcaaagcacaaggcacagttcacgcctgtaatcccagcactctgggaggccaaggcaggtgaaccacttgagcccaggagtttgagactagcctggacaacaaggcgagactctgtctctacaaaaaaaatacaaaaatgtggctgggcacagtggctcatgccagtagtcatagcaactagggaggccgaggcaagtggatcccttgagcccaggaggctgaggctgcagtgagctatgattgcgccactgcattccagcctggatgaaaaacaagaccctaactcaaaaaaaaaaggtcaaggatttgaatagacatttttcaaaagaagatatacaaatagccaacaggcacacaaaaagatgctcaatattattggtcattatgagatgaaaatcaaaactacaatgagatactacttcatgcccacaagattggctatcaggaaaacacaataataactgttggaaaggatgtggagaaattcaaagccttatccattgctagtggaatataaaatggtgcagacaccatagaaaacaatttggcagttcctcagaacgttaaacagttactatatgacccagaaattccactcctagttatatcctagttatatacccaaaagaacaacatgtccacacaaaaacctgaatcagaatgttcacagtagcattattcataagacaaaaactggtaagaaaccaaacctccaaagaatgaatggataaacaacggattatccagtcattaaaggaaatgaggtactgatacatactatgacatagatgaaccttgaaaatattacattaagtattcaataagccagacacaaaaggccacatattgtgtcatttcatttgcatggaaggtacagaatagacaaatctatagagacagacatagattaatggtatttggagtgggaggagacagggtgggaatggagagtgactgttaatgagtactggatttctttcagaaataaagaaaatgtttttaaaaagaagtcatacctcctatccatccagacacatttatttctacaaccagcagacaacaaggtaggaaaaacacaaaaaataaaaagggtgccaggtacgatggctcacgcctgtaattccagcactaaggaaggccgaggcaggcggatcacttgaggtcaggagtctgagaccagcctggccaatatggtgaaatcccatctctcctaaaaatacaaaaattagctgggcgtggtggtgagcacctgcaatcccagctactaaggaggctgaggcaagagaatagcttgaaccctggaggcagaggctgcagtaagccgagattgcgccactgcactgcagcctcggtgacagagcgagactcggtctcgaaaacaataataataaaaataaaaaaggatgaagccaagctggaggaaagaggtcacctagaatttaccactgaacttccacgcaccaaccttgaaatccaatgatattttcaaatcgtagtaacttacatatctggagtttggtgctatttgttacctccttttcttcctttaccatctacaaattcctctaatttttggttttcaattttatgaatgacagatacaagcagtttatggccaattaattaatactgagagttctcagaatgctccaaggaaaaataatttctgtaaggtatttggaaactcaagaaaagcagaatggaataatctgaaagagaaccctgggaaagccctgttaagagagaaagagttcactaatgcattttcaaatggactcagtggaaagcagccaaaggtttaaaacaggtttgaaaattgctataatgaccagactgacagtcaaccaaacttctataagtcctactgggagagttctaacgttcttttgatttctctgtatgaaaacacaacctgcttctaggagaacctttatgtgaaagaaactggattcagttcctagaagaaaagctggggaattactgtgacagccatctccaccataactacatccaggttggccactgcggtggtcacttgtcacccagaagaaagtcctgcactaactgtgtcttccaatgtagtaaacccagggaacccaggcccaatgcatgagcctgaaagaaacaactctgacgcaatgctcactcatcactggagggtcacaagtactttttaaagtcagttttatgattaaacaagtgtaagaattagcatgttcaatataagcaaagaacgaacatatgtagaccatctacgtgtgttgctttattaagttaaaattttcaataaaatagaacagcaccttttatcatataaacagattttaagcacgacactcaaaattttcaagttctgcccttgagcctcactgctttgccattttaggatgtatgcccactagtttcacagaaacaataaataagaaaaatgtttgtttccatagcatcctatacttccctatcagagtttcacactttgttgtaaatagttatttgtccattactcccacaaaattaactttagtaggaaatatgaccaatccccaacgtttagtatagtaactggcaaatactacacgttcagtaactagttaccaaaagaataaatatgaaaataattaattatgtattacataatctcaatttcaaacccagcattgaagactgtctggtactaccaacaccctctgaaattgccagcagtttcactcagcagttcactgacccctcactctctcacagaatgtttagcatctgctacacagtaacactgcagcctaagttctgcaaataccaagtaagttaggaaataatactgttcctgtctgtcaataacattattgcctaagtagaaaatcccaaagaatctacacacaaacacaatccaagaatagatgagagttcaacaaggtcacagtacccaagatcaacacaaacatacaaacacacatatgcacacatattttcaaataagacacattcacaaaagagtcccctggcatcagttataagttccttctctcttccaaataatgacctctcccaccaaccccaggaattaatgggcttgtgctctgactcaagtcacttttgagacagtttcttttttacaaaactatttccacatttgtcaaagatgcaatgaaacatctctaatatataatgtgaccctataaaagtatattctaagtcagatataggaaggtataacaaacgtacacattaaaagggtgactggtttgcacaaagctaaaaactataaaatccctactaataccttggttacaccttcaatacacttttagcattttgtacatacatttgttttactttcttccctactgatcacaagcctcaaaaaaaagcacgtctcgtgtccagctccgtgacaagatttacccactattttggctcaccttaatacaatctagacaaatatatcattaatattgacaagtacgtttctcatccctactcagtatctgcacttttaattttctgtctgccacttatttttatgatatggggggagggggttcaactctgcacaaacacactgttaaagatagcattgctaaaactaaacagctggttggtaggcagcacaccatgttgcagcctgaaatgtctgccatcaggagataataaaaagttctaatttggtctataaaaggcagtttaaaggtgtcaattacaccatgaaatacatgctgcccacgagtcaaacacatgagagatgagacccaccatacttgagagcactctataaaaaaatagggaggcacaatataaaaaagtattgttatggtgatgattttcaagaaggttgaaagtatcaccacctaagactggaatatttccacagaaataagattccgcagaaatcactaagacctggcttgacattttaatgaatatcctataggcagtaaaaatttaaaatatccaagtttataaatattacatgtatcgcatttgagctcttctgagttatgaaaagttaactccactttcataagatggacagagatcttaaatttagaattaagtggaaagcaaaatggaacacaagttttgatgcagataaatacaaagaaatccatttaggaaacaaacctaactgtacctaaatgaaaactcagacctcatagagatatactccagaattcattctagattagctatttaaataaaaacactaaaatcagaaagctaaaagagtattaggcatcactaagaaggctggtggggggggaaatctatgatataccactcttataaaagccttgatgccttaaaatacaaaatgaaaccaagaaaaaacagaaaaaaatgtaaaagggagaactatgacatttagagtcaattaacatttattgagtgctgaaggcctgtgtcagcaatgttcaagatacttttcccatgttaccaatttctacacagatttaagaaatttagaatgggaataaagtagataaaggataaaaagatctaagactgactctagaaaagtcactgacaaggtgaccatggatatccttgcgaagtactagaatagaaaaacttgaaacttgaaaaggtaaggttggaattttttaaaaataagggactatttcattttgtctgtagtaaaataaactgcggcccattgaaatttgggattcttgtgagctacttcagcacctaggacacagcggctgcttagaggaaagagaaaaggcacaaatagaacacattcatttttttctggaggaggtaaacactgaaaacaaaatttttccagtatattagtagctggtaaatctgcaaagtaaaagaaagtatggtatttggtgttcaactcctgacctttcagagaacagtagactgacagacacgtgttctgatccagagagattattaaagactgtgcatcaaattagaggcacagtgtgctgcaaaccaaacatgaggggaaaaaaacgaaataaagttaatatttagagtgaaattacatggtacagactaatagtgctcctggagcaaagaacagtatcaatgactatcatagagaagacaggaaaggcttcaaagtatatgaggcaagaattgcagagagaagaaaaaagatacaggcacaagattttaaacatatgtctgtgacagtcacattttagagaacctattcactcccttcaaattccaaatataaagacttaatctctaggcatctcatttatctctgaaatgaatggtggaaccacattaggtttcctgtagcattggaatctggatttcatatttaaaaatcaaactcaggccaggtgcagtggctcacgcctataatcccagcactctgggaggccgaggtgggtggatcatttgagttcaggagttcaagaccagcctggccaacatggtgaaaccccatctctactaaaactacaaaaattagccaggcggtagtggcgcatgcctgtaatcccagctattcaggaggctgaggcagaagaaacacttgaacccaggaggcagagattgtggtaagccgagacactgcaatccagtctgggcaacagaatgagaccccccctcccccaccccccaaaaaaacaaaaacaaaaacaaaaaaaaatcaaactcagatttccaccttcccctctcctaaacttcctattttctacctggttccataatgatctacccatcattcatgtttaaaaccttggattaacctttggtttttcctgcccttttctcctactctgccagactccatctgtgcaccaactcctggtcattccttccctcagaaatccctttcatgtgtccctttaaatttctaccaccagtacccaaagacaggtccctatttcatcaaatctaggttgacacttagccttagctaaccttcttgcctctagtcaaacctcactcccaactccaaaccaacctaaatactgctgacaactggtctctgatcgtgtccctgtcccctccctattcaaaatgtccccaccccaccccaaagtaattcaatatcttcccagtctactactttccctggtatccatggctttacaaaacctgattccaatttaattttaatgctcttatcgcctttcccctgcaatctggtccttcacctctcactcctctacacctttgttcttgccatcctcccctccaggcactccatatagctctttctgctatccatattcaatttctgctactaaaacttcccataggtaaaaagagtctctccttgtctcaaatcctacccctttttgtccacaccactcatgtagcatctagcctagatacataaccgtgcattacagggcactgcttttgtttgtgtgtttgttaaaaaatgccagtctcatctccctaactggacacaaagttcttagaggatgaaaatgcttgttctttgtaactcctagaagattttgcttagttctacctataaatggtgattaataactactgatgaggtgatctaaagttcagttgaaataatgcccatctactcccatgcagttctttctaagggctctctctcttcactggtgtctgtactaaccagaagcactgttacacactgtgtgccatggtcttgttttttccccctttcaaatatgagtctggtctctccaactaacttctaagttccttaaagactcttataccttttaagcattctttacaatgttaagcagaccactggacacagagtggtatttaacataaaccagtaataaagacacctaaatattacccaaaatgtctcaattaaacagtgcttgggcccggcgtggtggctcacgcctataatcccagcactttgggaggccaaggcaggcagattacgaggtcaagagatcgagaccatcctggccaacatggtaaaatctcgtctctactacaaaaaaaaaaaaaaaaaaagtcaggcctggtggcatgcgcctgtaatcgcagctactcggggggctgaggcaggggaatcgcttgaacttgggaggcagaggttgcagtgagccaagatcatgccactgcactccagcctgggtgacagagcgagactcagcctcaaaaaaaaaaaagcttaacaccacttaaggcacagactttataaataacacgtctaccctgttttacaaatttcaaagccagttcacgtctattatttatttcactctcataactctgtgatgtcagtttactgaaggaaaaactggctaagcaagattgtaggatcaggccgggcgtggtggctcatgcctgtaatcccagcactttgggaggctgagacgggtggattacttgagcccaggagttcaagatccccctagccaacatagtgaaactccgtcactactaaaaatacaaaaattagccatgcattgtgcacacctgtaatcccagttacttgggagcacaagaatcgcttgaaccctggaggcagaggttgcagtgagctgagatcacacaccactgcactccagcctaggtgacagagtgagactctgtctccaaaaaaaaaaaagattgtagaaccagtaaattggcagtgcaaggattcaaacccagacctcctgggcccagggtcaaaattttaggtactattccacaaatacagattcaacttctcaattagcctccaagttcctggaggaccagggccatgaataatttcttttaaaagattctctcctcaactcctcccaaatgtcttcatgtatcaataagatgaattaaacctatatgaattctgcagatacaacaaactcatcataaataacacacagcctgacactacattgtgcccccataacagacgaaatcaccatccaggcctccatcttaagtggagaaagacttggtaatataagcctatggcctctccaagcgacattcccaaacaaccattttgagctcagccacacaatcaccacacccatataaggtgaaagcatactgtatttctcaaaatcctcgagtcctgccagacagtctagtctttgttctctgaagggttgagttaacatctaatctaaagagaatggccagaagtgtctgctactctcagagctttcaaggaaacgtccagttagagagcatcatctcctggaagtaccacgggtctccaagtacacatagctcagagccagggccctccataattttctccctaaactgcatttttggatcatttttaaagactttggaagccttacagatgaagaagcagggccctaaataaaaataagttagttttaatattccaagtgaacagtttgctaaaacaccattttcatcatcctaaagactaagagactaagacatgaaaacaacagaaacttctctattagctctagtatgacagtatcacagaagtgttggcaagtttctccttaccaatgttattatccagagttagaaactactttagaaataaaataactttaggaaaattactttactatgtcaagcattaaagtaatttcaaaaaagttctagaggaacatgaaccaagttgtattctctagtctatagattaagtcatactaacaactcactacttgaattatatgagcattatagttaggaggccaggcaaaagctgagaaggcgaggctagtcaggaaaacatctcagagaatgttactgatataacatgtagctgttgcactgtaatagacatatattactctgtctgggtttaagtgttcctttctagaactgtctctttacctgatgaacagtgtattataaggccatatacctcctgagggggtgagcacagctcaaggtggccagaagacctcactccctggtcccagttactgattcagggaaaggatccataacggaataataaaggtactccctggagtatctccaacaaaatggccatgttcctgtcttttgagctccattggtcatctctaccccatgtgaagaaaactaccctgaaaatgaagccaacagttgacagaagagaacaagatcagtcctgatgacatgcctggtgcccctggagccagcctagccctaacctcagcctatttatacatcaacaaattccattttaatgaaaactattatgtcacctgccagtctaaatgaatatggtgccaaataaaaaagaattaattatctccagagtacgtctggaaaaagaatggctaacaaagttaaatctacttctaaacccaactggaaacaccaatatactgactttttattcttaccacctaaaatggcctaaataacttgagaaccagtccgttcttctcttagaatgtttgaacaatgtccacccaaacttttatttatgacctactgatatactattttccagactagatgttaaaaacagatatcaaattgtattcaaaacaaagtcactattctctcaagagtgtcttgttagtatttagcaaaagtctgggtaacaaatgggcaacctggctatgaggcctactccatgcacaccaaagaataaggctaaaaaggtaaacaagctacaagtctaccaagccccgatataatacatttactttcattcaaaacaatatattcaacactggtcggctctgaaaaagcacagatcattcatatatacaaataagcatacttttcaacacatgtgtttaatatacacaacccaaattctagattggaagattatacctaacatgcgaccctcaacctctggtttctgtgtactgatgcaatatcataccacagcaatgagttaaaaacgtgacctccacaagtttctttttttgtttttcatgttttacttgcctacttaccttctcatttgttaccttcacatttttaaaaagacagcagttctccaactggtaaccaaagtttcaacagtttctttgattcaccgaagagataagggtaggagttatggtttacatgagttttactactagaagtcacaacatacacacacaccaaaggagttttaggtgctaatacagtatatgttgatcactcccacagatgaagacatctttaccaacttgcaaagtgagataacactaagccttaatcatagtaaatggaaatacatatccgatgcgttaaagaaaaaaggaaaagtgacaaatcgtcatttcactggattcttttaaaattttttctggaggtcgggcgcagtggctcacgcctgtaatccctgcagtttgggaggccgaggcgtgtggactgcttgaggtcaggtgttcaagaccagcctgacccacatgttgaaaccccgtctctactaaaaatacaaaaattagccaggcgtggtggcaggtggtgcctgtaatcccagctactcaggaggctgaggcaggagaattgcctgaagccaggaggcggaggttgcagtgagctaagatcgcaccactgcactccagcctgggtgacagagggaggctgtctcaaaaaacaacaaaaaaattttttttctggagactggcatttatgtctgtgaagtgggcaaccaggtggtccaggaacaagagtagaaagatttttcaatgggtgtcttttttatcatttgagtttataccatttgaatgtactattcactgggttatctttttcattgtttgaatggataccatttgaatgtatgacttactaaaaattaataaataaattttaaatttagaaaattccttgaaagtcactttcagaaaccacattagaactccgttagtctaaaaataatcagaaaagaatactgcatgtcctttactcttacaaaaactgcaattttcccaagtatacttttaaatgtgtcctgaaaccattaccaactgtttctgcctaattttctttcacaaagtatgagtgcagaataccagcaaaacatgataaatagttcttttctgtttttcccttccaccacagaggtgctaatgggaaacaatataaatttgccaataggaaaaaaatgctaaaaggcatatactcacaaatcaaatcactaaaagttaaccatacagtagttaaccctgttaagccagggttatccaaagcaccgctcccataccactgatgcgaatggtaattttagctagtatgtaaactaatattttaattgttatgaatttattttaacatgtagtttattatacctaatacctacataccacatgtaggactacacaaatatcactgcctaagataaatctacttaagtaaaatcgtgaatccatctgaaaaataagagtgcacatgtgtatgagtgaagttttagaagcaccagtgcactatacaaattagatcgaggcacactgggaatgaccaccagcctacattaaccacaatgaacttagaccaaacttcgtgctcacagggaaactctcactgaaaggctggcacaactaaatgacagaagctgtgatctctattcctcttaccttggacacctcactgcaggctctggatcactccccaccctcctatctaccaccctaaggtttctaattccaaaggcatgaagagaagtctagagtcagtctccagggagaggaatgtcttggcctcggcagagctcttcagtattctccctggttcttattgcctcttcatatttctattacacctatgttgtccctgaaccaccaatattccctaactgtctatggcaccaagtcgaagcctgcacttccctctcagagccttatattccattattgttctctgctgcaggcctgataccagtccaaccccatttaaaagaaaaaaaaaaagatattcctgttgtcaggctgatggatttggccagaggtggattaaatggcagagcacaaaccaattcaccaggtatgagagaccagcccatactatcctcatttccccaagtgtatctgcattaacaaacttgcattttaaaaaagattaacgagagaaattttatgtaaaagaatttcaagctacttaaaggtgatttagaccacctgagaaattttagggctcactgcaggactatctcccagccagcaatcaggcagtatttacaatctggaataagggtgctgagactagaaaagggttgtcaatgggcttactaactaaactcttatttatgtatgatcagtttccatcacaaactatcctaacagctcatttagtatatagctgtctgctcacaacttcagagatgaaaaaaaaattttaacataaaacattcatcctcagaaactgaaccaatccctttaggttggctaaaggatgcttctgcaacagtcattcaccagtatgatgcaatgatgtgttctatatagtcctcaaaaattctgttttattcataccagattcttgcaagtattaccacaagtaatctcagagaatgaggtccaaagtcctgacagaggggtcccaattagagcctctcaggttatcagaatcatttgcccagacaggtatattcagaagcccaaaaatcttccctttaaacttgaaaatagagttccaaactcagttttcagtaaaatacctttgagaagggcatatttaagtttcaatgtaatatctaccacatcacctgccgagaactttaatttagaaatcatctgttttcaaaaataccatagcccagatgccaaagcatgatgtttacctttacacaaaaaaacaccaaaagaagaaagattttatttgggaaactagacctggcacttgtggtatttattttctttcatgttttataactacctttagtcacttaatcctattattgaagaattaaaggaaatcaaagagataccaatataagactagcaatttggtagacaagagggaaaaaattaggaggctgaaaaaggaacacacaaactcaccaactcagactgtttttaacagcatagcatactgtgtggccaatacccctcaaaccataaattctgagaaaagttccctagtacccagtggagagtcaaaaacaaattcctgcctcagcaatttctcaccatcattttatccatctgagcctggccctaaattttctaaaacaaagctcacaatcacatcccccttcaacttacatcctctctcatggaagaaaggtactttctgttccatcattttcctctcaaactctgcctatgacctggtccctaaaaacgaaatgttccttccacctctccaagtctaggcccttcattctcttcctccactggttccttggcagggccgggagcacagagggaatacctcccaccgctgtactggatttcccacaccgcggttcacatcgaatttttcttcttaacccccagtaatctggcttgtcttagcaattctatgaaactgcaagcacagagggttactgactcccaatagccaaataaaagctgaccaatctctccttttctaagtcctcgcccttttcgatttctgctggctctatctagccttggctctccactcgccaaggaaaattcaagactgtggttagactctagtctttcttctgtgcaatctaagtgatcccctccactgtcctcctagaaatgacatcagaaaacaatcttagacctatgcatctccagccaccagtaaataggaaagccctcgattctatcttcattaagcccttcaaccttacttcacatgtccaaaaccaaattcaaagtcttcccaggattcctgtcccattccaccttcacttccctgtatctaccaactatatcatcatcgccacgtcagtcaaatttcccttcacaggcagccaccaaggtctgctcgtttttccatactagtattgcaactcctatgagaattaatacggtttttccatattaaaatctcatccactatgactgcaggtttgcttccttcctggagttcaaaaatgactgcagtgtccagaatgagaagctgctgtaagactcctttcccatggaccagcacccatcctcaactgaaacgcagtctgggaaagtgtgaaaaaatgaaggagaaggagagagacactcagctaacgccactgccctcatctcacctgccacaaataatctgcatcttcccccagctaccaaaccgtccttcacataaatttctgttcagcccacaagctgaaaagcctcctcagcctcttattaaagacccactaaataagtcctttacttcttgatcaaaaggaatcatcgctgtgacttctaaactgtaagaaaaccaaacctttaaaagtacctgtcctcagggcttggggcagtaaaaaaaaaaaacaatctaggtgaaacgtcttctataggaaaatttattttttttgaacgaacttaaccaggcaaagcaagtaactagcaacatgtgcaccatttacttgggcaaatgtcgcccgttcctcctcggtgtcatcaaaaggtacactgggagaacagaagggttgaattgagctggtttccaaggaaccatgtcagagccgctgcggagttaagagctgcgtccacacagcagccaaatcatgaagttgcaggagcggctgttgttaacccacagctaagaataacgctcgactttccaaaataaaacgaagaaacgaagtcccctggccaatgattcggggcggcacagaggggaaacggagcttcctgcactgccctcatcactcagaacctggggtcccaggcgattcagtcaccgcccgcagaacagcgccgcgggcaccacgtgaaactcccggggccggctgggggcgggggacgaggggcgcccactcgggggtcggcagtttgcaggtgcgatgggcggccccctcacccacgtttatccggactggagcccgccgctcccggccgggtttccgggtggttcgcgctccttctgaattggcagcgaggtcgcggcaggttcgaggtaaatcggacgaagaggggaaaaagtctcaggggtctgggggcctccgcgcctcaggggaggcaagggccgggccagaggcgcgagggtgggtgagggattcccgccgcggggccgggaccggggctcgggcagtgggccctgccccgcgcgcccacgcgggccgccctaccgtggctctgcaggatctcgtgcttgagaccgccggtgtagtcgatgagctcctccaggccgcgctcgcacagctgcccgtagcccgagaacttgtgcagcaccttctccagctcgcgctccaccgtcacgcactgatccatgccggaggcggcggcgctcggctcctcggcgcccaggtgtccgcagccgttcggcccgggccccgccgaggccgcgtcctgctcctcgttccccaagcgggcggcgcgggaggctgaggcggccgaggcggcgggcgcactagccgcggcgccgggggagccccgcgcagccggagcccgcctgccccatggcgccctagccccctggcgagtcgccgctgctcccgttcgctcgctgcactcggccccgcgtccccaggccccgctcgcgacgttcgggtgcctgcgacggcgcggccgattgtttttgttttcacgggaaccgaccgatgacctggttctcccgggcggca

SEQ ID NO: 1619 - DNA, 478242 bp, Homo sapiens
ggatgccaaatcaaagaagctagtaggaagagtgacaacagaaaagaaccaaccacagaggctgctgatttacatgttattgaaatactttgaaacacaatgattaattaaaatgtttcttctgaacaaagagctaaagaactcaaccaatgtcttcactccatcttctaaaaaataaccagaaaaggaaaaggaaaaagaagtaattagaccatccatgcctacctcataggctagtgaaagaagaacacaactaatacatgtaaagtactactataatcaagagaaatatatatgtacatataataatattttattaccaccctttgcaactttgaagatgtcaatcaaatcttttataatttttcactatatatatagctctctctctatatataatataaatgtctagcctggattatactcttgataagaacaaacaaaaagtaaaaataatatgccatgggattattactttggggtattttgaaaagtaagtgaatactttgatatatatatatatagagagagagagagagatagagagagagagaaattatcttttatttatttttgttccttgcactccacgtagtactttcatggtctgtgcacttcaataacaaatattttcccctataaagtgctacttacaatgaagttgctaggtgcttctagaatgctcacaactgtcattgtcactacttactatgtatgccctaataatcatacttcatatataccacctcgataaagcctcatgtcccaaacttttttcccctttctccaggaatttgacctctgctgctccatttctaataatacctgttatcttaactatgatcatctagagacaatgatccaacatagtttagtaattttactccttcaaatttaactctaatttttgaaatttaaatattgtggaaagtatatgacaaagttagtggtggaagtaggagtaggaggagcagagtagatgtagagagaaaagaccttttattatcttaaaaatcacaccaaatttttttcagtggagctcagccttttaatactgaataatattttgagctagaaagcaggtaatgttagcaatcttgaatattcatcaaagggctaacaagtgattaagaagcctgtgtgtgtgtgtgtgtgtgtgtgtacatattttatacagatagtggcaattggtggaatacaaatatgagttttcttttttccatcaaaatttgatctttctcaattcagacaaaattctaccgacatttaacagaacacagaaaaccagctacaagacctgcaaataatgaattaaaggatagtattactgagctataaagtacaaagcattttggaacaagtcagtgttttgttattggagttatttcttgcctctgttgttgtttcaagcccatacacagattagcctacaatttcctattgctttatactttagacggactgaagaattattcaatggagacataggcctttgaccgcattcttggctggctccatattcaatcagctttgccatgctttttcaaaagcagatttagagttgagacagatataaaataccttttgtggtggagagttaaaaaatatgtagtcaaaatctttcctagtccttcctccacacataaacataaaaccctcattctctatttagaaaccagcatgtcaggatccaagcagaaaaatcagtaaaaattatcacaattgaaaaaatgttctgatctgcaacagcagctgggggtgggtattagaattgtgtgtgattcagatgctatatagatgatgaatatggatgaagttacacaacttgatggggtgaagagattggttgagctctttgttcagagaagcatttcaataaatttctgaatgtatttcaaggttactctcaccattttgtgttttctaaatatgagttatttgggggtggatgtcagaagttatggataccaaaccaagtctttttctgaaaagactttagttgccagtaatgaagactggagttcctttgcatgtcactggaattgaaaacgaggatcacattctgtgaagttgtagctatggatacttaaacccactgttatgattgatttgatgaagcaaagatttttataaaattcttgactttattgttagaaactgataatgtcgttataaaaaaaccaaagcacaaataattgtgactcctccttccataaggatgcatattacagaaaaatggaaagaaaatgttgcctttgtctaacaaaatggtcatatactcaaagtttggcatagtgctttcgtatacaaaggaatgatatgactcaatttacataaagtaatatgattcaacatgatttaataaaataaggcagaatttcatttctgttttataaagggaagtgactaaagatttaatatctgatcctttattttgaaaatgtacaaaacctacagccacattccttctgggttaactgtgtgaagagattctcagcatacttgaattaggcgtgacacaagtcactgaaaaagctgagtaggaattaataaatgaaaatatggtcttttggtttttcaaggtcactaaatcaaatctcagccaaggtagtaggggctgtgggtcattaccattctgagactgctaaggagctaagtgaatgaatcagtgatctgtcttctacttctagtgaactgtgtcaaatgtcccccaaagcaccaacacaattatcattaattaaagaactgactaatagtcttagagaaatggtcaatgccattgttaacagggaggccaatctaataaaagtcaaattgtacttcttaactacataattgtttcctttagtaccaagttgtaacagttttgctcgaaaaaggaaaagtcataggatagatatatttttaagtttatgaggaacctccatactgttttacataatggatgtaccaatttacattcctgccaactgtgtacaaggcttccattttccccacatccttgccaacacttgttgtctttaatcttttttatcctaatctgtgaggtgatatatcatgtgtttttgatttgcattttcctaatgattatgaagctaagaattttttcatatatctgttaaccctttgtatgtattctatgaaaaaattatgtctttgggacctttgttcatgtttgaattgggttatttttatgtacttatttacttatttatgtatatttactattgaattgtatgagttccttatcagatatatggtttacaaatattttctcccaatcagtagctcgccttttcattttgttgattgtttcctttgctgtgcataggttactaagtttgatgtagttccacttgtttatttttgcttttactgactgtgttttaattcaaaaaaaaccattaaaaaaaaaccattctaaagagcagtattcaaaaaaaaaccattctaaagagcagtgtcaagtagcacttttcctgagctttaatctagcagattaatggtttctgaatttacatttaatttttaatccattttaattgatttttgcatgtgatataagggtcaaattttattcttttttatgtgggtattcagtttttgaaacatcatttattgaagagactcttgtattttcttggcacccttgttgaaaattagttgacaatatatgtataggtttttttctgggccttttattctattagtctatgtgtctgttttttataacagtaccgtactattttgattactatagctttgtagtataaactgaaatcaggaaatgtgatgtttccaaatttgttcttctttctcaagattgttttggctattctgaatcttctaggcctgcacatgaatttttgattgttttattctcttaccatgaaaaattccattggaattttgatagaaattttattgaatctgtaaatcacttcaaatactatggatattttaaagatattaattcttccagtgtatgaacatgggatagctttctattgttttctacaatttcttttatcaatattttatagttttcagtgtgcagatttttacttccttggttatttctaattattctaatctttttgatgctattgtaaatgagattgttttcttgatttccttttcagatagtttaatgtgatccagcagtccctcattatatatatgggaaataaaataagtatctcaaagacacatatgaactttcatgtttattgcaacgtcattgataatatccaagttataaaaacaacctaagtattaacatatgaaataattagatattatttaaccttaaaatagaagacaacgctgccatttgcagcaacagggatgaatctgaagagcataatgctaattgaaataagccaaatatgaaaaaaatatcctacgtggtccacttatacatggaatctaaaaaagttgaatttatataagcagagagtagaacggtgtttaacaggaatgggactgggtggggaaagtggagagatgttgatcaaaggatacaaagtttcaattatgtaggataaatacattctagaaatatgatgtacagcatggtgaatatagttagtaatacctgtctaacagttaagttatgggataccatccaatttagcaattaacattacattagttttgtaagccttacatcttaagttttactgcagtagtaacattgcaaactctcatgatttaaagaaaattgtagaatatttgatcgcaacttggatatataaattctctgaggtaaattcagaaagacttttacaggtgctgtattgcatctaaggagcgagttgaaaagtttaaaaactggactcaggcagtcaattgtgttttgactaaacaatcaaacagctggtttgatattttcataaaatttatgaatatctttattttgtcagggattacaaactggcaaattattctgcagaagttgtgtgcatgtgagacaaagaggggaatgtgaggaaggagggagaaaagagacagagttaggcaacatggtatttctgaaataaacattttaatctggaaatttttacatgtacagtaatgttgcaattatataaccgacactttctgtaccttcacccagtttcccatttcttaacattttacaaacccatgatttatcaaaactgagaagttaacattggtacattacaattattcaaagcgcatactttattcagtttattttgtttctacctaatgcctttttctgttcccatataccatccagtacaccacattttacttggtcatcgtatcttcttaatttttgatctctgacagttttcttacacctttccttggttttcatgtccttcatagttttgaagaacactaatgttttgttgaattctccatgatttaggttagttttatggggttatgggttttggggaagaataccacacaggcgaagtgtccttctcatcctagcttatttagtggtagccagatatcataaattttcactggtgatattaatcttgagcatttggctaagtcatatttctccatgggaaagttactatttttgcattttctgtaatctattctttggaagcaggtcactaatttctgtccaccctctagcaggaatggtagtatgggagagagtttaggctctaccttcttaagaaggtatctgcacacattatttgaaattattctgtaagaaagatgactctttctcatgttttattcattaatttatatcagtatggagctctgtatatttattttgtgctttgggctatattccaatactaatttattttgttgctaaaattattccagatttgaccattgagaactctttcaggttgcttcctatgtctctttgacatatctcatagtttcagtttttgaagactttcctgtttttgaatggcataagattctcataaataaattacctgccatttgtggaaggattttggttcctctttttagaaagtggcatttagaaaccaagatctgggcatgagtatgcctactgccgccaggagtgtaatattttataaatgtttttatttaaagttcattaaatgtattatggagacttttaatgccaaaatccctacgagactttactggattcttacttgataattttacacatttttaatattgtcttttgctataaagaaattttcatatagtaaaatctatcatcttttcttgctccttccactctgtatattttccctggaaatgcttctgaactcccaaggttattgaacatatttctttacattttcttaataatatgttgatgctttgttatttgatacataagtaattgggcatgctatgtcttcttggttgatcagaacttctaaaaatctaaaatatttttcatttaatttaatgtttttcttctttggattttacctgaactaatagaaatatagtgtctgtttccttttcctgagtatgttttagatgtgcttgtctttattttaattcttcataccttttaggtgtgaccttttccaagaagattttaaagaaacagtgtgcataggttttcttccaagatggcggattaggggctttcagtgtgcctctgccgcttggatatagtaaaattataaataaagataaactctgtgagatttaattcaagatggaaaacaggaatccaccagaatagtgaaggacatcccagatcccaaggaggaaagagtgggcaagtgtcccttatgatggcatttggctgataaaaccgaatgaagcctcagaatgggaggcaggcagtctccctctgtgactcaccttgtaaatgaagatccaagcaatccaagccaaaggagagaactctgttactcccaaaacttggagataacctagggaaaggtttggagatgctgagaggaaaagacaccagaggaagctttaggcattttcccgggttggggagggagagcaggatgtcctttttaatctgggtgcatgcagagttagttattctttggtgacttggcagtggcggcgatgcaggcattttagtcttgggtcagagataggagcacctgctctggagtggggcaggagccttcacagccagaattgaaggggtaagtatggaaaacacccagctataggcattggaagtatgctctcccctgttgcaggtctggggcaggagaagagctgctgcagccacagcttctcctgggcaacaagacttgcagtcagggccagcttggtgacctgcaatgggtctgtgtctgacattgcagggcatcatagcctgctccctccccagagattatggtgcagaggagccctttctgttccacaccctggcagatatccagatattcggagcacccacttgcataaatcagcagtctgagttgccctatcctccctgtgcaaagatcataaaccagggcgaccctctgctccatgcccaggcagatatccaggcattcagaatgtccactctcctggattgacagcctgagccctccctcctttcctgtgtatagatcagatgcagtggggtcctctcaactctatgctaaggcagatttccaggcatttggagcgcccactctcctggatcaggagcctgagctgccccacccttcctgtgcatagatagtggtgcaagggggggtcggggggcgtccccatgccaggcagatatctaggcattcagagaacctgttcagctagaccagtagcctaagtttcctatccctgctatgtgtagatgtcatttcaacggggctgtctccacttcatgcccaggaagctctctaggcagtctgagcaccctcttgtgtggataaacagcctgaaacacccgaacctcctgtgcagagatagtgatgcagtaagacactttctgctgtatactcaggcagatccccaggcatctggagcccattttcctggattaagagtttaggtatccccctgccctcaccatgcagaaaacttgaaacgaaagaggttccacagctccgtaactagtcacacctctgggcactagggggccacccactaggcccctgccttggcagtgatgcttgtacctgccactggatgatctgtaggcaagactgactgctttgaccctacccatcttggtttccccctatggagctgagcagagagcttataccactgtgcattctatagataagcccattgcttgtggcagacaagaccctcttccagtaaacaaggatcatgtataaacccatccacattggctgcagctagctttgtggtagaatcataaagcccaatattaaaccatccaagtgcataaggctatagtagcaaaagaaaaagagcctactcaacatttcctacagccacaactcttatggagggggcaaaggttatgacattataataataataataataatatagtggggaaagaaagaaaaaaatcctatttgcatgaaattaattactcaggaggcttaggtgggacagtcattttaacccctggaggcagaggttgcagtgagtcaagattgtgccactgtaccccagcctgagtgacagagtgagacttcatctcaaaaaaaaaaaaaaaaaaaaaaaaagaaagaaagaaactggtcagaactcctggaataagaaaatacctaatggtttgcaaaattaaattaaaatctttgttaatatactagaccaagaagaaaaaagcatttgagagtttaaagacaagtcttttgaactaactcagctagaccaaaatgaagcaaaaagaattttaaaaaagaaggtcatcaagaattacgggattaagtaaagacatcaaacctacacattattggcattcttgagagatgagaaaaataaacaagttggaaaacatatttaagagaatatgccaagaaaatttttctaatcttactagagaaatggagatccagatacaagaaatccagagaacacctgtgagatgctacacaaaacaaacatcaccaagaaatataataaccagactgtctaaggtcaaagctaacaacaacaaaaacagtatttaaggcaactagaggaaaaggtcaaatcacatacaaagcgaaccccatcaggctaacagcggacttctcagaagaaaccttacaagccacgagagattacgggcctactttgagcattgttaaagaaaagaattccaacccagaacttcatatcctgccaaattacgctacctgctaccacaaaaacatacttaaatacacagtccacagaccctataaagcaactatacaataaaactataaagcaaccggctaaaaatttcacaataagatcaaaacctcacatatgactatcaaccttaaatgtaaacagtctaaatgctccatgtaaaaagcacaaattggcaagttgaataaaaactataagacccatctatctgttgtcttcaagagagccatctcacatataacacccatatgcttaaaataaagggtaggggaaagatctatcatgcaaatggagcacaaaagagaccaggcattgctattacatcacatgaaaaggattttaaacaaacaagagtaaaaaataaataaagaagaacactacataaatgataaagtttcaattcaacaaaaagatttaacctaaatatatacacacccaacattggagtacccgcattcataaaatgagtacttctagacctatgaaaaaacttaaacagccacacagtaatagtaggggatggtaatggtccacagtgttagattattgaggcagaaagctatcaaataaattttgaacttaaatttgacacttgaccaattggacctaatagacatgtactgaatactccacccatcagccacagaatgtacgttcttctcatctgcacatggaacatgtgctaagatcaaccatatgcttggccataaagcaaattttaataaatgcaaaaacaatgaaattgtaccagccatactctcagaccatcatggaataaaaatataaatcaataccaacaaaatccctcaaaatgacaaaattacatggaaattaaacaacttattcctaaatgacttcaggtaaacaaaaaaaaataaagaattttaaaaaatcattgaaataaatgaaaagaaagaacacaacatacaaaaatctctgggatgaagcaaaagcagtgttaagcagaaaatttatagctctaaatgcctacctcaaaaagttagaaatatctcaaaccaacaatctaacattatacctagaggaactagaaaaacaagtacaaactaaaacaaaagctagtggaagaaaagacataactataagcagagcagaactgaattgagacccataaatccacacaaaggatcagtgaaactaaaagtctgttctttgaaaggatgaacgacattgataggctaccagctaaattaacaaagaaaagaagagagaagatccaactaaaaagcacatatgataaaggtgacattacagccaatcccacagaaatgcaaaagattttcagagaatattacgaacacctctatgcacacacactagaaaatctagaagaaatggataaattcctggaaacagacaatctctcaagattgaatgaggaaaaaattgaaaccctgaataggccctatcaacttctgaaattgaatgagtcacaaaaaagtctaccaaccaaatgatggcctggaccagttgaattcacagttgagttctaccagacatacagagaagaacaagtaccaatcatactgaaactattcccaaaaatcaaggaggagggactcctacctaactcattctatgaagtcatgaccttaatatcaaaacatgtcaaggacacaacacaaaaagaaaactaccggccaatatccctgatgaagatacatgcagaaatcatcaacaaaatattagcaaactgaatccagcagcacattaaaaagttaattcaccatgatcaagtaggcttcatacttaggatgcaatgttggttcaacatacttttctttctttctttcttctgaaactcctattagattattttagagctgattctcctatgccatatacctcatattttatattttgttatattttcactttttaaatattgtatgatatttatagagtatcttagctttattttaagtgccatatatatatgtataatttagaccatgttagattctttattttgtaaattttattatttctatttcaaatactttttctaatccttcctttttcatagtatcctgtcattttttatgaatacactatcctcttgagtatcctagatttcaatagacacatttacttgtcttttcagtatttctaaaattaatatgcactttgctatgaactgaattgtttacaccaaaacttatattttgaagccccagccctcaatgagattgtatttggagatagggcctataaaaggcctccagaactgtaagaaaataaatttttgttgtttaaggtacccagtttatgtgttattttagcccaagctaactgatatgtacctttaaacaaatttgtaaatatttttccttaaaaaactgatttaaaaatatatcttagaatgaacattttttggaattgaggaaatacattatttgtccttataaaaattagcttatgttccttgatgttttcctcttcattttttcaaaagtattttttctacttgaaatattggttcttccattcagtgctgttggttttcatcaaaagtttagcagttttttttttttacttttatatctataaaatggaggactacattattcagtgtaagtttctgttgtcagtcttggtggttacttttccaacagacctgcatagacagactttacattagtaaatctataagggacaaaaattagtagaagtctcatttctcatcaggctgtgagagcagaggagtaccagcatacttgcagatgcccagctgaaagaagacatctatccatttatgctacaaagaatcctaagaatcaatgtagtaccttcacccttcttcagccacttgtctaatttcttgctattgccaatatgtctcttgtatttatcactaccttttacttcctctgccactctgtgagttctgttttatgttttcccgtgcatactacaatttgggtcataccatctacccatttgaattctttcagtgacttctcattattgctcttaaaaaaatcagaagttcttaacaatatgcaaagtcctgtgtggtataattctcattggacttcatttctatactgttccttttgctgtctttattgcagccatattagctgatatggtttggctctgtgttcctaaccaaatctcatcttgaattgtaatccccacacatcagaggaggggcctggtgggaggtgtttgaatcatgggggcaaacttccccctcattattcttacgatagtgagtgagtgctcatgagatctggttgcttaaaagtatgtagcactcccccctttgctctctttctctcttgctccatcattgtgaagatgtgcgtgcttccccttcaccttctgccatgactgtaagtttcctgaggcctctcagtcatgcttcctgttaagcctgtggaacagtcagtcaattaaacctattttatttataaattacgcattctcaggtagttctttatagcaacatgagaattgaataatacagaaaactggtcccaggaatgggacatttctgtaaagatacctgaaaatgtggaagtgactttggaactaggtaatgggcagaggttggaacagtttggagggctcagaaaaagacaggaagatgagagaaagtttggaacttcctagagacttgtgaaatagttttgaccaaaatgctgatagtgatatggacaatgaagtacaggctgaggtgctctcagatggagatgagaaacttattaggaactggactaaaagtcactcttgctatgctttagcaaagacactgctggcattttgctctggctctagggatctgtggaactttgaacttgagagggatgatttagggtatctggtgaaagaaatttctaaatatgacctggctgccgctaatagcatacagtcatatgcattcacaaagagatggtctaaaataggaacttatgtttaaaagggaaacagagcataaaagtttggaaaatttgcagcctgaccatgtggtagaaaagaaaaaacaattttctggggagaaattcaagccagctgcaaaaaatttcataagtaatgaggagccgaatgttaatagccaagacaatggggaagatgtttccagggcattacagagatcttcgtgacagtgcctcacatcacaggcccagaagcctacaagagaaaaatggtttcatggccaggccagggccccactgctctgtgcagtcttcagtcatgattgtaagtttcctgaggcctcccagtcatgctttttgttaagcatgcagaactgtgggtcaagtaaacctcttttctttataaattacccactctcagatagttttttatagccgtatgagaatggattaatgcactagcctacttgccaatttttggaccagccatgtgttctgccatcagtttttaacacattgtctcctttaacatccatgtgatttcatctttgcctttactcacctttacaatctcaggtaaaacattacttcctcagaaaatacttttttcaatgttatgaagaagtaaaattattttcttttgttctctcttaacccatgcatctcgatgtcagaagtatgtatggttatttgattaatgtctttcttccccacaaacattaaattttgtaaggacaggaactgtgtttggtttcactcacaattttatctgtggtatctagcacaaaacttttatatactaggtaatcattatatatttgataaaataacataaattaatatgtaaattaagcactttagtatatttcacctctgaattggattaacattaattttggtttcttttttgttttctctacttatcttttgatgatacttcaagtctcttgaattttgctcctcttgtttttgtggcctgatctttacaggatcttatagttcctctattatgaaatattgattcctaagttttcagcagcctacttttaaacatgtttggattacagattcttccactatgctttttactttcctaaatctaattttgggttagaaatttttctttacttgtagaattataaaggacaataatttatcctgtcgtgatcataataattctatgggttacagacaagaacctagtttagttctcataaactgaagaataagagcttcaaatggcagatattaaaagagtgggtatgcagttttgaagcatggatcatgccaggcatctgtactcatcaatgggggcactactactgggcaattagtgaaggcaaaagcggtatgagagcactgaaaagcgtggaagtaatgtaaacataaatgctccagattgcataaaaatatacaaggatgccaaagccaaaatctgcctgttgcacaatttaccccattgctagctaacagataggatatattatatttaacatattcttgaagcatagtggctcaagaaatgaacatgatgtaatcattagtaattttagcacttagtactaaataactggaaatcatcatgcttctattaacaatggcaaacttgatccaactgtataattaaaaatactactaggttatcaaaagtgtgtagttatgatagtgaggtccaacgaattaaccataagcaaaatgacttaaagccttatatctagtctgttaggaaaacactatttaatgttacctgtcatacctgacatgtattctttattttgtatttcatacactgtagtaagtgatagatacttttgacactcctgctgcccacattagtcttaacagctcagctgttgaagttgtcttatagcctaagcatccttaatttcaacatgttcattctccccatcttttttttttacaagtttaataaaacacatttttaattagcaatgcactaatgaataaatataaacagatctatggcccagtacacaaccatgatgaagcctataaggttgaatataaaaatgtgaatcttcatatagaagacaaatactatgaattaaatatatatcaagtactcactgcaaataacattatcaaaatttaagtaaaacaaagttatttctcaaaaaatgatttcagagatatcatttagtagttgattttcatcaatgttaattatttctttagttgggagaaagttatttttaaaacttgtgaacatagagaataactgtaggttattgagtaaggagccattagccaataactaccactactcaatacatgaagtaaattgcaccaataacagaataaattgatgtcagggtatttttggtttgtataacatgcacaaaacataaagttggaatgtttgtgttaaagtcttgattctgtgactatttagccaagcgatttggagaaatgaactttctcttttttgggggggggtctcaataactttaaacatttgttttcagttttcttaaggtataattgacaaataagattgtttctatttaaagtgtacaatgtgaaaatgtgatatacatataaaaataagtcaaaatcatagaaacagagatgagaatggtggttgcaaagggtgaaggtagggaaaatgaggaaatgtttgtcaaaaattacaaactattagttataagatgaataagttctgaagatagaataaactttgtctctattaaccttaattatcctatttgtctaataaaacagataccattctcaaaaggtttttgtgagagagaatttaattcaagaacaagtaattagtgtttgaaaactacaaggcaataagctattttcccattttactttctattctttcagaaaatatttccattttcattctttaagcatttagacttacaggtttcaagcatggaaatttatccaaagtgactatgatattatttgtaactgtggctgctcttcagaataataaactccatgcatttttttattttattgattttaacttattttattgaaatgattgttaatgtttactttttaaattcatttcttataattatttttatttataagttacataataatgggacatatttatggaatatagtgtaatattttaatgcacatacacattgtataatgatcaaactggggtaattaccatattcatcatgttaaacttttatcatttctttgtggtgacaacattcaaaactctttcttttagctatcttgaaatatatactacattactatttgctatagttacctgtgtaataaaacagcaaacaccagaacttatttttcctgtcttactgtaactttgtgtccatccattgaccaacctcttcccattcctgcttgtccaagtttctccagcctctggtaaccactattcaattatctacttctatgaaataaactttttagattccacacataagtgagaccatgcagtgtttgtctttctgctactggcttatttcacttcacatactgtcctccagattcatccatgttgccgcaaatgacagaatttcattcagttttatagatgaatagtattccattgtgagatatatataaaatatattatatatattatatataatatataatatagtataatatataatatatattatataatacaatatataatatatattataattatatatattttaattatatatacttttaattaataatatataatatatgtatatataaaatatatattatatataaatatacataatatataatatatattaatgtatatattttaattaattatatatataatatatttatatatgaataaataatatataatatatatacgatatataatgtatattatatagtatgaaatatatataatacaaaatataatatattatataatataaaatataatatattatataatataaaatataatatattatataatataaaatataatatattatataatatgatatataatatattatataatatgatatattatttattattaatataaaatatatattattaatataaaatatattatatatttatatattatatataattaatatatattatatatattatatatcataaaatatataataataatgtatatataatatatataatatataatatatataatatataatatatataatatataatatattatatttaatataataatatattttatatatataacattttctttatccatttatctgtagatgggcatttaggtcaattccatatcttagctatggtgaatagtactccaataaacatgggagcacagatgtctctctgacttactgattttatttcctttgggtatgcatgcaaccagagctattaagcaagataaagatataaaagggcatcatatgggaaaagataaagtcaaattgtccctatttagaaacgatatgattatatatattgagaaccctaaagactccaccaaaaacctgttaaaactaataaatatatttagtaaagttgaaagatacgaaatcaacacagaagtaccagtagcatttttatgttccaagagcaaactatctgaaaaacagatcaaaaaagcaatctcatttccaacagctacaaaaaaatgcctaaaaataaacttaactaaggaggtaaaatatctctataaaaaaactgtacatcattgatgaaagaaattgaaaaagacacaagtaaatggtaaaaatgttccatactcatgaattggaataattaatatttttaagatgtctgtatttccaaaagcaagctaagattcaatgcaatccctatgaaaatatcaatgacattctccacagaaatagggaacacaattctaaaattcatatggaaatgtgaaagaccccatatagccaaagcaatcttaaacacaaagaaaaaagctggtggcatcacattacctatttttaatgtatactataaagctatagtaaccaaaacaccatgataatggcataaaaacagacatatagaccaatggaggagaaaatagaaaccagaaaaaaatccacacacttacaactaactgatttttgacaaagggaacaagaatacacactggagatttttaaaaagtcactaccaaaaaatggtgctaaagaaaatggatatccatatgcatgagaatgcaactagatccctaggtctcaccagatacaaaaaacaactgtaaatggatcaaggacttatatgtgacacctgaaactctgaatgtcagacgaaaacataacagagacacttaatcaaattgaacttggtataaaggtttaaaataagaccccaaagcacatacaacaaaaacgaaagtagtgcaatggaattacatcaaactaaaaagcttctacacagctaaggaaacaatcaatacagtgaagagacaaacttcagtgagaaaaagtattggcagactatgcatctggcaaggggataatatccaaaatatataaggagcccaaacaactcaataggaaaaatataatcccatttttaaaatgggcaaaagagcctaattcctctaatgatgatgtaaaaatggctaacatatatatttaaaaatgttcaacatcactaatcgtcaaacacaaatccaaaccatagtaagttagaatgactgttactgaaaaaaacaaaaaatgctagcaagcatgaggagacgagggaactcatacgctgttggtggaaatgtaaatgtctacagacataatggaaaaaaattatagcgtctcctcaaaaagttaaaaatagagctcccatttgaaataattttagacattcaggaaagttgccaagatagtacatgaagtccccgtatacttttcatccaactccctctaacattagcatcttacatatccacagtacaattatcaaaataaagaaatttgcaaaatactattaaggaaatgtcagattggattcaggtatcaccagttttcccccaaattttctgtttgtttgtttgttgttttctgttacagggtccaatccaggatcctgtattgctttctgtggtaatatattcttaatctcctgcaatctgtgatagattttcaggtttctgctgtctttcatgatcttgatgtttttaagagcactggtcagttgtgttgtagaatgtcctttaatttgagtttgcctgatattttcatgtgattagattgacgtcattcattatggggaaaataccaaagaggtcttgtgcccttctcagtatatcatacattataccaatatgtcttattactagtaatgttaaccttagttaaaatagtgtcagccaaagttatccactgaaaagtttctactttccaatgtgtaattaataaatagtttggggcagataatttgagtgtatgccaaaattattctatctaaacttttgcctattaattttagcatttatcagtggatctttcatgcagcaattattactctagtgtactaatggtgattttattttttctttccttctacatttaattaattgatattcttccgtaagagttttcatactttctccatttatcaactatttattcaataaatatatcagcgtgaatcataaatacatatttcattatttgggttatattttattgacgttattatttactgtgttgatcagattgttccaggttctgcccttgggtgatcttttgagtaggctcctatgtcattttgacatgcccccatctgttttatgccctaacactttcttactttctggcaccacagggtgtcccatgtttaccttgtatttcccataccccagtcctgtgaataaacagttctccagagagtgctgttttcctttactggagaatggcatttagaagctagaagctgagtgctaggtgtgctcattgttactagggtattcacaggttataggctctcttagcaagcagaactaatgtgtatactaagccaagtatgcatacatatttatactaatttctatatttatattttaaaaatatgatttgatactgatatatccatcttaaatttcagcacaccagagtttcttctatctgccctcttgtttatttgtaattttcttctctaacagtgagaaacctggctctcattattttcagtgtacttacttacttcttcaaccttagttgaaccctaccagtgtacttacttgttaaaccctagtgtactttttttttttttttgatacaggtaaggagtttgagaattgcccatccctactcctatgagacacaaatttacctactatagtagagtgtttgtgtgcagtttttcttgtctttaatcttacagtatcagggcaaaatgttgttccaaagtgatttagttcatttttttactccttattcccttcagtaggataatgccacaaatgtttattatggttagatttatttgaaatagtctgcatttatcttgagttatgctgatatcctaatttaggtgtttaaaattgcatttagcaaaatttattatctgtaaggtacagttatatggaatctaacaaatgcatagagccatacttccatggtaccaagcagaacagtttcatcactcaaaaattcctcattaactgcttctttgtagtcaatttctcttccccattgatatctggcaaacagtgtcctgttccatatccttatattttgccttttttaagaatgccatataagtagaatgatacaacgtgtatcatttatgtttttttttttgcttagaaaaatgcatttaagattcatttatgttcaatgaatccatggtttatttcttttcacaacatactacttagcaaattagtatgtatgatggtttgcttattcattcatctgttttttcaaaaaagagttgtttcctgttcttttttttttttactattgttaatgaaactgctgtgaacattagcatacaggtttttagtgtgagcatagttttcagtttacctggttaacacttaagagtgggattgctgtgactcctggtaactttctaagagattgacaaactatttctccaagtggttgtaccatttttgtactactaccagcaaggaagagttccagttattcccatcctcccttggtattaccagtttttatctgtctcaatagacatttagtgctatcttactccagttttactttgcatttcctcagtaactaataatgttgaacatattttcctatatttatttgccactcatatgctttccttgataaaacatctatttaaatattttcaaattgggttgtttcctttcttgtagagttataagagttgttcacatattctggatacaagttctttttcagaaatgagatttgcaaatacttctacaagtcagtgttttagatttttattcttctaatagtgtctttccagaaaaaaattttaattttgatgaaattcaatttgtctgttttgtaatgaattgaacttttgctgtcatgtctaaaagttatttgctaaaacaaggtcatggaaattttctcccatgttttcttctagaaagtttgtaagttcatgttttatatttatgtctgtgatacattttgaatatgttttatatacaatatagtatctggcatgtgtttagcttcattattttgtgtatggacatccaagtaatggtcccactaccacctgtcgaaaagattaaccattctccattgaattctctttgcaattgctttcatcaaaagtaacttgtttatatttgtgtgaatctacttctgaaagctttatgctgctgttagtctcttccatatttctatccttttgcccatagcagattttcatgattattgtagttttagagaaaaaacttgcaatcaggtatgcaagtcctctaactctgctccttttcaaaattgttttggctcttctaatttctttacctttccatacacattttagaatcaggtttttgatatgcacaaaaacatgctgggattttgattttgattgcattgaatttagcaatatatcatggagaagtgacatattaattatattgagtcttacatttatgcatctgaaataggtgcacaataattttggtttttaatgatttccttcatcagtgttttgtggttcccagcaaacagatcatgcacacattttgctacatttgtatcccagtattttaattttcatgctattgcaaatggcattcttatttaaagttgattacaagtacatataatttaacatttattttctgtattgatagtgcattctgaaaagactgaactctgtagttctaggaacatctttgctgattcttgggaattttctatgaagacaattatgtcatctgtgaatacagtttacttccttcctttcccattggtgtgccttgtattactttttgttgcctatttcactggcaaaaatatcgagtatgtattgaataggagtaataagatagaagaaactttcctatttcctgccataagagtacaacattctgtctttcaacagtaagtatgaagttagctgtaggctttgagtagtttgtagatacctcttatcatgttaaaaaaaagttctcttctatcctagcttttgagtttttttttccaattattataaatggatgttaaatttatgctttctctgcatctaatgagatgatcacattattttcttcaattcgttaacctagtaaatgatattaattttcaaatgttgaaccaacttctcatcctttagatgaatctgacttagtctgatattttatcctattatatattgctgaatttaatttactaatatattgctgaggattttctgtctagtttgagatattgatttttagttttctattcttgtattgtctttgtctgtacccagtactatgatcaccttctaaaattagttgagaagtattcccttttcctgtgagagattatctggtacttgtttggtagaatttgaaagtgaaactacatggacctggacttttgtttgtggaatattttcaaccagattcaatttcatatgtatattcatagtttttttcttgagtgagattttggtagtttgtttttcaaggaattaatcaatttaatttaaattgtcaaatttaaggtcatagagtagtgttcccttaatattttataaattaatggttagtagtgaagtcttttcttacatacctgacattggtaatatgtatctacttattttttcttgctcattctgattagaggtttatgagttttattaatcgtttcaaagggctacatttgacttcattggttttctgtttttgtgtttttaatttcattgtttattttgttgcttatttttcttattttctttcttctatttccttttatgtaattgactctttttttttctagtttcttacggtggaagtttagaaatctgattttatgtctttccacttttctaatgtaagcattttatcttgtaaatttccctttaaggattgctttaaatgtaccctgaaaatttgatatattgtattttcattttaattcagtccaaaatatttatttaactttgctcttgaaacttccattttgacacctgtgttatttggaagaatgttttcttaaattcgaaataattgtaaattttcctgatatctttatactatttatttctgtaaagttgtgttatgattcaaaattatacatttaaggacttgtgaaggactcattttctttttttttcttctttttatttatttatttattattatactttaagttttagggtacatgtgcacattgtgcaggttagttacatacgtatacatgtgccatgctggtgtgctgcacccactaactcgtcatctagcattaggtatatctcccaatgctatccctcccccctccccccaccccacaacagtccccagagtgtgatgttccttttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccaaatcatgagtgaactcccattcacaattgcttcaaagagaataaaatacctaggaatccaacttacatgggatgtgaaggacctcttcaaggagaactacaaaccgctgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtcctggtaccaaaacagagatatagatcaatggaacagaacagagccctcagaaataacactgcatatctacaactatctgatctttcacaaacctgagaaaaacaagcaatgggtgctgtttttaataaatttaataagtggtgctgggaaaactggctagccatatgtagaaagctgaaactggatcccttccttacaccttatacaaaaatcaattcaagatggattaaagacttaaaacgttagacctaaaaccataaaaaccctagaagaaaacctaggcattaccattcaggacctaggcatgggcaaggacttcatgtctaaaacaccaaaagcaatggcaacaaaagccaacattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatctcattttcttaaattataaattttatcacttatgttataaattttctgatgataaaacattttttcaagaaaatgtgagtccttaaatgtataattttggatcataacagaactataaagaaatcaatagtatgaagataccaggaaaattgacaatcattttgaatttaagaaaatattcttccaaataacacatctgtcaaaatggaaatttcaaggccaagttaaacaaatattttgaattgaattaaaatgaaaatgcaatatatcaaatatttatttataattttataaaggtaaaataatttttacctttatcttggtgaccgtttcctgtccactaaagaagaatgttattctgctcttgttgcatggatggatttctaaatatctactaggtaaagttggtggatagtgttgttgttcaagtcatctgtattcttactgattttctgccttcttttctgtcagtttttgaggaaggagcattaaactgtcaactctattcgtgaatttgtttgtttcacctttgagttcaattaacctttgacctatgtgttttgaagctcttttgttagctggacaaacattcaggattattatgtttactttgagaattgtccctttattataatataatgttcctctttattccagcaaatatttattcctgttaagtctaacttacctgatgttaacacagctattttatctttctgttagtgtttatgatatctttgtttatcatttaacttacttataactttttatgtctttctctttgttgtagagagcatattgttgagtcatggttattgtattaaatttgacattttacgtcttttaactcatggtcttagagcattcacatttatagtgattgagattgttaaatttcaccagtttaggttttcctatatattccatgtgtttattgtttttttattttcctgtctcaggttaattgataattagtaggattacattttatctctctattaattaactatacctcctcttacaattctattcacgattgcaatgcagattactttcaattactcagtctacatccaaataatattttaacacttcctgtataataaaagaatcttaaaacattatatttcccaatcttctttcccaacctgaatactattaatattatacttctattttcacacacacacacacacacacacacacacacacacacacaaacataatacattgctactgtttttgctttaggcagttacattttagagcagttaaagttagaaaaatattattttaccattattttttccatttccagttcactttatttctttttgtacaatgaaatttcggtatggtatcttttctgcctgaagaatttctattaacattttttatagagtaaatctactgcaaatatattccccaaatttttgttggtttgatctttatacctgtatgtaatgtttgtttgctcctgtatgtgatatttcttttttgtctggctgctttagcaattgtctctacagtttttaagcagtttgagtatgatatgactagcgatgtgtgtgtgggtgtgtgtgtgtgtgtgtgtgtgtgttgctatttatactgcttggtattttatgaatttcttggatatgtggtttggtgttcgtcatttacaaacctatcacccattacataattcttcaaatgcttcttttgtttctttttctctatctctctctctctttctggaccctccttctaggaccccagttgcccttatattagacatttgtttattgtttcacagttattggataatctggctttcatttttttaatattttctcctctgagtttcagtgttgattacttctatagatgtatactcaagttcactaattctttccttagcgagtattgagcttactaatgcatttctagaaatcgttgttttctaattgtttaatttttttatttttatttttattattaagggtacataatatttatacatatttattgggtacgtaattagggtatccatcacttaaagcctttatcattcctttgtcttcagaacattccaattccactcttagttattttaaaatatacaacaaattattaactatagtgcccttattgtgctaccaagtgttggatcttatttattatatcttactgtatttctgtacccattaaccatcccaattttatccccccatccctgccacccttcccaacctctagcagccatcattccaccctctatctttatgaattcagtttctttaagctcctacctatgagtgagaacatactatacaacctttttatttctgtgcctggcttatttcccttaacataatgtccaccagttccatctattttgttgtaaatgacaggattttatttcatttttatggctgaataatattccattgtgtgtatgtaccacgtgttccttacccattcatctgctgatggaaacttatgttgcttccatatctcagctgttgtgaatagtgctgcaagaagcatgagagtgcagatgtcacttttataaaatggctttctttcttttgaatatatatccagtagtggaactgctagatcccttggtagttctagctttaggtttttgagaaacctccatatagttttccacagtggctgtactaattcacattcccctcatcagcataagagggttctctttactctacattctccctagcatctgttattcccagtcttttcaataaaagccattttaatttgggtgaggtaatatcacattgtagtttcaatttgtctttctctgatgaatagtgatgttgagcattttatagacctgttgaccatttgtatatcttcttttgagaaatgtttattgagatatttgcacattttaaataagattatttgctttttattaagttgcctgagttcattttatattctggttactaatcccttatcagatgtgtagtgtgcaaatgttttcttccattctgtggtttatctcttcacattgtttattgtttactttgctattcagaagctttttagcttgatgtgaaataaaattattctttatcaaagtctttttaaataatatttccatttgattgtttagtgatagcctacatttataataagagtttgtttggcagtggattttgttttccaatgtcagctctacccttagccttaagtctttcctttgcattgttctctgttgttttgagtatccctcagttttaggctggtactttgtccttagaactcatggagaccactgtcagtgctgtttctcttcttgcatagttctgaacatagaatttatttctgtcccactttaatgcccaactgacctgccccttcctacagctgtaatcagattttacaagtactctaaatatgacagtgttcgttgtccctcctaccacaaatttaagttattgtttgatggagtaaataaggaagaggagaccagatgaagttttttgcccatcctactgtatctactgttcccatccttcatttatgaatatgagggagactttctcaagacttctccaagctctctgtgatcacaaagtgggatcttagaagaaaaagcaagaaagaggatgtagacgtcctatgtacatgcaaccaccagggacttaaccctctatcacgaatatgcagtttactgaccttcaccaatttgccaatcaccctagctgaactcctcttattgatgtccagttgcatcttacccatacaatccagggctcaagtttcaatcctcccagtaagtgtctgtctctcccaagattctagtcattttctcattttgagatgtcagtactatgatgggttctagaaaagttatgaacttgctcttggtccagcactttttagagttgtaagatctggagaaatgctctttccaactttcttcatttccaagtaaaaccagaattgtcattctaatcatttttattcttacatttcaaaacatcaagatttgaaagttcaatcagatgtgattaggcttatccttatgctcaaatacttcttcttgtttctcagggagcagctatcaataagacttatatatatgttttctctgtgaatgtcaccatcgattcagacagcagcaacctcaaaaacaaaacaatattttcatttccatgtaagtgcccatattcccaaatttatttatgtttcaacatttaaaaaagaaaatatgccatatgtatattgtgtatcctaaaatatattttttcaatttttatctcaattatgaccatattggaaattgaatataaatgcaaataaggttactacagtctcaaatgttagtttgataaaggttgcttataatgtcataattttagtgctgtctacaaaacaaaacaaaaacccagttttatttcttcatgttactagcaagtgtgtgcatcctgatttcttgattttgttaataaatctacagaaaaaaatagaggctgtaaaatcagacaattactagttgtgcagtcttaggcaactactttaagtattctcttccttagttgttatattacttacagtagttccaacttagcatgggttgcagtaacaggtaaatggttatgctcaaaataacatggaatcaagcttttcttttcttagcagtgcaccaagaacactgtcgagttacacagataccaagttctcaattcaatagatgtgttttgaagctggctcatactggctcatgagatctgatttttaaactttcagaaattttgcaagttggtttttacatcattcgtagcttgaaattgtcttcacagtggcattatttatattagaaaatgctacaaattagagctccttttccactgttagagagctgctttaccaggatatcactgcatatgcctgggcaactcaatcatatgacacccagaaggcctcagatggattaaaaattctgaactctgcatgtaacagcttatttatgatcagaaaatggatcagttggttaatgagtaaaaaaaatcataggtcattagtccatgtaattcacagaataatagcaatgtatgtagatgtatgacaagataatgcagtatggatttttattctctgatgttactaagcaactccaggaaaacaaacatttacaagtaataaaagaagcattgaacaattgaccaaactaccttatttatgtaaattaactaaaaacctgagatgtgcaaaataagggagcaattaaaaatgtagaataatatgaaatgttagttgtttaacttttctgtcagagataatttaacggttttaattcttaagaattttattaaatttcagggaaataacaacattgtctctctcttaaaagaaagaaagaagtgttgctgtgatgtaaatttaacaccatgctcattataaaaattttggaacagaaagagaagcagaaagaaaataaatcattcagtcttcacccacaaagacaaccactgtgactatttcaaattgtttccttccaaattttgctctaggtttcgtctttctttttaaacttttatttctttttatgcattatatttgtgtttaatatacttatggtcatatgacatatttcataacacacttatgtaagacatatgcccttatgtatgatagttttagattcattcacattataaatgtagattattagtgcagaaaacaaagaaaagtacattaaatagaagtatatttaaaaagaaaaaatacaacttaaattatgtcaattacattacaaagattttgggataatgcaccaaaacgttaatagtgtttatatttgggtggcgattatttttatctttaaaaaatgcatatcataaaaatgcattaacataattaagactaaatcgtacatacaaatatttaagtatggtaaacatgaacatttacaagtatttgataaaaaaattgtaagaagaggtttgttacaaataggaaattatttgctttgtttaattaaataaaacatcatgtaatgtaatttataaaatgccaaaaacacaactatttttaattgatacattatattttacatatttatggagtacatgtgatattttgctccatgcacagaatgtgtaatgatcaattcagagtatttagggtatccattacctcgagtgtttatcatttctatgtgttgagaacatttcaagtcttctcttctagctattttgaaatatacaatacatcgttgttaactacaggcaccctactctgctatgaaatattggaacttatttcttctgtctgactataagttgcccattaatctctcttccccactgcccccaccaccacacacacaccttccctagcctctggtatttatcactctattctctacctccattggatcaaagtttttagctccggtgagtgataatataaaacacttaactttctgtgtctggcttattttacttaacatactgacctccagttacatccatgttgctactaatgacagaatttcattttttatggccatatagtactttattgtctatatataccacattttatttatctattcatcctttgatggacacttaggtttcatgtctttactactgtaaatagtgtggcaataattatgtaggtataggtatcccttttatatactgattttcttttctttagataaacacccattattggggttgctgtagagtacggtagttctatttctagctttttgagaaatctgcatactgtttttcattgtggctgtactaatttaaattcccacgaatagtatatatgatgctccttttctcttcatctttaccaatgtctcttaatttttgtctatgtagtaatagccattctaactggggtaagataatatctcattgtggttttaatttgtatttgattagtcaggctgagcattttttcaatatacttgttggccatttgtatatttttgagaaattttgatttatgcactgtcttcactttttaatgggattattagtttattaacttttgggttatttgagattcttgcatattctggatattagtcactagttagatcaatagtatataaatattttctccctttcaaaagattttctctttaatttattgattgtttccttggctgtatagaagctttttagtttaatatacttccatttttttaatttcgcttttgtttcttgtgcttttcagtcgttagccataaaatatttgccttgacaaaattcctaaagtgattttcctatgttttcttttactagtttaatagttttaagtcttacatttaagtttttaatccatcttgagttgatgtttgcatatagtaagagatagcagtccagtttcgtttttctgcatatggacatacactttttcagcataatttattgaatagggtgtcttttcttcaatgtatgattgtggtacttttgtcaaaaatcagttggcggtaaatatgtagatttctttctgagttatttattctgttccattgacttatgtatctgtatttatagtaataccatgttgctttggtgaaatggttactgtattgttacgcaattttgctcttgtgttgtactaaaaattttttaatttttttaacaaagtgcattcaaagtgtagtaatcattgttaacaaatattagagcagagtactacttattgctttcaaatttcaaagcatgtgaagagattctaaatgtgtttggatgaatattttagttaaaataactcacattccaagaaaatacaaaatcaatttagactacagatgaatcctacaaattttaaatgtccatgccaaatttaaagcaaaagttactccactcttttcgcaattttgtggccatctaaacattatgctgcacattctagttttcttggtcaccttctgtggtaggcagaattgtaagatggccctaaaaattctcagcatctggcatacacacatcttctccttgttgttcagtaaaacactaatctaagtactattgtgaagagattttgtagatgttattaagaacacaaatcagttgattttaagatagggagattatccaagtgggcctaacctaataacatcagcaccttaaagacggagtgttctacagctagtgatgggaaagcaagactccagttgatgacaaaagaggatgcactcttgtcttctgggagtaaagcaaacatccattttgctacctgcttatgaaggccacatgacaaggaaccataagtgtgctatagaagcctagagtagtccctactgacagctagaaagaaaacagatcctcagtccttgtaccacaaagaacagaattctgccaatagtgagcttgagagaggactctgagtcaagataagaactgcagccccagctgatactttggttttagcctggtgagaccttaagaagaaaatccacccattccaaaacctcaggcctacagaaattaagataaaagacgtatgtagttttaagctgctaagttcgtggtatttttttacacagcaataaataactagtacacactctaaaatgtaaggcattctagctatttatcctctcacatatccttctctcttgctccatgatttcatatcctgatcaagattcataatccttccttcccttccagaactttacactgtgtaaagttgatagtcatctctgttttaaatatattcactgattgctttttctgtatctttaccttgactgaaaccggctcttctccatgggcaagttttgcctataaccttttcaaagcgagggtattcattctatcatacactacgaacctcagggtcagttgagaataatggtaataatagagaacatttgctgaatattcgtgtggcaggtactgtgtgccacaaatgggtgcctttacacacatcctttgctttacaaaacaaaaaaattatgcgtaaggatgtgtgccagcaaatgatacctacttcatagcactctctccttccttctttatgaactgaacttcaatgttgttcgaagaactaacttcccaactaggaactgcatttcccagcccaccttgcagatagatagctatgtaacagagttctggtcaatgagatgtaaaaaaaagaaaaaatggtttggacttcctggacagctctttagaaacaaaaagaattcagttggcacgaagttttgctgtttgttctttcttgccagcttaagcctagttgcgttgccttttgggcaggaggtttggaaggaaagagtcacctggcaactctgaagactagattcactttaaaagataggtggtgaaccccaaaaacagatggagattgagaacaccaccgccagagtcacaagaacagcaatagggaactggtgctcaaccaatagaaaccgtgtccatcggctgggcatggtagcttaacgcttgaaatcccaacacttttaggaggccaaggctagtgaattgcttgagcccaggagtttgagatcagcctgggcaacatagcaaaaccacatctttacaagaaaaaaaaatagctggacatgatggcatgtgcctgtcttttcagctatttgggaagctgaggcaggaggattgcttgagcccaggaggtggaggttgcagtgagccgagattgtgccactgcactatagccttggccacagagtgagaacctgtctcaaaagaacaacaacaacaacaaaatacactcctgatccagtcacctttcaccaggttccatctccagcactagaggctacatttcaacaagagagttgggtgcgaacacagatccaaaccttatcagcaggccgccatcttttatcgccctgtagcactcgccactgttgccctgagactccagcctcccaaagagctgaaacgacaggcacatgccatcatgtccagctatttttttttcttgtaaatatgaggttttgctatgttgcccaggctgatctcaaactcctgtgtagatcccaagtactgtgtagctattcaacagaaagctgaccagactgttttccatgaagatttctgttcctgcttctccccactgagcagggcctcccaacatgggactccagctcaactaccctgcccctgcctgaacacttcagttggaagtggctttgcatttctctgaggaggaaatcttagaaacaaaccacaggccagcagccattgcagctgcagtggtaccatcctaattgtccttgggctagggaaaaaaacaaaggacctggttgctgtgctggcacctccagcacactgcagccaccatacagagaggagtccagtctcttttccctgtaactcttcatcccccaatcttcacaaagcgaggcccctggctcgtaatgttggaacagctgccccacccctacttgagcatacccactggtagtggctcccggaggcaactgaaagcccctctgccattgccagagcagtggatctatccctgctgccctcagtctgggagagaaacaaagagcttggaggcgtcacacacacttctagcacaccacagtcaccatatagagaggtgcccagtctttcctggctgtgagccctgaactccctgctcttcaccagacagagccccaaacctgagccagagagtgcagtaccccatactatggctgaacattcccattagcagtggatccgcatttctttgaggtggagctcccagaggcaaccaaaaatctctctgccactgctcttccaattgttctacccttgccgcccttgaactgtggaaggagcaaagaccctgagtgctttaaccacacctctagcaagctgcagttgccctaaggaaaacaggccagtctgtctccctcatcatctccttgccctccctgctcaccaccaggtagggcccctgtggcttgggcacacaacagaaccaccctagtctgagataattgcactgattgatagtggctctgcatctctttggggtggagccccaagtgacaagtaaaaggccctttgccacaaccactgccatgatctcttcctctgctgcccccaagctgtggagggagcataaagcctgagctcaccccagagctgtggtgtgcagcctatgagtgccaagccaagatctatagctagtactagagcgggagaggagcccacattttcagaccactgagagggtgcctgattgcaatgttgaggaaatacagaggagtcatgtggctgagcaaaagcttacctactgaccataacacttaaatgccatctactggataatagcccaaacttcaacaccaaaaaatactttgctagcatactcccttgtggaaccaagaacaagaactcatctacaaataaagaccttacacaaagcctcagatctctgaaaacattcagaaaagaagtctactgactgtactcaaattacattaaagttaaaggaacatcagcccacacagatgagaaaacaccaacagaagaactctggcagctcaaaagctagagtgtcttctttcttccaaatgactgtatgacttctccagaaagcattcttaactgagctgaaatggctgaaataaaacataaatcaaatttatgatatggataggaatgaaatctctgaggttcagcacaaagtcaaaacccaatccaaggaatctaagaattacaataaaacaatacaggagacgatagacaacatgcccattaggagaaagaatcacgctcctctgatagaactaaacaacacactacaagaatttcataatgcaatcattaagtattaacagcagaatagaaccagctgaggaataaatctcagacgtccaatactgactctcttaactcactcagaccaaaaaattgaaaaagcataaaaataataactgggagaaaacaagcaacttggaaaacatatttcaggataccattcataaaaatgtccttaacctcactagagattctaacattcaaattccagaaatgcataaccccagtgagatactacacaggaagaccttccccaagacacacaattatcagattcttcaatgtggaaatgaaacaaaaaatgttaaaggcagatagaaggagcagatcacctacaacggggaccccatcaggctaacagtggaccatccagcagaaaccctacaggccagaagagattgagggcctatattcagtattcttttctgtctttctttcttttttgtttttgaaacagagtctcgctttgtcacccaggctggagtgcagtggtgcaatcttgggtcactgcaacctctgcctcccgagtagctgggactacaggtatgtgccaccaggcccagctaattttttttgtatttttagtagagatggagtttcgccatgttggccaggctggtctcgatcacctgatttcaggtgatctgtccgccttggcctcccaaagtgctgggattacaggtctgagccactacacctggcctcagcattcttaaagaaaataattttcaaccaagattttcatatccggcagaactaagcttcataagtgaacaagaaataaggtcttttcagacaagcaagtgctgagggaatttgttaccaccagacctaccttgcaagaggccctgaaggaaatgctaaatatggaaagtaaagacacttactaaccactactgaacatacttaagtaagcagaccattgacattatgaaacaaccactcaaacaagtctgcataataaccagccaacagcatgatgacaggatcaaacctgcacatatgaatatcaaccttgaatacaaacagaatgattgtcccaattaaaaggctcagagtggcaagctgcataaagaagcaagactcaactgtcttcaaggaacccagatcacgtgctataacactcatagactcaaaataaagggacagaaaaagacctgccaagcaaatggaaaacagaaaaagcagggggtgctatccaaatttcaggcacaacagactttaagccaacacagatcaaacaatacaaagaaaggcattacataatagtaaaaggttcaattaaactatcctaaatatatatgcacccaacacaggagcacccagagtcataaaacaggttcctagagacctaagaggagactttgataaccacacaataagaatgggagacttaaatactccactgacaatattagacagattattgaggcagaaaagaacaaagagagtcaggatctgaagtcagcactgtatcaaacgggcttgatagatatctacagaactctctaccccaagacaacaaaatatacattctttttatcaccacatggcacagactctaaagtcaacctacaattcaaactatactataaggatacagtaacccaaacagcatggtattggtacaaaaacagacacatagaccaattgaaaagaatagagggcccagaaataattccaggcacccacaaccctctaatcttcaacaaagtctacaaaaataagcaatgggggaatgactagctactcaaaaataatgctggtataactggctagccatatacagaagattgaacctagactccttctttacaccatattcaaaaatgaattcaagattaaatgtaaaacctgaaactataaaaatcctggaagataacctaggaaatatcattgtggacataggccttggtaaaaattttacgatgaagatgccaaaagcaattgcaacaaaaacaaaacgcgacaagtgtcaactaattaaagagcttctgcacagccaaagtaatgtcaacagagtaaatagacaacctacagaatgggagaaaacatttgcaaagtatgcatccaacaaaggtctaatattcagaaattttcaggaacttaagcaaatttataattaaaaacccaacagccccattaaaaagtagacaaagcgcattaacagacacttttcaaaagaagacatacatgcagcccacaagcatatgaaaaaatgcacaaaatcactgatcattagagaaatgcaaatcaaaaccataaggatataccagcccatataataagaatggctattatttaaaagtcaaaaattacagatgctggcaaggttgtggagaaaaaggaatgcctatacacagcaagtagtaatttaaattagttcagccattgtgaaaagcagtgtggtaattccacaaagaaattaaaacagaattactgtgtgactctgtaatcccatcactgagtatgtaccgaaaggaatataagtcattttcccataaaaactcatgcatgtgtatgttcattgcagcagtattcacaatagcaaagacaagaaatccacctacatgttaatcaatgatagactagataaagaaaatatggtacatatacacaatggaatactacacagtcataaaaacatgagattatgtctttttcagccgcatgaatggaactgaagactattatcctaagcaaactaatgcaggaagagaaaaccaaatattgcacgctcttacttataaatgagagctaaacaatgagtaaacatggacacaaaggggaaaaacagacattggggctgacttgaaggcagaggatgggaggaggcagaagttcaaaaaactacctatcagagtgactatagttaaaaataattgtacattttaaaatacttaaagagtgtaattggattgtttgtaactcaaacgataaatgtttgagaggatggatgtataaaaaataacctatctgttgagtactatgcttattacctgtgtgacgaaacaatctatgcaccaaaccccacaacacgcactttatctgtataacaaaccatcacatgtacctctgaacctaaaataaaagttatagaaaagatgaataacaaactaaacactaatcgggctatgtttctttaaattaggttttgcattacatatagctagtcctattttaacctaatattgtatactttacattaattaaataaatacaacaacagggtaaggtgagtaaaattattatccccattttagaaacgaagaaacagaggcacagtgaatatatgtaaattttccaaggttacacaggtatggagggagccaccatttgatcctaggcaatttggcattagattcgacattcttaactccaatgctgtactgtccagttccatcttaacacttccaaatctatagttttccaccaacacataaaatttctactcttttgaggtttatgccataaggctggctgtattaaccaacaaataaccactttactgtcatatacacagcttctgataatttatccacaattattgaagcctttgcttttttttttttttttttttttttttttttgagatggagtctggctctgtcacctaggctggagtgcagtggctcgatcttggctcactgcaacctccacctcctgggttcaagcagttctcctgcctcagcctcccaagtagctgggactacaggcacgtgccaccacgcccggttaatttttgtattttcagtagagatggggtttcgccatattggccaggctggtcttgaactcctgacctcaggtgatccacccacctcggcctcccaaaatactgggattacaggcgtgagccactgtgcctggccgccatgttttataatctttatctccaagccaggttttgcattgtttccttgaaatcttcatcttcaaacaacttcactacactattttagccatacactctccaaacccagtggatatactgtgcacctaaccggcttcattaatggcattgcttctgaaattttagactcagatgttctattgtgtcatcacaatgctctactcatatattttatcattcagtcactttcgttacacctgttcctttaatccaggtcactcaaatcctctacattcctcccatctgttgaccatccattctcttttattttcatattccatcaagattattttcaattcaactcctgaaatctcagtgcctacctccaggctgcttatcaggaatagagaagattgcataactatgaaggttagaaccattataaacccatagacaacaaacttatcttggactttcccttccttataatgactcattcaaagtattttgtttctccaaattccaaccttttaattaccttatggctttcaacacatacctttttatttgtttcagagagaaaattgaatatgcaaaacaagaatttccttaattttcttaaaccaaagctattgatgtgtaccattttgaaatggttcatgcaccatctcagctctttgccgtgctagaggaatttaactgtatccctaaaaatattctccacctacatgccctcacaagttttctcattctctgaggtaatggaattgtagtttaactccctgtgccctctttgaattttattaaagttgtattacactaaggaaatacacttccttgtttatagtataaatgtggggtcatcaccttattctactgtaatttttttcttttattgttggtttctttttgcaaaattcagaggttagatgttgaatgcacattcctatatttctgtcttctctaaatgtcccagctcttttaaacttttaattaggaaagcttttttttcatgattacaattgtgataaaacattcccatttttcttgtactgaatctcattctttttcttccatattaacattccactaatatcatatgtatttatttattattaaagactgaattcttgagcttctcaaattaagtctcaatatcattgatttaattttctacacaattataacttttaaggccttcaatacacatcttagtattcatttagttttcttaaattccttcttattttcatcttagtcagttgtctattcatcttagatttttctttccatttagctttctactcccttttcaggggccttgaatgtattttattttgatggagactgtaacattcttctactttttttctggttcttaaatttaagaagttatttacaaaactcattttttaccctttaagtccttagaaaagtaaatatttttttcataggtttcatgttgttttggtattgttgttatgctgttttcttctcaactcattcccaaataaaactactattatatagtcctaatactggacattacttggttgcacactcattttgcttaggagtaggaaaataccttttttagatctgtattaggaaataagttagatgtgcccaacttctcatgtaatttttagtcattcatctaggattgatatattgtactgaaaaaaaaatttctgcctccgttgactgggtctctgataccctaaaaattaactctaatcaaaaatactgtccccagtacacatctttcttctggcttttcttgtcattgtatcttttccacaccacacctccaacatgggttggcatatatcatctgagaatctaagatgcaagatgcctgattactttctccctttactaacagctcaattgttttacttcagtcaatgaattttgatggcagattcatgggaaacaaaaatgtggcttcttcaaagacagtatgcatcaaagttatggtgtgttattgatacagacctaatgtagctaacagaacgatttttctaaaatattgctttcaccatattgtaccctattcaaatacttacaagataaaaatctaattctcttggtttgacattcacaggtcacctgaataagaacaattcatatccatctcagcacttttacttgtactgctcctctcctttctctctgcctacccttgcattttcaagtcaagcaacaaagcctatcgttgttggaaggactctgtctttgaaaagcctaacacttaatttccacactctatgctttgtaatcagtaagctccaggaaagcgggtactgtgcataacttgttctttttttcttttgatgctgttttattttccaaagcctaaaaagccatgtcttacactcatttctatcttaaagacgtgccataatgttattcttatacggagttgtcaacaaatgcttgttaactatatggatagttattgatcgattgaatgaatgcctctgtcatagaatctgaagacttttcacattatgtatttatgagaagtaacctatacctaacctccttcttcattcacctataaagatagattaatatcgttagtcaagtggcattttttctataattaaaataacatttcagtaaagataaatttataattatatgctcctattggaattgataagtagtactttagtattggaaatgtgaaaacaaaagggaaaacgtttcaatttgtatgaagaaaatatgtatggtatattacatacttaagaaatatatctgaaaatttctcaagtaaaaggatcagttttgttgatgctttctattttagaatagttaaaaaaactgtaatatattttataaagtgtgctctgaagtgttgcccaaatctgatacttgctactaacagagtatgtgacctcaggcaagtcagagaacttctacaagttcagttttattatttataaagtgcatgtactggccaacctcacagggttttatgaggatcaattgaaataataaatgcaaaataactttgttaagtattgtttaaatatgagaggatattaacattcccaataaatggccaaaaagaaatctactcagtaaactacaatgaaaagatctgaaaagagatgtgagatcaaatgttatgtcatacctttttaaaatcttgaatggcaagagacaagaagtctattaatttagagttgccagataaaatacagtatgcccaattaaatttaaatatcagataaacaaaacgtatgtgtttcagtataagtaaattatacatatgggctcttgcctccaaagcatattaaagacactgctaaatatttgtcaattaggaatgtgattactatggaataataacaaactagttatcttttcctaccacttgttactgatgttgaagaaggaacataaaaggagattgaatataagttaaagattgaggaaataatatgtttttcagcttaagtgcagcaaatgttggtgttccattattttattttaatttgtgtgaattcatagaacatcaaacatatctatgttcaagtaggagaacataatcacttgtcaaagtttaatataagtgatttctccttcattccctcttttagattttccaatatggcatatgtaattgtaagtaatcactgcatgtctatggtggttttatagtaccttagaactaagaatggtcctgagagtacttgaattattctaaaagaactgatataatcctaataaacttagtgaaagaaagagaacaaacgattgataacaaatggacaaaacagactgacgttaaaaacaaagtcacaccaattaatttagtttatcaattataaattattgtgttagaataaaagacataaaaaacattagggcaatatgggggaaattttttgttcatgtgaaggtattaagtaaattttcaccttccattactgccatcttcttaactcataaatttcattttaaaattctttctgccaagccagccaatatcttgtctaaaatgatatgcttcttttcttatgtgcacttcctttatgagagttcatcttaaggcacagttttaaaagaaatatgtatttgacaaatctaaaagcttgactgtcaacttaaaattcacttctctcttcgaaagctaaaacatgaatgaaagaaagaagttaacatcccaaggtcttaattttctgtataaaatttataaattacttaaaggctaaagattctatgtgtctacaaggattattatttactttccaaatggattacaaaacccttggaaggttgttctctaggcctcatatatatattcaatccaggaagatagtgcaactttgagttaaccatgttaagtctatatacatctgcttctgtatcccacaggagaaaatttctaaaccactccatatagatttaatttcatgaatgatggtttcttccactatttattgtctccattcttactgcctataaattctttggtaagttaattaagatctcttagtctgcattcccacaagtaaaatgggacccccgaatgactcagtatctccatgacccaacttcatattccctcaggagaaaaggtcattgactctggtctaagcaatgtagtactaatttcttcagcatagtgccaggtaggtttgtggagaaagttatcaaacattcagaagatttgactcaaatatctcaatcttagtggcttctcaaagcatgccccagtgcacacatctttttcagatcgtccttgttcttctaagtggaatgttttcactaagtgcatttgtgtagggcactcttttaatgattgatgcatgaaataaaaatatttgattactatattaacattgtaatgaatacccccactttcacataaacaatattatgtaatatacatatatacaatagatatactgtacatatggaattgcaataaacattttctctttatgttctttaagaactgaaaatgtgaatattcagaaaaaccttgggagtagcccacagaaagattgaatatgttaagaatctaatctcatatgtccatgtgctattatagatgcattcacttactcatgcataaataaaagcagaattttctatgtgcagaacccactgcatttttttgagtttaagtaattgaaaaataaagtcaacatttcatacaaagcatctctttccaagagctgaatattatgtattttgaattgccttttatattttgttaaatcagtgattttaaatgaagataacctcataacttttattatccagttaaccacattgtaggctattaaaatcaaatatgtagatattcaaatgcacacaggatggcacatactttctctgtgcaggagacagatggcttttattaatattaaaagtgattaacatgtcaagtaaattagcaaactttcagcagcatttttatttctttagcttattattctattctctcttagaagtactgacctggagcaacttccttatcttcttgtctattctggagtagtgagcctttgtttacaagccaatacaaatggttctatttataaagtcaggtgtcaatcatttcaggtcacatacactttcctatactcaggaaagtttggccacctgagttttgtttgtttctaactaaagatgaatttaacatttataaacatacagtcaataccttcacacaatatattcatattattttgccccattctgtacctataatcaatcattccagtcacaaacataagaaaaaatcaccagtgactattaaagtttgaaatatttattctgtgtaagacactgtactaggcattttgggacctgcaaagataaagtaaatattttctaccttcttaaagacacacagatagtgtataactggtaggagtctggattcccaagagaaagaagagtttgcttctaataaagaaaattcttggcttaattgaatttttaaaataatgataagatatgtcaaaaatgcataaactagataatcagatataaagtatccaattttacatcacccatattaaacagatgttttactttttttgtttcgggtctatctgaagatatgtaagtcattacaggtggactaatgcccttttgtgttactgattccaaatcattcctttagaagtaatcatgaaacttaaggtgatgtgatcttcctgttcacatttttataattttctacataaatatgaattcataaacagtatatgtatattcatgattggtatatacaaccacaatatttacataactaatcatatttattttcataatttgatgttttactcaattttttttttttagatttgggggtaaaagtgtagttgtattacatggatatgttgcctagtagtgaattctgacctttcagtgtatgtcatctgaatattattcattgttccaaatggataatattttatctatcacttccaccaccaccgtcccatcttttggtgtctctaatgactattattccactctgttatgtccatgtgtactcattattcagctttcacttgtaagtgagaacatgcagttttgacatcctgtttctaagttatttcttttaagataatggcccccagttccaccgctgttgctgaaaaagacataatttcattattttttatagttgagtagtgttccatagtgtgtgtgtgtgtgtgtgtgtatacacacctgacatttttaatccagtcatctgttgatggatccttaggttgagtccatgactatgttattgtgaagagtgctataataaacatactaatgcagatgtctttttgatataatgtcttcttttccatgagtagatacccagtaattgaattgctgaactgaatggtagttctatttttagttatttgagaaatatccatactgttttccatagaagttgtactaatttacattcccaccaacagtgtataagcattccctcttctccatattcttcccaacttctgttattttttttacttttttacaatagcaattctgactggtgtaagatggtatctcatcatggttttaatttgcatttctccgatgattaaggatgttgagcacttttttttaaatttactttaagttctgggatacattttcaggtttgtaacataggtatacatgtgctatggtagtttgctgtacctatccatccatcatcaaggttttaagccccacatgcattaagtatttgtcctaatgccctccctccgcatgccccccaacccctgacaggccccagtgtgtgatgttcacctccctgtgtccaagtgttctcattgttcaactcccacttatgagtgagaacatgcagtgtttggttttctgttcccgtgttagtttgctgagaatgatggtttccagcttcatccatgtccctgcaaaggacagaaacacattgttctttggctgcatagtattccatggtgtatatgtgccacattttctttatccagtctatcactgatgggcatttgggttggttccaagtctttgctattgtaaatagtgctgcaataaacatacgtgtgcatgtgtctttatagtagaatgatttataatcctctgggtatgtacccagtaatgaacttgctgggttaaatggtatttctgcttctagatccttgaggaatcgtcacactgtcttccacaatggttgaaataatttacactcccaccaacagtgtaaaagagttcctaattctccacagcttcaccagcatctgtggtttcctgactttttaatgatcaccattctaactggcatgagatatctcattgtagttttgatttgcatttctccaatgatcagtgatgatgagctttttttcatatgtctgtgggctgcataaatgtcttttttggagaagtgtctgttcatattccttcccccactttttgatggggttgtttgtttttacttgtaaatttgtttaaattccttatagattttcgatattagacccttgtcagatagatagattacaaaaattttctcccattctgaaggttgactgttcactttgatgatagtttcctttgctgtgcagaagctctttagtttaattagatcccgtttgtcaattttggcttttgttgcaattgcatttggtgttttagtcattaagtctttgcccattcatatgccctcaatggtattgcctaggttttctaatagggtttttatggtttggggttttacatttaagtgttcaatccatcttaatttttgtataaggtgtaaggaaagggtggagtttctgttttctgcatatggctagctagttttcccagcaccatttattaaatagggaatcttttccctattgcttgtttttgtcaagtttgtcaaagatcagatggttgcagatgtgtggtgttatttctgaggcctctattctgttccatcggtctatatatctgttttggtaccaataccgtgctgtttcggttactgtagctttgttgtatagtttgaagccaggtggcatgatgcctccagctttgttatttttgcttaggattgcttggctatatgggctcttcctgggttccatatgaaatttaaagtggttctttctaattttttgaagaaagccaacggtagcctgatggaaatagcattgaatctataaattactttgggcagtatggccattttcataatattgagcctttctatccatgaacatggaattttttttccattcgtttgtgtcctttcttatttccttgagcagtggtttgtagttctccttgaagaggtccttcacatcccttgtaagttggattcctaagtattttattctctttgtagcaattgtgaatgggagttcactcatgatttgactctctgcttgtctatttcaggtgtatagaaatgcttgcgatttttgcacattgattttggttcctgagactttgctgaagttgcttatcagcttaaggagtttttgggctgagatgatggggttttctaaatatacaatcatgtcatctgcaaacagaaacaatttgacttcctctcttcctatttgaataccttttatttctttctcttgtctgatagccctggccagaacttccaatattacgttgaataggaatggtgtgagagggcatccttgtcttgtgctggttttcaaagggaatgcttccagcttttgcccattcagtatgatactggctctggatttgtcataaatagctcttattattttgagatatgttccatcaatacctagtttatggagagttttttgcatgaaagggtgttgcattttatcgaaggcattttctgcatctattgagataatcatgtgttttttgtcatttgtcctgtttatgtgatgcactacatttattaatttgtgtatgttgaagcaaccttgcatcccagggctaaagccaacttgattgtggaggataagctttttgatgtgctgttggattcagtttgccagtattttgttgagtatttttgcatcaatattcatctggaatattggcctgaagttttctttttttgtagtgtctttgccaggtttaggtatctggatgatgctggtctcataaaacgagttagggaggagtccttcttttgcattgtttggaatagtgtcagaagggatggtaccagctcctctttgtacctctggaagaattcggctgtgaatctgtctggccctgagctttttttggttggtaggctattaattactgcctcaatttcagaactttttattggtctattcagggatttgacttcttactggattagtcttgggatggtatatgtgtccagaaataacacaggaataacttctaggttttctagtttatttgtgtagaagtgtttatagtattctctagtggtagtttgtatttctgtgggataaatggtgatatcccctttatcattttttattgtctctatttaattcttctctcttttcttctttatcagtctggctagtggtctattttgttaatctttaaaaaaaaaacagctcctggattcattgagttttttatttttttgtgtgtatctccttcagttctgctctgatcttagttatttcttgtcctctgctagcttttgaaattgtttgctcttgcttctgtagttcttttaattgtgatgttagggtgtcaattttagatctcttcagctttctgatgtgggcatttagtgctaaaaatttccctcttaacactgcttaagctgtgtccagagattctggtatgttatctctttgttctctttggtttcaaagaacttatttatttctgccttaatttctctatttacccggcagtcattcaggagcacattgttcagtttccatgtaattgtgcagttttgagtgaatttcttaatcttgagttctaatttgactgcactgtggtctgagataaggttttttattaagtctgttcttttgcattcgctgaggagtgttttagttacaattatatggtcgattttagaataagtgctatgtggtgtagagaagaatgtatattctgttgatttggagtagagagctctgtagatgtctattatgtctgcttggtctggagctgagttcaagtactaaatatccttgttaattttctatctcatagatctgtctactattgacagtggggtgttaaagtctcccactattattgtgtgggagtccaagtctctttgtagctctgagaacttgttttatgaatctgggtgctcttgtatggattgcatatatatttagttagttcgtcttgctgcattgatccctttatgattatgtaatgccttctttgtcttttttgatctttgttggtttaaagtctgttttatcagagactaggattgcaaaccctgcttttttctgctttccatttacttggtaaatattccttcatccttttattttgagcctatgtgtgtctttgcacatgagatgagtttcctgaatacagcacaccaatgggtcttgactctttatccaaattgccagtctgtgtcttttaattgggggcatttagcccatttgcatttaacgttaatattgttatgtgtaaatttgatcttgtcatgatgatgctagctagttattttgcacattagttgatgcagtttcttcatagtgttgttggtctttatattttggtatgtttttacaggggctggtaccagatttttccttccatatttagtgcttccttcaggagctcttgctgccagcacagcagtctgaagtggacctgggacaattgagcttggtcgggggaagggcatccaacattgctgaggcttcagtaggcggttttcccctgacagtcttaaggagcgggggaaattcggactgggtggaactcaccacagtgcagcaaagtggctgtggccagactgcctttctagattcctcctcactgggcagggcatctctgaaagaaaggcagcagccccagccagggggcttatagataaaactcccaacatcctgggacagagcacctgggggaaggggaggcagtgggcacagcttcagtggacttaaacattcctgcctgccatctctgaagagagcagcgaatccagacaaggaggattcttccagcacagtgctcgagctctgctaaaggacagactgcctcctcaagtgagtccctgaccgccatgcctcctgactgggagagacttcccagcaggggtcaacagacacctcatacaggggagctctggttggcatcagactggtgcccttctgggataaagcttctagaggaaggtgcaggcagcaatctttgctgttctgcagcctctgctggtgatacccaggcaaacagagtctggagtggacctccagcaaactccagcagacctgccataagagaggactgactgttagaagaaaaaataacaaacagaaagcaataacatcagcttcaacaaaaaggacacccacacaaaaaccccatccacaggtcatcagcctcaaagatcaaaggtagataaatccacgaagatgaggaaaaaacagcacaaaaatcccgaaaaatttcaaaaaccagaatgcctcttctccaagtgattgtaactcctctccaagggcacaaaactggattgagaatgagtttgacgaattgacagaagtaggcttcagaaggtggataataacactcctctgagataaaggagcatgttctaacccaatgcaaggaaattaagaacctttataaaaggttacaagaactgctaactagaataaccagtttagagaagaacatagatgatctgatagagctgaaaaacacagcacgagaacttcatgaagcatacacaagtatcaatagcagaatcgatcaagtggaagaaagtgtatcagagattgaagatcaacttgctgaaataagttgtgaagacaagattagagataaaagaatgaaaaggaatgaacaaaacctccaagaaatatgggacaatgtgaaaagaccaaacctacgattgactggggtccctgaaggtgacagcgagaatggaaccaagttgcagaagacacaccaggatattatccaggagaacttcccaacatagcaatactggccaacattcaaattcaggaaatacagagaacaccactaagatgctcctcgagaagagcaacaccaagacacatactcgtcagattttccaaggttaaaactaaggaaaaaatgttaagggcagccagagagaaaggtcaggttacctacaaagggaatgcccatcagaatagcagatctctctgcagaaacactacaagccagaagagagtggggtcaatattcaacactcttaataaaaaaaagaattttcaacccggaatttcataaccagccaaactaagcttcataagcgaaggagaaataaaattctttccagacaagcaaatgttgagggattttgtcaccaccaggcctgtcttacaagagctcctgaaggaagcattaaatatggaaaggaaattccagtaccagcccctgcaaaaacacaccaaaatatgaagactaacaacactttgaagaaactgcatcaactaatgtgcaaaataaccagctagcgtcatgatgacaggatcaaattcacacagatttagttgtgttttatttatttcacttatctgatttatctggctagaatttcaggtactatgtgaataggagtggtgaaagtgagcatccttgtcttattgatgaatagtttgattccattattgttcaagaacaacattctgtatggtttcaatacttttaaatttaagtgttttttttatttcaattatttgaagtttaagacttttttttttttggtaattactcagactatggtctattggggtgaatgtcccatggacatttgatatatattctgctattgttgggtggaatgctcaatgtgattttgtttatatgttctatatgctttctgacatttttgtgtaatagttctatcaattaccaagaaaataatgttgtagacgtaaacataattgtgaattcagcttttacctttcagctctatcagctttcgcttcatgtatgttaaagctccattgtttggcacacacacacatttaggttttgtttaacttcttgatgtattgatcttcttatcataactgaatatacctctttgtctctattaattttctgtgatttaatattcctgttatacatattaatgtagtcagttctgttgtcatttgataaatgtgtccatggtatataatttttaatcattttacttttaattgctcaatgtcattctatttggagtgagtttcttctagacaccataagtttgggctatgttgtttttattctctctaaaaatccagtttggttttttatttttggtatagaccatttgcatgttaaataattattgatatgttaggcttaattatattattttattattaattttctgtttgtttcctgttcctttcttttttctcttgcttatctgtgagtttcatgaacgtatttttaggattccatcttgatatatttatagtatttttgagtatatccctttgtctacttttcttaatggttgttctgtgtattagaaaatacatatataaacgtagtggactgaatatttgtatccctctaaaattcatatattaaaatcttaacccaaaaatgatagtattaagagtttgaactttaggtattaattatctcatgagggttccatccttattaatgggattaaattgaattagtaataaaatatctacaaccaaaaaaaaatagcccaggactagatatattcataggcaaattctacaagacatacaaagagctactacccatcttcctgaaactattccaaaaatttgagaagggactcctccctaactcattctacaattccagcatcactctgatacaaaaacttggcaaggtacaacaaagaaaactacaggccaatatctctcatgaatatagacacaaaaattattgacaaggtactagtaaaataaatcaaatagcacattgaaaagttaatttaccatgatcaagtaggcttcatacctgtcatgcaatcttggttcaccatgctcaaatcaataaatgagattcaccacaggaacagaattaaaaagccaaacaatatgattacctcaaaagacagagagaaagctttcaatagaatctaacatcccttcatgattaaaaccctaaaataatcctaggcatcaaaagaacatacttcaaaatagtaagaaccatctattacaaacccacagcaaaccttatattggaaaggcaaaagttgaaaacattccccttggtaactggaacaagacaactatgcctactctcaccactcctgtttaacatagtactggaagtactagccagaacagtctctcaagagaaagaaataaaaggcatgcaaacatgaaaaaagagtcaaactatgttttcatggatgatatgattttattcccccagtattctgaaagctctgccaaatggctcctggaactgataaatgtcttcagtaaaatttcagaatacaaatcatactaaaatgtgtagcaattgtatacagaaataacattcaagctgagtgccaagtcacgaatgcaaacccattcgtaatagccacacaaaatataaaatacccaggaatacatctaaccaaggaggtgtaaaatctctacaagaagaaccaagaaacactgctcaaagaaatcagaaatgacacaaatggaaaacatccatgcacatggattagaagaatcaatattattaaaatgcccataatgccaaaagcaatctatagattcaatgcaattcctatcaagaaccaacatcatttttcctagaactagaaataactattctaacattcaaattttagagtatttcataatttgaatattttatatttcataattagaatatttcatgattagaatattcataatttgaatagccaaagtaattctaagcaaaaagaacaaagccagagatatcacattacctgacttcgaactatacaccaagactacagtaccataacagcatggtactcatacagaaacagacacatagaacagaggaacagaatagtaaacccagaaataaagccacacacaaccatctgatcttcaacaaagtcaataaaaacaagtaaatgagaaaggattcctgatctgataaatgctgttgatgtatctagctagccatatgtagattaatgaaactggacacctaccttccgccatatacaaaaattaactcaatgtgtattagatatataaatgtaagacctcaaactatgaaaatcctagaagaaaacctagaagaaaattctggacataagagttgggaaagagtattaagacctcaaaagcaattgcaataaaaacaaaaattcacaagtggaaactaattatactaaagagattttgcacagcaaaataatcaacagattaaatagacaacatacagaatgggggaaagtattcaaaactatacatatggcaatggtctactatccagaatctataaggaacttaatttgataagcaaaaaacaaccccattaaaaagtgggaaaaggaaaccaagagacgtgtcgcaaaagaaaacttgagtggccaataaacatatgaacaaattgccaattgtcaattattaaaatttcaaaaaacaacagattctcacgaggctgtgcagaaaagagaatgctcattacactgttggtggaaatgtaatttagttcagccactgtgtaaagaagttgggagatttctcaaagaattaaaaaggaactaccattagacctgacaattctagtaatgggtatatacccaaagaaaaataaataattctaccaaaatgacacattcactcatatgtacattgcagcactaatcacaatagcaaagatatggaatcaacctaggtgtccatcaacagtgaattggataacttttgtattgttgattttagttttgttgtttcaagatagtagattggaattattgttagcatgcttcttgcacttggaaagaaaaatagtgtgtagagattcatgctgtgaacttttttttccaagaaggaacatggatacttaggaaaactgaaagaaaccacagaccctttgaaagaagtgacaggctacatacaccatgacccatgctggaaaactgtgagtccccagagtatgacagggagagggtttccctctgtgttataaactcacactggggaatctgcaatccaggccatggtggaatgccttaactacctaccactggagctgagttagtgggcagcgggaaaaatatgtaaagcagtggcatcgggatgtgctttacatgcacttccagactccagtagggatgtaggaaagccatttgtgattctacctcacaggggacctcacagagattagctgctaactcaagcagtggtcacaggttgagagaagtttcttattgatattcgtaatacaatcttcagtggtgacaacctcccttggccagaactaaggactgaatgagaagtgtgctataatcacaggcacaggagctgggcaccggtgcttcattggtagaccttgaggggcatggcctgaaagctatggtttctgtctcagtgggggaaggcttacagcctgtggaagtttggagttctgagtgcaggctggctggaacccagctaactgctcctagtaagtttgagacctgcctagccaagttcatgggagttaggtgggacttactgccacctgctaccctctgctgcctatgcagactcttatgtgcagcagaatcatctacaatcctacctggaacattactctagcattgagagaacagaccttcgattctcattggagctgctgttcgtgcccacatgtgggtagccagagcatgtactcacctgacccagcccacatctggctttaccccttcaccctgctcagtagcttaacagaaaagtcagggacttttggaatttccatggccctgtccactgcctgaaacaccagaatacctcccctgaataacataaggcaagcacaaaactcaccattatcaccacagcaagcgctcatttgcaagtgccacctctcagctggaggacaacaggcacagtccattacaacatctgcaggcacaataacacagtgcccagaaaagataaatcttttgtgtgacctcagttattaccattgcctgcatcaccctggctaaccaggaggttttgagtcagtcctcttgacaaatgcagtactactacagctggcattttagaaagtcaacaaaccttataaccaaggaaatgtcacagagtatacatcactcccttgccacttccatcagagttggtgctggtacctgctgctgggagactagagaactagtcacataactgcatcccttgcatatgttctccagcaccagcatggtgtgtggcagccttactgggcaactagacccagagtatcagcaggattcacaacagtctggccctcaggaaggggaaagggggagtacatcaagggagcaccctgtgggacaaaagaatccagagtgcagggcataagtaccaggactttctgcttgtgagaagtctctttcagcacaggcacaggttcagaatggaaaggctgaggctatagcccaacaatcaggccaccctggtgctagagaagggtcttggagaaaggaacttcccctcactcaccagtgcagacaaggtggggcttctcccatgagaggtcagcatgagggaacccttagacagcctttctggaacacttcagggtgactgcatccccacagaagggcctttcaggttcagtcttgcatgaggtatagagtcacagtccctctctacatggaacatcagcattcctgcagatgaagaggttgcctgcctgaatagctgaaacactgggtcaggagcgtgactggtaggtggattgatttcctgctggtctgctaggggagctgaggtagcttcctcctgcccccctgaaaagacttcagtgtgtttcactgagagcttcctcagccacctctatcaatgctggaacctctgcccactattcgggtacagtatttacccacatgctttggccacagatggtttttacccacagatatttcctactagcctgaagcctgaactgtttaacacagtgaataaaatactgagagagaaaataaataaataaatacacatggctagaaaacaaaataaactttaggagaccactgccattccagagccacaggaaacagtaaaactgttcacacactaagcacattgctactgcaaccagcacccgagaaagtcgtcatacaaagactctctataatcaagacactcaaataaattcatcaccactcaaagcacccagagccaagttaagttacaatgaacaataaacattaaacacgtgtcctcaaaaagtagaaaaagaaatacaaataaaagtagaatcaaatataaaataaaaataattggaagaaatagtcttcctaaatgaaaataaaccagaaaaataattcaagcaatatgataaaaacagagtctgagaacaccaccagaagatcacactagctctccagcaattgtttcaaaccaaaatgaaatattttaaatcccagataaagaattcaaagggttgtttatgaagttactcaagaaaacacaagagaagtgaaagtgaacatgaattaagaatttaggatatgaataaaacattttctaaggtgatagatattttaatgaaaattcaatcacaatttctggaaatgaaagacacacttagggaattacaatatgcagtgaacagttttaacaatagactagtcccactataagaaataatttcagttctcaaagacaaggcttttgagttaacccaatcagacaaaaataaagaaaacagaattaaaagaaatgaaaaatgtctccaagaaatatggtattataaaatggccaagcctaaaaatcactggtgttcctgagggagaagaaaaggcaaaaagttttgaaaacttatttgaggaaataattgaataaaacttccctgaccttgctagacattaatacatccaaacacaagaagctcaaagaactacttggagattcatggcaaaaataatgacatcatcaagacatataatcatcaggctatctaaaggtaacatgtaggaaaaaattctaagagcaatgagacaaaagcatgaggtaacctataaaggaaaacattaaacttctcagcagaaaccttagaaaccaacaatatttagtctccttaaatggaataaatattaataataatttctatccagcaaaactgagtttcataaatgtaggagaaatagtctttttcagacagacaaatgctgagggaatttgtcactaccagaccatctctacaagaaatgtttaagtgagttataaatattgaaacaaaaggttgatatgcagtagaaagaaactcttgaaagcaaaaaatttacagggcctataaaacaataacataatgtggaaaacaaagtaggcaataatcaacatgatgactggaacattatgtgacatctcaatattaatattgaagtaagtggtcttaatgctccacacttaaaagatacagattggcagaatgaatacaaaattacaaccaaatatctgctgtcttcaagagacatccctatcatgtaaggattcttatagactctaagaggtagaaaaagatattccatgcaaatggaaaccaaaagtcagaaggagtagcaactcttatattagagaaaacaaactgtaaacaacaacacttaaaaagagaaagaaggccattatatcatgataaaaagtttaacaagaaggtataacaatttaaaatacatacatccctaattttggagccctcatatttataaaacagttattactagacctactaaaatagacagcaaaaacactaatagttggagatttcaacagtccatacatagcactagacagattatcaagggagaaaataaaaaaagagacactggacttaagctgcactctagaacaaatggacctaatgtatatttacagaacattctacctaagaactgcagaataaacgttcttttcctcagcacatggaccattctccaaaatagaccatatgaaaaaccaccaaaaagtctcaataaattttaaatagtcaaaatcatatgcagtatctttttatatcacagtggactaaaactataaatcattttcaaaagtaaccatgaaaactatgtatatacatggaaattaaacaatctggtcctgagtaatttgggggttaaaaatgaaatcacaatggaagtttaaaaattatttgtaatgaatgataacagtgacacaagttatcaaaaactctgggatacagcaaaagcaatgctatgattaatgtttatactgataaatatatacaccaaaaagtctgaaagatcacatattgacaacctaccatcatacctcgaggaactagaaaaataatggcaaatcaaacccaaagctagtagaagaaaagaaataacaaaactctgagaagaactaaatgaaattgaaatagaaaatagaaattatcaatgaaatgaaaagtcggttccttgaaaagacaaaaaattgatagaccattaactacattaaccagaaaagtagagaaatgattcaaataatctcagttagaaataaaaatggagacattacaactgaaagcacagaaataaaaaagataatcggaaactactataaatacctctatgcaggaaaactagaaaatttagagaaatgggtaaattctaggaaacattaaatcctcttagttgaatcaggaagaaacaaaaaccctgggcagactaataagcagtgagtttaagtcagtaataataataatagtaataatttaccaccaccaccaacaacaaaaaagcccaggatcagacagattcaaagtcaaattctgtgagacattcaaacaacaattggaaccaatcctactgaaacaatttcaaaatatctaggaggagggaatccttaactgattctatgaatccagtaacaccttgacaaaaaatagaaaagaacattaaaaattaaaactacataccaatatcactgatgaaaatagatgcaaaattcctcaaaaatatactagcaaactgaatcaaacagcacattaaaagacaattccccgtgatcaagtgggtttcatcccaggtatgcagggatggttaaacatatgcaagtcaatatacattattcatcacataaacataattataaacaaaaatcatatgatcatttcaatagatgcagaaaaatcatttgaaaaaatccaccaacgctttatgataaaaatcctcaacaacctaactatagaaggaacatacatgaaagtaataaaagacatataggacaaacccacagccaacattatactgattgagaaagagttgaaagcattctccctaagaactggagcaagacaaagatgcccactttcaccacttctattaaacataatactggaagctctacccagagcaattaggcaaaagacatgaataaagggcacccagatgggaaaaaaggaagtcagactatttccatttgccaatgataaaatcttatacctaacaaaccctaaatgctactccaaaagactcccacatctgataagtgaacccagtaaagtctcaggttataaaatcattgtacacaaatcagtagtactgatatacaccaacaatgaccaagctaagaataaaatccagaataaaatccaatttcttttacagtagctgaaaaataaaataaaatatctagaaatatatgtaaccaagaaggtgaaagatctctacaaggagaactacaaagcactgttgaaataaaacaatagatgaatggataaagaaaatgtggtatgtatacacaacagagtactattcattcttaaaaaagaatgagatccagtcaatttcaaaaacatggatagaactgaagattattatgttaagtgaaataagctgggcacacaaagacaaacatcgcatgttcccacttgtctgtggtatctaaaaatcaaatcaactgaattcatggacatagagagttgaaggatgtttaccagaggctgggaagggcagtgggtggttggtgggggtggggaagtggggatggttaatgggtacaaaaaatagaataaataagacctactatttgatagcataattgggtgattatagtcaataataacttaattgtatcattttaaataacataaataatgtaatcagattgattgtaatgcaaaggataaatgcttgagggaatagacaccccattctttatcatgtgcttatttcacattgcatacctgtatcaaaacatctcatgtaaccccataaatacatacacctactatgcacccacaaaaacatttaaaaataatttaaaaattaaagaaagaaatcacaggacacaaacaaatggaaatatataccattctcacagattggaagaagcaatattgtgaaaatgaccatactgcccaaagctatttacagatttgataaaattcctatcaaaacactaacatcatttttcacaaaattagagaaaacaatcctaaaattcatatggaacaaaaaaaaaaccatatagccaaagcaatcctaagtaaaaagaataaatctggaggcatcaaattacctgactcaaattatactataaggctatgggaactaaaccagtatgctactagcataaaagtagatacataaaccaatggaacagaatagagtacggacaaataaagccaaatacttacaaccatctgatcttcaacaaagcatgcagacacatgaactcgggaaaggacacccgatttaataaatggtgctggggaaaatagatagccatgtgtagaaaaacgaagttagatacctattgctcatctcatataacaatcaactcaagttggattaaagacttaagtctaagaactgaaatcataaaggttctggaagaaaacctaggaaaaactcttctggacaatgacgtaggcaaataatttatgactaagacctcaaaaccaaatgagacaaaaaacccataaattaataaatgaagcttaaaccaaaaagcttttgcacagtaaaagaaataatcatcagagtagtcaacccaaagaatgagagaaattagttgcaatctatgcatccaacaaagaattaaggtgctgattctacaaggaatgcaaacagatcagcaagaacaaaacaaattatcccatttaaatgtgggcaagtgacatgaatggacattctcagaagatatacaaatggccaaaaaacgtatgagaaatgctcaacatgactaataatcagggaaatgcaaattaaaaccacaatgagataccaccttaccccaaccagaatgatcatcattaaaaagtcaaaaaacagtagatgttgacatggatgtggtgaaaagggaatatttacacactgctggttggaatgtaaacttgtacacctcctatggaagaaagtatggagttttctcaaagaactacaagtagatctaccattcaatccagcgatctcactactgggtatctatctaaaggaaaagtaattatatcaaaacaacatctgcttgcatatgtttactgcagcacaattcacaattgcaaagatatggagccaatcctaagtgcccatcagctgatgatggataaagaatatctgccatatatgtgtgtaacatatacatatatgtgtaatatatacatattgtaatatatacatatatatgtatatattacacacgcacaacccatggaatactactcagccataaaaaacaatgaaagtatgtttgttgcagcaacgtacatagaaccagaagccattattctaagtgatataattcagaaataaaaaaccagatatcctatgttctcacttgtaagtgagagctaagctacgggtgcataaaggcatacaaagtggtgaaatggacaatggagactcaggaaagtgtatggtggaaggaggctgagggataaaaaacttcatattgggtacaatgtacactactgaagtgatgagtgcgctaaaatttcagacttcaccactctacagtttatccatgtgaaaaaaaaatgcttgtacccctaaaactattaaaatagattttcagataagaaaacaaaacaaaacaaaaaaacccagtgaattggataaagaaaatgtggtaaatataccatggaatattacatagccataaaaaagaatgaaatcattttctttacatttcctttgcagaaacacaggtatgcacagacataaagatggcaacaatagacactggggactactagagcaggagagatggagtgaggcaagagctgcaaactaattattgggtactgtgctcagtacctgggtaatgggattcattgtactaaacctcagcatcacacaatataccagttaacaaacctgcacatgtatcccctcagtctaaaataaaagttgaaattttaataaataataaaataagaaataaaaaagttaaaaatcatgccagaaactttgagaaattatctctaaatacatatgatttataagatcttagtataaaaatctatatataattcctaaagatagacaatcaaccctagaataacatacaaaatgaatatgaataatacattaattaaaaaacattcctgaatgtcttacaaacatatggaaagatgctatttctcactattagtcaaggaaatatatgttaaaaataatgagatctcatattaaataatttggcaaatgttatggacatcatcacaagtgttgacaaacataaaaaaaaaaccgactggccagaactaacagtagtactacgttaaataggaatggtgagagagggcaaacttgtcttgtgccagttttcaagggaaatgcttccagcttttgcctgttcagtatgatattggctgtgggtttgtcatatatggatcttattattttgaggtatgtgccttcaatacctagtttattgagaatttttaacatgaagagatactgaattttattgaaggcattttctgtatctattgagatgatcatgtggtttttgtctttagttctgtttatgtgatgaatgacatttattgatttgcacatgttgaacaaaccttgcatcccggggatgaagccaactgcattgtggtgtataagctttttgatgtgctgctagattcggtttgccagtatttcattgaagttttctgcatggatgttcattaggtatattgtcctaaagttttctatttttgttgtattatgaaaatggccatactgcccaaagtaatttagaaattcaatgccattcccattaaactaccatggacattcttcacagaattagaaaaaaactattttaaaattcatatggaacccataaagagcacatatagccaagaaaatcctaagcaaaaagaaaaaagctggaggcatcatgctataagagttcaaactatactacaagagtacagtaaccaaaacagcacaatactggtacacaaacagacacattgagttaataattggtgttaagtgaactggcttgccatatgcagaaaattgaaattggacctttgtcttacaccttatacgaaaattaacttgagatggattgaagacttaaacgtaaaacccaaaactataaaaaccctaaaagaaaatctaggcactaccattcaggacatagcacaggcaaagatttcatgatgaaaacaccaaaaataattgcaacaaaagcaaaaattgacaaatgggatctaattaaactaaagagtttctgcatagcaaaagaaactatcagcagagtgaacggacaccctatagagtgaaagaaaatttttgcaatctgcatctggcaaaggtctaatatccagaatctacaagaagcttaagcaaatttacaagaaaaataacaaacagccccattaaaaagggggcaaaggacaggaacagacacttctcaaaagaagacattcatgcagccaacaaacatgtgaaaaaacatatgtaaaaaaagttcaacatctctgattatttgagaaatgcaaatcaaaaccacaatgagaatgccaactattaaaaagtgaagaaacagtagatgctggcaaggctgcagagaaaaaggaacacttttacactgttggtgggaatgtaatttagttcaaccattgtggaagacagtgtgctgattcctcaaagatctagaagcagaaataccatttggcccagcaatcccattactggatatatactcaaaggagtataaatcattctattagaaagatacgtgcatgcatatgtcaactgtagcactattcacaatagcagtgacacatggaaacaacctaaattcccatcaatgatagattggttaaagaaaatgtggtacgtgttcatcatggaatactacacagccattaaaggaatgagatcatgtcccttgcagagacatggatggagttgaaaaccattatcctcagcaaacgaatgcaggaacagaaaaccaaacactgcatgttctcacttataagtgggagctcaacgatgataacacatggacccatgatggggaacaacacacactggggcttgtcagggggagagtggggagggagagcatcaggaaggatagctagcgaataacgggcttactacctaagtaatgggttaatctgtgcagcaaaccagcatggtacatgtatacccatgtgacaaacctgcccatcctgcacatgtacactggaacttaaaataaaagttaatggaaaaaaaagagaaacagactcatacactgcttgtgggtatataaattataacaaggtattagaaagcaaatcagcaagcaaatttacttaggatggcatacttaacaattacagttctaggagtataacttagattaaggttttttatcctaagcactattgagattttcggctagaaaagtgcttgatgtggggacttttttttacacaggtatatttagcagaatccctgaacactacccacttgatgccattagcacgtgccaccaccagttgtgacaaccctaaatagccctagatattgccaaatgtcctcaagagggaaggggagcaaaataatctctgtgtgagaagcactgaactagagaaacttgaaaaactctcacatacacaaagagatataccattatgtgttgaattgtgtctcccaccaatttacatgttaaagtcctaatgttcagtacatcagcatgtgaccttatgcggaaatagggtaattgcagatgcaattagataatatgaggtcattagggtaggctgtagtccaatatgactggtgttgttacaagaagagaaaatttggatataggcataaagagaagacaatgtcacgagataaaggggaaaaaatggccatctacaatccaaaaacagaggaccaaacggatctttctctcaatgccctcaaaatggaccaagtctaccaacacctttattttggacttttagactccaaatttttacttttgaaaagtaaaaaaaattaaaattagtttgctttaatttgtaaattctcttcatagactaatggtaagacaatacaccacccagtttgtggtattttgtcagaaacagtgacaaagtaaattacaagcactccttagtaaattaatactaacgtgtaagaatgtttattgcatcattatttataaaatttggcatctatacaaaatctaagagagaataaaataattacttgtagcttattcatacttttgaaaagtatgcagaaattataaatgaaatggcactacatatattaaaatgtctgcatgtaaataatattgagtaaaactataatgtgcaaaataacttttacattattacatcatttatataaagcagagaaacatgcaaagcctcacacaagcaaaaacaaattgaaatggtaaacaacaaattccagacagtggctaatgtgtgtaaagaaggaagggaatgaaattataaaggcacagatattgaatgaaagccatctttatttttcctatattaaaaagtttgtagcaagtgtggtgaaacgttgagatttgttaaggctatgtgttgattccatatgtgttcatttatttttcttcatattttaaattatcaacatctcacataaatgtttctcatattaatccttaatcaaaatttctataattattatagctgagtcaaaactgatgaatatatttaagacttttgatacacattttcaaattgtcatctttaagtttgcatcaacttacattttcaataacagtgcatgggagagatggttttatttactcttaaccataatggtattaccattatgtttagatttcataatttaattaatgcaaatggaacctcaaagtttttatcaatttatatttttatgttactttgacttctggtaatatttgatgtgtttgttttaacagatgtcacttgtatattttgtaagttgtgagtatatagtttggtagtttagtaaactttattgaggtttggtttatgtttaaggaattgccttattttcagtttatagttctatgagttttgataaatgtgtttacacatatgatcatcacaacacttaaaatatagactatatctaccaccctataaaattccctcatatccctttgcacttatttccttcaccccagccccagcaatccttgatcttatatcactatcaatttgttttgcctcttcttgaactttgtataatcggatcatactctgtgtgctctctagtttctgacttttttctctcattctaatgcaccaatttttaaaatcttggtgttaatttttgctttaatttgtaaatgctcttcatagactaaaatattaatctttttcatgttatatgtgttacaaaatttatccaaatttgcccttgccctcttatatttacttaagaatactttaagtgtttagatgtttataatgtatacctaataaattatgtcaacattttctattagagattctgccttttcatagaatgtgcttagatgcttttcaaaacctgaaatcagagttttatcagtgtgaaaaggtgtgagtagggagaatgactctggtgcactgtgtctcaccatacgtgaatagtgctttctgaagatcacctttttgaagaggtgatcttgtatagggggtgctcttttctcactttaatgtcaatggaagagtcttcgacgtcaccagggtacccaatatgaattatctgtcacttagggaaacacaggggactgatgcttgattcatacctaagaaatataaaggaagagaatttggctaaaaggcttgtggcagcagaatagagggcttcaaattaggagggaatgatgcacctaccaacaacaaatcaaacaaatacctgttagtgacaagataccaaacatgtatgagaaaaccccataaacctaaggagccctaatgccggtggaatataaatgtcttatatgtgactggtgctatattgcaccggcattaggactccttaggtttatggggttttctcatacatgtttgttatgtgaggacttcaacactagaatagtcagaaaccacagtttgttagctataagagaagcattaagggctcaaagcataaaaataggaaagaattaattaatcatgcttcggcatctgtcaggacaagccaacttatattaaactacccccaaatctcagtggcttaccacaatcaaagtttattttccactcacacaaagtctaatgcagtgggtgctggtttggatgttctcctgctcaactgtctttcaggtgaggaactcaggaacctgggtccctgcagccctgttgttctgacatattgaggttctttacttccaggcttatctatagttccatttatattcctatattaactgtatctatattcatatataaataaaatcctacacattttcaagagtctgagtttttaaaattctaaaagaaaagctaaatctcaacaatttttctctcaagataatataaaaaatacagatttttatttgcaggcatttctttgcaatgatcagaggaagtgtccagttactacaaccagaattcactgagagttatatagaggttaatgattataaccagaaaacaataaatcagccagcatttgaggaaagtgaacactatgaaagagaagtagtgacctcaatagaaaactaaagaattaacctccaggaaataaagttaatacaggaaatggaagaaagcttacagtaagtccattttatatccatagaaaaattttagtatattttatccatttaaacagggtactataaaataaaatgtaaaaattaatagtaaaaatcagatacatgaaattactgaaattataaaatttcatatatataattacagaaattataaaattatagacactgaaattataaaaacacttcaatacatgtagatgaataacagaagagactcagctaaggatgtataaagttatctaaaagacataaaagaggtattctccaagaacgcagtacaaatggacagggatcatataagaggagagctcttattccaacatgtatctaatcagacttccataaagatagaataaaaagaaataacttaaatgatgactagcaatctgccattactatggatatgtacaagtcacatgttctactcatctctcatatccagtttatcaatgaatatcttatttccaactagtaatcagagtggacttttaaagtataaatgagagcactttatccttctttagtcatccattgcttctcattgcatgtagaaaaaataataatctgctccaagtctcccattatcctactcttcctttccgtacaatatatccattacaatgaccacttgttatttcccagaaaatctcaagatgcattctgtctcttggcctttggtcttactgttccttttgcctagactactctccccaactcatacccaagcttttcacaaatcttcctcctaggtattcttcagactaatattacataccaacttcttagggatgtttacacacataacaataagtatttaatttctgtggctattctttatcatagcttactgtgtatcttctttacaaatttatcaggatatgtaggttaagaaattttgcatacttgttgtctaacacaatgaaatataatttccaagagaatagaggtcttttctatccagttccccattgcatttccatcattcttatagtgcctagtctagcacaggataagtgcttactatatttgctaaatgaatatatgtactatttcatttgaaaggatccactaagattttaaagcaattcattaaaaatagtgtgcatttttacctacatagttatggtaaaatttcagaattcaaaggataaagagaacatattaaaaaaaataagagagcaaattaacaatgagctgtcaaagactggacactttcacaactctaaaatctaattcaaaacacagcaaataggaatatgcttaataaaggaaaggataactgaatttcagtaagacagcactgtgacatttttgataaccatcttataacccccattcttcagcatggtgccagtggctatgaatatgatggcctacatttttgatgtggctaacttgagacaagaggttaataataaagaacttgttcttaaaatactgtgttcatgtgttttgacctgtctggtggttccctgaggaatcacacagagactcacatttgttttgccctaatctcagggctcgaataaatttccaggttgcagaggtatctgtcaaaatattttaaaacattcatttccataactaccagagaagtgggtgacagatggggcaaacagataacaaatccaaaatcctggaaacgagaaggctgagaaggctcagaatgaagatacaagtattaagtcacttaagaaaaccttttaggtcactgatgatcactgacacaatggaaaacacagaatttagttaatatacacaaaagatagtcatcacaaaaagttttaaaaagttgctacaaaatggatgactgcaggcctcaacaatcaaaaatagcaaaccctgaggaaaggagatttaagttccaaaatactcttcaggatgccgagcttaagtagaaaatttcaagacatacaaacagaaaaataaatcccatccagaggtaaaaaaaaaaaaaaatgacttaagctgttctttggggaacctagatattcaattaactacacaaagattataaattaactttctgaaatatgctgaaagagcttaaggaaactggacaaataactaaagaaaagcaggaaaattatgtacgaacaaataagaatatcaatagaaacagagactataaaaaggtatcaaagtaaaattctgaagatgtaaagtataataactccaatgtaaatatcactgaaggattcaagaaatttaaataggtagtagaaaatatctgtgaacttgaaggtaaaaaatggaaattctcccctctgataagcagaaagtaaaaagaatgaagagaagcgaacatagcctaaggcttttgtgggacaccatcaaaaataccaacatacacatgggagtctcagaaaaagaagagataaagaaatgggaataaaacagatttgaggacctaaaagtcaaaaacaatttaaatgttgttaaagacttgcatctacacatccaagaagttcaattaacttcaaataggataaattcaaagtgatcaacacaaaggcacattataataaaattgtcataagccaagaaggagagaatcttgagcaccagaagtgactccttatgtacaaagaattgtcagaaatattaacagcacatttctcatcagaaaatatggaagccagaaggcaatggaatgacatattaaaagtgatgtaagaaaaaaacctgtcaactaagaattctgtatcttgcaaagttgtttgtcaaaaataagagatattagaacattccctataaacaaaagctgagaaagtttgttacttgaatacctgccttacaataattatttatttgagttcttaagactgaaagaaacactggacagtaaatcaaaagaatacagagaaatgaagaaatttggtaaaagtaaatacataagaaaatatgaaagccagtattattatatttctggtttgtaactttttattttatatgtgattttaaaaagtaatatgttaaaagattattataaatatatattaataggaaaacaatgtacaaagatgtaatttatgacaacttaaaagggtggtagggctctataagatcagggttttgtaggttatttaaactaagttaatatcaaataaattagattgttatatacttaggatgctaactgtaacttccatagtaactattacaaaaatatctaaaactacatacataaaaagaaattagaagagaatccaaaaaaatgacttaaagacaaataagacagtaatggaggaaatgaagtaaaaaagagttatgacacacagaaaacaaatagcagacaggtgacataagcaagatgactgaataggaacacttggactctcccacgtggacacaccaattgaaaagcaacacacaaattatttccctttgtgagaaatccaggaactagatgatatgttcctgcagcttcatcttcatggatgagtatgaaactgtccacattgaaaccagttggaaaaataaatacatcctctagccataattcccactacctggcacagtaacatatgttcagaatggaacccccagctcccagcttctctgtgagagtgaaagagatagaccgactacatgtagcatactaacacttccaggcgctgcctgaggatctggcttctctctcatctgttttggaaagctgatagaatctgacatatgtgtatcttctggggactacagagaacaaagaagtggtttgaactagtgtgtgggcacttgccacagctcttctacttggctcagcatagaattagagtgtgaaaactaccaactctctgcatctccctgaggagggaaagagttgtattgcatatgttatgtcttaacttttccaagtgctatatgagaggctggcttctaccccacctatctctgagagtttatgaggcttgacatattcaaataccctggggactacaaagacaaaattattagtttgagctggcatattaagcacttgccacaactcctcccttaaacttcacacagagcgagtgggtaataaagtcacccaagattgcagcttcaaccagggggagaaaagagattgaacatgcactcaaatgccctaaattttctgaggactgccaaaataactggtttattcctttttttttcttttttttagtgctaatgtgacccgttatgctctagtcatctgagggccaatgagaacaaagagggcagtttgaactagaataaaactgctgcaatcaccttcccccagatcaacatagagataaaaggcacaatttcccagttctcagcttcttcctggagatggaaagattggagcagagtgtctaatgatgcaccttctctgaagccttcctgagaaactggcttcattcttgcttgtcttgaagcactgaggggacctgcaatactctagatgctaggaacaaagaaagtggtgtggcctagcattaaggtttgagagacctccagaatgtctgaatagggtaattggtaagagttttctcctgtgaaaggccagtgcttgaagactgagagaggtgactcttttgtctaatgtgttaacagcaacacagagaatcaaaaaaatgaggaaacaagaaaatttgttccaaacgaaggaaaaagataaatttcaagcaaccaatcgtaatgaaatgaggatatatgatacacatgacagaattgaaaatggctgttataaaactgttcacaaatggaaaacactatatttaaagaagtacagctaatatgctgagaagaagagaaaagaggatcatattaatttttcactaaaaccataaaagactgaatgagaaaaataggaactaagaacaagggaaacaaatagaaaacagtaacaaatatgggggcttgacatattctagtctcctgggggctagaaagaacaagtggttggtttaaactagcataggatacttgccacaacttttcccccaagcttagtacagatattaatacaactatactagtaatcacattggatgtcaatggtctaaatgcaccaattcatacacagagattgtcaaaatagaacaaaaatcaagagctaaatacgggttgtgtgtaaggagcccactttaaatataaagatacatatagagtcaaagaaagtggatggagaaagatatgctatgccaacactaaataaaataaattgggagtagctatgttaatttcagaaagagcagactttaaggaaagttatcaggggaaaacagggagattacattttttacaacttttattttaggttctgggttatgcgtgcagatttgttatatacataaactgcatgtctcagaggtttggtgtacacagtatatctgcacccaggtaataagcatagtgcccaataggcagttttttgatcctctcctttctcccagtcctctactctcaagttatccctggggtctcttgtatccctctttgcatccatgtgttctcaaattttagcttccatgtataaatgagaacatgcaatatttgtttttctgttcctgtgtgattttaattagattaatggcctccagctccatccatgttgctgcgaagggtataatcttgtgtttttatgacggcttagtttatacaccacatttttaaaatccagtctgctgttgatgggcatttagtttgattctatgtctttgccacggtgaataatattgtgatggacatatgtgtgcatgtgtctttatggtagaactaccataaagacatgagtagatgcccaatatgggtaaatacccagtaattgaattgctgggtgaaatggtaaataagccctagtatttgagagcactgaaaggggattctagtcaataattatttaattgtacatttaaaaataactaaaagagtataatggaattgtttgtaacacaaaggataaatacttggggtggatacccaattttccatgatgtgattattatgcattgtatggctgtaacaaatatctcatgtatctcataaatatatacatctaatatgtaccaacaaaatttaaaaataaaataaattaataaaatgagacattacataatggtaaagagatcagtgctccaaagagatgtaacaatcctaacatgtgtgagtctaaaaacagagcatcaaaatacataagacaaaatctaacagaacttcaaggaaaaatggatgaatctactattatttggagattttaacatccatctttcagaaatgaacaagccaaaccagcagaaaattggaaagagcatagttaaactcaaaaactctatcaatcaacagaatgaaatgtaaatatctaagctacttcatccaacatcagaatacacattcttctcaacctcacgtgaaacattcaccaggatagataagattctggacaatgaaacacatatttaaacagttaaaatatgagatattatacaatgtctcctcttagaccacaatgaaatgcaattagacatcaatgacaagtgctcactgaagtcaggtaaaaaatgcatgcacaaatttaaagcagtaagacatggcatgagaacataagagattttttaaaaacattttaaaaggtatcaaacagaaatcgtggagcctaattgaactgaactgaaaatttcactagagatgttcaagagcagactagattaagtataagaaaaaattagcaaactcaaagacagtttattggaaataattaagtcagagaaatgaaaataaaaaaatgagtaaagaaagcttaaaggatttatgggacggtataaagtggactaatatacacagcatggagtcccagaaggagaaaggaccagaaattttattcaaacaaataatggttgataactttccaaatctggggaagaaaacggacatacaaatccaggaagccagaggacttgatataaaaagaatacagtgaaatttatacccagatatataatcaaattgccaaaaattaaagacataaaaagttttgaaagaagcaagagaaaagtgacttatcacatacctctataagtttataagaaggattttctgcagaaatcttataggccagaagagagtgggatgatataaaaagtgaaaaaaaaaaaccttgcatatcaagaatactgtacttgggagaactatccctcaaaaatgaaggaagagagaatttccctgaccaaaaaaaaagttaagtttgttcaccacaactaaacctgccttgcaagatatactaaagtaacttcccaatcaaaagatataggatggctgaacagatttttaaaaaataagatttaactatatactgtctataagagatttactttggatttaagaagacacataggctgaaaataaaagaatgagaaaagatattacatgcaaataaaaaccaaaagagaatgagggtggctatattgatatctgaaaaaatatattgcaagtccaaaactttagcaatagacaaagaagaacattacataataaaaatggatagttcaccagaaatagttgacaattataaataaatatgcaccaatcatcagagaacataaatatataaagcgaacattgatgggactgacaagagaaatagcaatacaatgataggaggagatttcaatactccatttcaaaaatggaaaaaaaaatccagacagatgatccatatggaagcagaggacttgaataacactataaaacaagtggacctaacagaaatataaataatataacacagaacagtagcagaatgcacattcttctcaagttcatatgaatctttccccaggatagattacacgttaggtgacaaaataagtttaacaaacttaagaagagtaaaatcataacaagtatattttatataaaaaatgaaaaaaaatcatggccatgtggatttttaaatttttattgttttatttttatgggtacagagtagttgtatatattttaggtgatatagggtttggatttgtgtccctgctcaaatctcatgtcaaattggaggagggatgtggtgggaggtgattggattatggggtcagatatcccccttgctcttcttgtgatagtgagtgagttttcatgagacgtgatggtttaaaagtgtgtaacacgtcccccctcactcactctctctcctgccaacatgtgaagatggtcattgcttcctgttcacctcctgccatgattgtaagtttcctgatgcctgcaagtcatgcttcctgttaagcctgtggaactgtgagtcaattaaatctcttttctttataaattactcagtctcaggtagttctttatagcagtgtgaacacagagtaacacaaaaaattggtaccaggatttgggcactactataaagatacctgaaaatgtgaaagtgactttggaactgtgtaacagacactggggttggaatattttggagggctcagaagaagacaggaaaatgagagaatgtttggaacttcctagagacttgttgaatggttttgattaaaacgctgatagtgatataaacaatgaagtccaggctgaggtgctctcagatagagatgaggaacttattggaaaatggaataaaggtcacgcttgttatgctttagcaaagagactggtggcattttgcccctgccctagagatctgtggaaccttgaacttgagggagatgatttagagtatctggtgaaagaaatttctaagtagcaaagaattcaagatgtgacttcactgtttctgaaagtgtatactcgtgtgtgtgtgaacaaagagattatctgctactggaacttgtacttacaagggaagtataacgtaacagtttgggaaatttgcagctgagtcgtggaaaaatgaaaaatcaattttctgggtaaaaattcaagcctgctgcagaaatgtgcataagtagagtagccaaatgtgaatagccaagacagtggggaaaatgtctccagaacatttcagagacattcaaggcaggccccctccccatcccaggtctgaaggtctaggagggaaaagttatttcccaggctaggcccagggacctgctgctctgtgcagccttgggacatggtactctgtgtcccagcagctccagctccaaagatggctaaaatgggccaaggtacagctcaagtcatggcttcagaggatgcaagctccaagccttggtggcttccatgtggtattgggcctgtgggtgcacagaaagcaagagttgagatttgggaatctctgtctagatttcagaggatgcatggaaatgcctagatgtccaggcagaagtctactgccatggcagagccctcacggagaacctctattagggaagtgcacaggggaagtgtggggttgaagcccccatgcagagtcctcactggggcactgcctagtagagctgtgagaagaaggccaccaccatcctcgagaaccttgaatgatagatccaccaacagcttgcaccatgcacctggaaaagctgcagacaataccagcccaccaaagcagccatggagcttgtaccctgcagagccacaggggtggaactgcccaagtccatgggagcctgccccttgtgtcgatgtggcctgggtgtgagacaaagagtcaaatgaaatcattttggaattttacaatttatgactgttctgctgtatatcttggaagcaactattagcctgtaaaatcaataacttgtttttaattttacaggctcataggcagaaggggcttgccttgtctcagaggagactttgaacttgaacttttgggttaatgatggaatatgttaagaccttgggaaactgttgggaaggcatgattgtggtttgaaatgtgagaaggacaagagatttaggaggggccaaaggtggaatgttacggttcagatgtgtgtccccactcaaatcttatgttgaattgaaggggggggggtctgcagggaggtaattggattatgagaatagatttcctccttgctgttctcatgatagtaaattctcatgagatgtaatggtttaaaattgtgtggcacttgtcccctcggtcactctctctcctgtaaacctgtgaagaaagtccttgcttctctgtcaccttctgccatgattttaagtttcctgaggcctcccagtcatgcttcctgttaagcctgtggaactgagtcaattaaatctgttttcttaataaattgcccagtctcaggtagttctttatagcagtgtgaaaatagactagtacaataggttacatgagatattttgatgcagacatacaatgcataataatcacatcagggcaaatggaaaatcaatgtactcaaacatttatcctttctttgtgttataatcaatccagttatactcttttagttattttaaaatgtacaataaattattgttgactgtagtcaccctgttgtgctatcgaatagtaagtcttattcactctatctattgttttttgtacacattaaccatccacatttccccctccttactacccttcctagcctctggtaacctttcctctacctctgtcaccaggagtttaattattttagcttttagatcccacagataagtgagaatgtgtggtttgtctttctgtgcctggcttattttacttaacataatggccttcaatttcatccaagttgttgcaaatgacagtatttcatttttttatagctaaatagttctctatggtgtatatgtaccacattttcttatccattcatttgttgatggacacttatgttgctttcaaatcttggctggaaaaaacatgagaatgcagatatgtctttgatatatcaagttcctttgttttggtttcatacctagcaatggaattgctggatcacatgatagccctatttttagttttttgaggaacctccaaactgttctccttagtggttttactaatgtgcattcccaccaacaatgtatgagggcttcctctactctgcatcctcaccagtatttgttattgactctcttttggatttaagccattttaattgttgtgaggtaatatctcatcataatgttgatttgcatttatcttatcattaatgatattgacctccttttcatatacctattttccatttgtatgtcttcttttgagaaatgtctattcagatcttttgaccatttttaattgaattattagatttttttcatatagaattgtttatgctttttatgtgttctggttattaatcccttgttagatagagagactgcaaatattttccccccttctgtgggttttctcttcattttgttgattgctttgctatgtggaaactttttcagttgatgtgataccatttgtccatttttgcattggctccctgtgcttgtaaagtagtactcaaaaactctttgcccagtccaatgtactggagagctgcctcaaagttttcttgtagtagtttcagaggtccagcccttagatttgtttttaatccattttaatttgatttttgtaaatggcaacagataggactccagttttattcttctgcgtatggatatccatttttcctagcaccgtttaatgaagagacttccctttccccagtgatttttcttgacatctttattggaaatgagttcactgtagatgtatggatttgtttctgcattctatgttgtgctccactgatctgtgtgtgtgtgtgtgtgtgtgtgtgtgtgtgtgtgtgtgtgtttatgccagtaccatgttgtattggttactgtagcttatagtagaagccaggtaatgtgattacttcagttgtttttatttttgctctggatagctttggctattcttggccttctgtgtttccatataaatttaagattacgttttctagttctgtgaagaatatcatcaatattttcatatcatcatccaactctatgctctgctacaagagacttccttggatacaaataaacaaattggttgaaattagaagtaacgaaaagagagctagcttggctaacgcaaatatgagataaaatacaattaaaaaagaaataggtctacaataatagttgaacacttcagtacttcactttgaataatagataaaacacttaagcagaaaatcaataaggaaatagagaacctgagcactataaatgaagtagacccaagagacaaatataaaatggtataccccaaaccagctgaatccacatttttctcagctgcacatggaaaatcatcaaggacacaaaacaaatcttaataaacttaaaaaatgatattatagaaagaaacacaagaaaggaaactatagacaaatatcccgtatgaaaatagatccccaaatcctgaatgttatactagcaaaccaaacccaacagtataataaaaggcttatacaccatgactaagtaggatttatctcaggaatgcaaagttggttcaacacaaaagtatcaatcaatgaaatcaatcacagtaataaattgtagggaagaaaaacacatatttatttcaattaatgtaaaaatcattcaaaaaagaaaatacaacaatataataagaagtgaagcactcagaaaactagaaacagaatgaaactcacaccatgataaagaacacttagagaaacccagaactaacatcatattcaatagctaaagactaaagtctaccctcatgagatcaggaataagacaaggatgctcactttcaagattgcttttcaacattgatctggcagttctaactagagtaataaagaaatatatatatatatatatatatatatatctgtgtgtgtgtgtataatccaaattggaatgaaagaaggaaaattacttatatttgcagatgacataactctataaatagaacctaaaaaaacctattagtgatagttaataaattcagcaaaatttcaaggcacaatatcaacatgaaaaattagattgtgttttaatacaccagcaactaaccatgctgaatggaaattaagaaagcaatttcattaacaagagcacttaaagaataaaacatcttgaaataagcttaaccaatgagacaaaagatttgtgtaccaaaagccacaaaatactgctgaaaaacaagagctaaataaattgaaagatatcctatgtttatttactggaagacttaatattattaaaatggcactactacccaaagtgacaaagatattcaataaaatccttatcaaaattccaacggcctgttttgaagaaataaaataaataaatcttcaaatgaatatgtaagtgcaagaagcctcaagtagtcaaaaaaatttagtaaaagcaaatgtaggagaactcacacttactgatttcaaaacttattataagtctacagtagtcaatacagtgtgatacttgcataaaaatggacatatagacccatggaatagcaaaagcattcagaaacaaacccacttacctatggaagattttcagcaaagtccaaagaaaattaaacagaaaaaataatagtcccttcaaaacaggatgctggaacaactaaatatccacatacaaagggatgaacttggacccctacttcacacaacgtacaaaaaagtaactcaaataaacccatgacatagatcgcagagcaaaaaccacaaatctcttagaagaaaagatagagataagttttcataacttttaatttggcattaatttcttaaatatgacacagaaagcatgagcagtgaaagaaaaaaattgataaatttgactttatcaaaattaaaaacttcgtgcatgaaagaacattatcaagacaatctaatgaatggcagaaaatggccgggcacggtgtctcacgcctgtaataacagcactttgggaggccgaggcgggcagatcacaaggtcggaagatcgagaccatcctggttaacacggtgaaaccctgtctctactaaaaaatacaaaaaaattagctgggcctggtggtgggtgcctgtagtcccagctactcgggaggctgaggcaggagaatggcgtgaacccgggaggcggagcttgcagtgagccaagatcaagccactgcactccagcctgggcgacagagcaagactccgtttcaaaagaaaaaaaaaaaaaaaggcagaaaatatttccaaatcgtatatctaagagtctagtatccacaaaataaaagtaatgtttacaagtcagtaacaaaaaggcaataaattccacttaaaaatgggcgaaataattcaatagacatctctccaaagaagatacacaaatgaccagcaaacacatgaaaatatgctcaacatatttagtcatgagggaagtgtgaaggaacaccaaaatgaaacaccactttgtacctactagtatggccttaatatatttaaaaatggaaaacaataagtgtttgtgaggatggaaacaaattggaacccttatatcgatcaggttggtatataaaatgtttcagcttctatggaaaacaatttggcaaaaactagaagttaaatatcacattatttatattataccacaattccaatattaggtatatattccaaataattgaaacaggtaccaagcaaatatgtgaatacatatgttcatagcatattcacagaagcaaatgtacacattttatgaacaggtgaatggataaataaatcatggtatatacacatgatggaatattattcagccatcagaaagaatgaaatgctgagacatgttaaaagataaactgaggcacattaaaatattagagttatttgagcaaacatcaatttatgaattgagatctgtcagactgcaggtggtttgggggctccacagaaagggcacaaggtgaaggcttctatagattaagcatggaagcaaggcaaataaaatatttgattaaagtggagaaatatccttatttgtattattccagtagaaagtccccatttagaggttatttggtggtttctaattggttaaacttgaaaatttatttcactgtttacactgagttgggttgtggttttctttcatacaatcatgggatgttggatctgcctcagcctaaaggcttcccaattaattattctaacgggtattatatgatgtggacaaatttgaaagcatgctgtgtgaaagaattcacacacaaaaggctgcatatattaaatgactccatttatattaaatatttagaacaggcaaatccataggaacagaaagcagattgctgcatacctgaggctgggtagaaaagaagatgaatagcaactgcttaatgatatgaggatttgttttaggtgatggtgaaatattttgtaaatacaaattgtggttgcacaatattgctgatgtactaaatacatgtaactaaattgttcactttaaaatgtttcattttatgttatgtgaactccatctcaataaaaaagaacctcaagtaaaattaattatgcacaaaatatgacagcaatattgacatatgttttttcctatttctgtgggaaaattatttaaaatacgtagtgtaatacttagttagaccaccattcaattatgggagcaaaatttatagctcagaatatacaatatttgtaaagtatatgacaggtaatctctgaataagataatacctgtaaatttcttaaattagtgtctgacacataggttcaattagccactgtcattatttgaagggcattacgcaattacttcaaagtcatgactgaactagaaaacttatcttggtactacggtattggtgaaactcatgaaggtgggctccccaactacaggattaaaatcctagtcttagctctactttgcatgcgtacctaaatccttctatcactgtggaaataagggcctcaacccttgctctgatttccacatcctgaccagtcgtttggccatcatttgaacaaaaatcccaagataattctagaactttggaatgactgaaatttctgattttgaagacataattaggcacaacaatgcatatttatctagaggggagagaaaggaaatccatatgtacaaaaagaagcatcagatttcttaaacacttaaggaaaaaaaatacaacaatgaaaattagttcaacccaaccaaaatcaggctagagaagggtgtggaaaaagggatggagggggagagaaagagagaaaaaaacaatatatagggaagctattagaaagtgctcatattgatggataatctaaaattataaaatacagaaaatgattatcctgttccatgtcaaaggatggtaagcaaatttaggaagcattttctatttaaaataatataaatagagtaccaaggtgggcaaattaaaataaataatggataaataaatattcagaaacagtaacactgtggtgaaacttattaaagataaaaaatacaaatatttctataaagatggaagacagttcccaccaagaatatataaggaaaatgaaacctttttatctagcagcacagctttgaagtatatatcacatacgctattcaaaatacaagaaacagaaaatgtataatattttcagtcattattgaaataaattttagcagttctccattatgctaccaaaactctcaatttcaaaaagaataaaatgtagagggcacacctatgtatagccatgtgataatattataaatatacaacaatgtgaacatgtcctaaaataatccaatggaaaattaaagacaaaaaggttattttgcatggctcattcaataaaagggaattgaaacgtgaactcacattttcttgggacgtcaacaacaaagccactcataccaaaagctatgggttatggcaaaagtggtgctgatagaaaatttactaatatattcatttctcagatatccattcagcacctaccatgagccaggcattattcttggtgttaatatagatatatttagatgaatattattcaggtagaaagtaccaacaataaaatggacagattttaaatgttcaggtaaatgagttttgacagttatatacactcacgtaaccaccacttacaataataatatacaacatttccactgtggcaaaatgtcccgtcatgctccttctcactctgtcatatttttggacaaacaactgtggttctgatttctaacatcatagatgagttttacatgttctttgacttcacacgtatgttatcagataatacatattttttattattatacttttaagttctggggtacatgtgcagaatgtgcagatttgtcacatgggtataacacatgctatggtggtttgctacacccatcaacctgtcacctacattaggtatttctcctaatgctatccctcccctagccctccacctcccgacaggccctggtgtatggtgtactatgcagtcataaaaaaggatgagttcatgtcctatgcagggacatggatgaagctggaaaccatcattctcagcaaactatcacaagaacagaaaaccaaacacagtatgttctcactgataagtggaagttgaacaagggagttgaacgaggagaacacatgaacatagggaggggaatatgtactttttggatcagttttctttttcaaacaatgtctgtgacgttcacccatgttgttttatgtatcagctgcaattttttaagtttaaattctatttatttctttttttaagaatttattttttaaaaaattggagtcggggtacatgcacaggtttgttacaaggtgatattgctagatgctgaagtttgaggtggatggtcctgtcacccaagtagtgagcatagtacccaatatcttctctcgcttccccgtctaggacccagtggctattgtttccatcttcatgtccatgagtattcaatgtttagctcccacttacaagcgggaatatgcagtatttggttttctgttactataataatttgcttaggataatggcttccagctgcatctatgtggctgcaaaggacataattttattcttttatatagctgtatagtattccgtggtgtatatgtaccatattttatttatccaatccacctttgatgtgcacctaagttgaatccttgactttgttattgtgaacagtgctgcagtgaacatacgaatgcacgtgtctttttggctgaatagtttattttcctttaggtatatcctagtaatagaattgctgggtcaaaatgtagttttatgttctttgacagatctctgaactgtttttcacaatggctgaactaatttgcattctcaccaacagtgtataagcattccctttcctccacagcctcaccagcatctgttaaattttgactttttaacaaatgccattctgacaggcgtgaaattgtgtctcatactcattttgatttgcatttctccgatgattagtaatatggagcattttttcatattttggatgcttatacatcttcttttgagaagtgtctgttcatgtcctttgtcgatatttaaattgaattacttgctttatgcttgttgatttgtttaatcaattacaccaaaataaaaaattaacaaatggacctaatcaaactaaagagctactgcacagcaaaagaaattattaagagagcaaacaacctatagaaagtgagaaaatatttgcaaactgtgcatcaaacaaaggcctaatacccagaatttacaagatacttaaatcaacaagttctgtgtttttaattgctgagaataaagcatttatgattgcattgtgtggatatactacagtatgtttgtccattcacctgctaatatacatttggattgtttccagttggcgatgattaccaataaaactgctaggaacatttgtatacaggtattttagtggatagtatgcttttatttctcttgggtaaatgcctagaagtgaaattattgggttgtagggtaagttaatatataacttcatatgaaactgccaaattgttttactaagtaactgtaatgcatcttctttgttctaaatttggaaaacatacgaatatatatatatatatatatatatatatatatatatacacacacacatatatatatacacacacatatatatatatatgtgaaaaggagaaaagaaaatctttctgtgcccatatcagagataaaatctctacccatatccagagataactattagcattttggtgaatttccattcattcattctcagtctctccttttatctctccttcctctccctcctactcttgctttatcctcatttcctctctctctctctctctctccttacacacacacacacacacacacacacacacacacatatatgtgcgtgtgtgcatatcaactctaaatttagatcatattcatagaaacataacaaaaatttgatcatactctatatatgggtttaatattccatatttattgaatttattatgaatttcccacgttttaaatttacctttaaaagtatgaaactttagctcttccccctttatcaagtacccattttttaatattacatcattatacaacccccttacattgaatttttaacaaattttattatttgcctaatatttcctattagcttcatgagggttgccttgtcgctgttttcccagtacctaagggctagcaagtattaagtttgccattaataattatacaataatttcgacatttgtatttaaagaaacatcacctcaagtatattttattttaaaaaatttaagggaaccggccgggcgtgggggctcatgcctgtaatcccagcactatgggaggccaaagtgggtggatcacctgaggtcaggagtttgagacaagcctgaccaatatggtgaaaccatgtctctactaaaaaataaataaataaataaataaaattagccaggcatggtggtgggcgcctgtagtcccagctactcgggaggctgagacaggagaattgcctgaacctgggaggtggaggttgcaataagccaagatcgtgtcactgcactccagcctgggcgacagagtgagactctgtctcaaaaaaaaaaaaaaaaaaaaaaatatgagggaaccgtgtaatgtggtgtatcacatttatggatttgtgtatgctgaaccatctttggattccagggatatatatcacttgttagtggtgaatgatccttttaatgtgtccttgaatttgctttgctagtatgatgtttaggacttttgaatctatattcatcagggataatgaccctgtaattttcttttgtttggctttggtatcaggataatgctgtcctcataagatgagtttggaagtgttactgcctctgtagttttttgaaagagtttgatagggttgccataatattttttcttttgaactttaattttaggttcaaggggtacacgtgcaggtttgttacattggtaaattgcatattgtggaggtttgatatacagataaatttgtacccaggtgaacagcataatacctgataggtagttcagtcctcaccctccttccaacctccaccctcaactagtctcagtgtctgttgtttccttctttgagtccatgtgtgctcaatgtttagccctcacttataagtaaaaacacgttgtatttagctttctgttcctgcattaattctctcaggataatggcctccagcatttcatgtctttgctattgttttttaaatgcttggtagaattcataagtaaagccatcagctcctgagcttttctttgatgggagattagttcattattaattcaatgtcctttctcatttagaatctgttcacattttctattttttaaagattcagtcttggtaagtggtatgtttctaggaattcatccatttcttctaggttatccaatttgttgtgtacaattgtttttggaagtctcctgtcatccttcatatttctgtagtatcagttttaatgtaccactttttgtttctaattttatttattttaattttctctttttgtttcttagtctagctaaagaaggtttttctattttgtttatctttatttaaatagaaagctaaggtttttctattttgtttatctttaaaaaccaactcttaattttttgaacttttctattgttttttctagtcttcattttatttttttctgctctgattctttgttattttatttcttatactaactttgagtttagtgtgttctatttttttgcttctttaaccgttatagctaggttttttatttgaggtctttctgttttcttcatgtaggtttttatcactataaacttccctcttataactggttttgctgcatcccatacgttttgatatattgtatttccatcgctcttcatctcagtatatatttacatttttttaaatttcatgtttgatccattggttgttcaggagtgtgttgtttaattgccacatatttttagatttttaaaaattcctcttattattgatttctagtttcgtgccattgtggtcagaaaagatacttgacataatttcagtcttaagtttattaaagcttgtcttttgcctaatttttgatttatactggagaaagtttcaggtgcgcttgagaatgtatattctatggctattgaatggaatgttctgtatatgtctgttaggactgtttggtctacactgtagttcaaacccaatagtttttattgattctttttctggattatctatacattgttgaaaattaggcattgaaggtgattatttttgtattgttgtctatctctccattcagatcaattaatttttaatatatatttaggtactgtgatgttgggtgtgtatatatttacaattttatttcctcttgatgaattgacccttttatcattatcaaacaacttttgtctttttgtacagtttttgacataaattctattttatctgatataagtatagctatttctgctgtttgtttctatttgaatagaatatctctttttccatgctttcacaggtatgtctctaaatctggtgtgagtctcttgtaggcagtatatagacagctcaccttgttaatccatttagccactctgcattttgattggagaatataatctatgtgaattcaatgtaagttttgttagatacggacttattattgctattttgataattgtgtttggatgttttgttgacattccttatttttctctttctgcctccatatttctgtaatagtatgctttaatttcatttttgttatctttttttgcatctaccataggtttttgctttatggttaccctgaggtttacatatacaatattataagtcatttaagctgataacattctaattccaatggcacataagcattctagacttttacttttcccaattttatgtttttgatggcacaatgtgtatatttttatattgcatatttattcacaaattattgtagctatagttatttaatttgttttgtcttttaactttatactagagatctaagtgatttacataccaccattaaagtattagaatattctgtttttgactatttatctgtatttgaatatttatttactttcaccagtgatttttatacttttataagatttcatgttaccaattagcattctttcatttcagcttggaaaatttcctttagcatttcttgtaaggcagatctagtaatgatgaactacatcagctcttgtttgtctggaagtctttttctctccttcatttctgaacaatagctttgccagaaaaagtaatcttgtttggcagttttttgtttcagcacgttcttcctgtctcctgacctgcaaagtttctgccaagaaatccagatagccttatagtcatttccttgtatgtgaagaaccacttttctcttatctttttaatactctttgaagactatattttttctttttttaaagtttggttataatatattgtggtgtactttcatttggtttgaatcttattgcattcctttgagcttgatgtacatacacgtttgtatcttcttccagatttggggagttttcagtcaatattcgttaaatctttccctttatttatctgttctctttctggaacccctataatgcaaagttagctcttttgatggtgccctataaatcccctaggctttctttatttttattctttttttcttttttatccttcgcctagatattttacaattacatctcttaagagttcacagattcttccttctccttagtcaattctgctattgatgctttttatttgcatttttcatttcttatattgaattcttcaactgcagaatttcactctttttaaaattatttctatctctatattgaacttctcaattttgtgtgtattatatttctgattttgttcatttgtacatctgtgtttttttggaagttgctgaacttccttaaagcacttattctgaattctttgtcagacaattcatagatctccttgtccctggggccagttactggaaaattattgtattcctgtggtggtgtcatgtttccttgattttcatgttttgtgttgccttgattgagatctgtgcttttgattcatccattatctcttcttgactttgtggactgattttagtgggaaagactttcccctataggtgggtgcaagggaacttgttggatgaggtgttgtggtcatggctctggtgaaaccacagtagcataatccccatggagctctactctctgagactggcatcaaagaagattgtaggagtcctcagcagccaagcctatgggtgtctgcagcagcaacaaaggctgatgacgtcttcaatggtagtggcttctgagattctcctaataacattttctcccacagggaatgtagtggctgagtggatcccttttgtccccaaatcacgcttgcagatgtacttcagtggtgatggcactagtgtctgatgtacaatgcctgtggaatagcaacagagctaaggtatgaagtgtgggcatgcatagaaggatgatggctttggggtctgaggaagcagtggcaccccatttccatgtttttaacagtatgtgatgcatgggtgcttgcattgtggacatggagccagggtctggagtacaggttggtgcagagctactgctgctctgggaaccagagtaagaagacacttgctctagtagtggctctgatgtctgtggtgcaagtagttgcagcatggtttcagagccagtgtctaaaatgtaggaacttatgcatcaataatggggtcaggtgcacgtgctaagtcactctgcagctggcatagctgtccaaggcacatgtgctcacagagcagcagcagcagagacagggactatagcataggagaacacagagtaaccatgattctgaggcctggggcagtgctatttcacggtggcactagcatcagtttctgagccataggaatttgtggtgtagttatggactttgattctggagtgcacacacgtggagcagctgcggtcccatggtctgggtaatgcatgttgctgggacatgcattggggtgtgcaccattcattggtggtggccctggttctggggtagcacaacaatgtcttcttcttagggggcataatactgtgtctacttctctgtgggttccatagtggtaatggctgctggttacttcagcagagaatgctgctcttggcacatgccatatgattgatactgatagtctccaaactggctgtctccatatttctcacatatgctggtctccccagtgatcctttctgtgaagtactctctattttattgatccattgtgttgttgctgatccttaattgaatccttcatccctcccaaggctattatttttgttggatagctgtctaattgctcttctttgtgtgagaatgaaggcttgtatcttatgcttcaccatattgttgatattgctagctatacgtttttaaataaagtgtctaagcctcctctgaatcagttttactagctactctctcaatttattccctcttcagctgtattcttattctttcatattactatttttctagagaaagcatggcattaagaaaatgtacggaatgaaaaaaaatagcatacaagggcatggatttccacgtactcagaagagttgtagaatgatgcaggaaatatatacctagaattttaccctatgattctgagacagagtattacaacctcagcattatggtcattttcaactaggtaattgttgggtggaaattttctgttcattttagggtatttagcagcattcctggcctacattcactagatgcctgtagcaccctcccacaaggcatagaaataaaataatgacaattgccagatgttccctgtgaggaagataaaaattgtcctcagctgagaacaattgttctgatgtaacaccactctcagacaacagtgcaataaaaatagagatcaataccaagaatatctctgaaaactatacaattacatggaaatgtcataatcagtgcctgaatgacttttgggtaatcaatgaaattaaggggaaaaatcaagaaattattaaaacgaatgaaacaaaagaaacaacatgtctgaatttctgggacactgctaaagcagtaataggaaagtttatagttctaaatccctgcatcaaaaggaaagatctaaaattaacaacctaacattagacctagaggaattagaaaaacaagagaatatcaaccataaagctaccagatggaaatgaagaaccataatcagagctaaactgaatgaaattgagacatgaaaaactgtgcaaaagatcaatgaaactaaaagtttactattgtaaaggataaataagattgatagaccactagctatactaataaagaaaaaagagagaagattcaaataatcgcaagcagaaaaggcaaaggagtcattaccaccaaccctacagaaacacaaaataccctcaatgacagttatgaacacctccatccagataaattagaaaacctagaagaaatggagaaattcccggaaacatacaacctcctaagattgaatcagaaagaaaaggaaacccccaaaagaccaatgggttccaaaattgagtgagtgataaaaacctaccaaccagaaaaaagccaaaggccagacagattcacagcccaattctaccagatgtataacaaagagctggtaccaatccttctgaaactatactaaaagactgaggagaaaggactcctcccttactcattctgcaaggccagcatcattctgataatgaaacctggcagagacacagtgaaaaaggaaaatgtcaggtcaatatctctgatgaacatagaggcaaaaattcttaacaaaatactagtagaaccaaatttaaacagaactaaaaacaaaatacacatgattctcttaatagatgcacacaaagcttttgataaaattccatatccattcatgttaaaaaccctcaaccaactacatattgaaggaacatacctcaaaataataggagccttctatagcaaacccacagtcaatgtcatactgaacaggaaggaagcattctctttaagagttggaacaagacaatgatgaccactctcaccacacctactcagtatagttctggaagtcctagccagagcaatcaggcaagagaaagaaataaaaagcatcaacttagagaggaagtcaaattatttccctttttagacatatgattctatacctaggaaactcaatagtgtctatccaaaggctcctagaaattataagcaacttcagcaatgtttctggatacaaaatccacatacaaaaatcactagcatttctataagccaatgacattggctgatagccaaatcaagaacattatccaggtcagatgtggtggttcatgcctataatcccagcacttcaggaggccgaggcaggcagatcatctgaagcaggagttcaagatcagcctggccaacatggtgaaaccctgtgtctactaaaaatataaaaaagttagccaggcatggtggcaggctcctgtaatcccagttacttgggaggctgaggcaggagaattgctagaacctgggaggcagaggctgcagttagccaagattgcaccattgcactccagcctgggcaacaagagcaaaactccatctcaaaaaaaaaaaaaaaaaaaaaaagaatgttatccaattcataatagccaaaaaaagagtaaaatatctagggatacagctaaccagagagatgaaagatctctaccacaaaaattacaaaatactgctgaaagaattcagaggtcacacaaataaatagaaaaacattctatgttcatgaataaaaataattaatatctttaaaatgaccatacagcccaaagcaattggcttcaatgctatttttatcaaaataccaatgagatattgtcatggaataagaaaaactattgtaaaattcatatggaacaacaacaaaaaaactaaatagccaaagcaatcctcagcaaaaaaataaaaataaaaaaataaaataaataaaaaataaacaacccagagacatcacactacccaatatcaaactgtacttcaaagttagagtaatcaaaacagtatgatattagtacaaaaacagacatgtagagaccaatggaacagaatagagagcccaaaaacaatgccacacgcctacaaccacctgatcttggacagagttaacaacaacaagcaatggggaagggcctctctatttaataaacagtgctggaataaatggctgccaaaatgccaaagcttgaaaccaggctccttcctttcattatatctaaaaatcacatcaatattaatgaaagacttaaatgtaaaatttaaaactatagaaaccctagtagaaaacctaggaaataccattctggatataggccctggcaaaaattgtatgacaaagacttaaaaagcaattgcaacaaaggcaaaatttgacaagtgggacctaactaaactatagagcttctgcacaataaaagaaactatcaacagagcagagagacagcctaccgaatggaagaaaatatttacaaactttacatcttattaaagtctactatccagaatccctgaggaacttaaaccaatcagcaagcaaaaaacaaccacattaaaaaatgggcaaaggacatcaacaaacatttttgaaaagaagacgtacatgtggacaacaagcataggaaaaaaatgctcaagattactaatcattagagaaatgaaaatcaaaaccacaattagatattatctaacaccagtcagattcgtgattattaaaatgtcaaaaataacagatgatggcaacattgcagagaaacgggaatgcttatacactgctgataggaatgtaaattcgttcagccattgtggaaagcagcttgatgatttcacaaataacttaaaaccttaagtaccatttgacccagcaatcccattattgggtatttatccaaaataatataaatctttctaccattaggacacattaatgcgtatattcatcacagcattattcacaatggcaaaatcatggaatcaacataagtgaccatcaacaggagattggagaaagaaaatatgatacatatacaccatggaatactatgcagccatagaagagaacaagatcatgtcctttgcagcatcatggatggtgctggtggtcaagatcctaagcaaactaattcaggaacagaaaatcaaatactacgtcttctcacttataagtggaagctaaacattgagtacacatgaacacaaagaagggaaaaacagatactacggccttcttgaaggtggagggtgggagaaggcagaggattgaaaaaccttttgagtagtgtgcttattagcagtagtatgcttattgctagtataatacctatcaaatactatgcttattagtaaatactatactagtaataagcatactactggtaataagcatatgataagcatactattagcaatatacatatgatgaaataatgtgcataccaaatccttgtgacaggcaattcgtctatataaccatcttttatatgtacccctgaacctaaaataaaattttttaaaatgttttagctaaatagtgaatctcaggttattatatttaccaacgagaaaaaaataattatcttctcattaactaagaagcctttaaaagaaagtatggtcaattctaactggattctgcaaatgattctaaataattacatctaaggaaatagcataaaataagaaatgtacattttaaattcatatacatattcattcttactaatattatctgttgatatcctttatattttcagaacacagtagctggccactgctttcaattgtaaattcaaaattaagtataaaaataccatttgattcaaagtttataggttgagaaaggagtggtataattacatatagtgattatagtacaagttaatatatatttattagttaagagtttactatatagaatacatttcctttctcctttattcatgtacagtcatgcatcacttaacagggataaattttgagaaatgtgcccttaagcaattttgtggtgtaaacatcatagaatgtatttatacaaacctggatggtatagcctactacacacctaggccaggtggtacagcctattgctcccaggatgcaaacctgtatggcatgttccattattgaatactgtaggcaactgtaatacagtagtcagcatttgtgtatctaaacatatctaaacctagaaaaagtacagtagaaatatgacataaaagataaaaaacagtacacctgtatatggcacttaccatcagtggagcttgcaggattggaagttgctctgggtgagtcagtgagttagtggatgaaattgaaggcctagtacattactgtgcactactgtagactttataaacactatacacttagcctacagtaaacataaataatttattcaataataaattaaccttagcttaatttaactattttttactttataaaattttatctttttaactactggatgttttaatagcacttagtttaaaaaacacacacattgtatagctgtacaaaaacatttttctttatatccttattctataagctttttttagtagttttaaacttttatctttctacttttacaactttttgctaagaaggaagatacaaccacacacattagcctaggcctacagagggtcaggatcatcaatatcaccaactttcatctccacatcattttccactggcaggtcttcagggacaataggacacatggagttgtcatctccaatgataacaatgccttctggaatttcatgaagaacctgcctgagggagtcttagagttaacttcgtttttctaatataagtagaagaagtatactccaaaataatgataaaaggtatattagagtaagtactaagcaataggaatattttcactccattataatcttatgacatcatcatcttatatgtggtctgtcaatgaccaaaatattgctatgcagtgcatgactgtatttctttatccacttattagtataaatctatgagttgtttttttatgtagtgagttgtaatatcatattgtactagtttttttgactaatgatacaaattttttttttctgtgctcattgaaaatttggatatcttcttttatggagtaccttttcaatcttgtgccatttttgtatttgtggtttgtctttttactttttacatgtagaggttttttcagtatattttgcatgtgattcctttcattcatagtataaatgagaaaggaaaaatagtgctatgttgattcagaaaaagtagatttattctagctaggagaacatttagaaaactaaattcaaaataaaaaagcaccaatcaagaggattatttggtgtcactctttttccagaaggaaaagtggattatttaagaactttccatcttggatcttttcaaccttctcttcctaatatcaatctcttcattcctagtggctaatcctaggtctcattatctttcctccccctagtatttcaaaaacttgtagtgaaaagatttcagttgcttttcaattagtaatctaattgaaggctaggtatgatgaaccagatttataagtgacactaagagtagcttttcaaatcatattattagataaaaaagcaacttgtagagtactgcctgcaataagataccatttatgtaaagcaaacacatttatatattttaagtgtctatgaaacactcgtaataatgacagtggcatcttttaggaaaaggcagtatgctgatgaaagagaccaaggttagtgttgtagaacaaggtatttaaaattgattgtagtattttactatttcattaattataatggattaaaatgctttttatgtaactaataatgtatatgtaacgagagctacagagaggtggcatcatcaacatgacagaataggaaacatcaataaatggccactccactgaaaaaaaacattcagctggcaacaacggacaaaataatcttttttataactctggaatctaaacagatacagcaaacaggggagtgcttaatgaagaaagaagtagctaaattttggtaagaaagtgtggtaattttgtttatttacctacctaccactctctatgccctagctcagcaagctgcagttcttgtgtggcttcctggtgccacgggataatatggatctttttcttaaaatactgtggatgtgcattttgacttttctggagattccttgaatctgatcttagtttcacacaccacctcaggctagagtgctcgctggtaaatgtctgatgaaagcatttaaagacatatgctacttatagatgacttggacagttgatgcaagaaaaagcaagcattagacagactgaaaactgtgaagaaaaaggctaagaagaaagattcttggggaaatgaggtttagaaaggctaccatatatactagggaatgtggagtgcaattcatatacctagggacagatatatgctcagaaaagacatgagaggaatctaaactcagatttttggttgatctttaaggtctgaactaacaggaggtggagattaacgcagggttgcatgttgactggcttagcattgatggtgtacccagataaaagtcaatttgaaaagactgagagagctttttctctctgttagccccaggctctcacacgtatctctgacagatcactggctgaccagtgagatatataaaaagagacttcagtgaccacacctaaaaaataatataaattttgcaaacctacttagtaaaagctactaaacaactggatggtcacagccgtcaacaatcaatggcaataaaccctggggagggggcataatctgatttctagaggtactacattctaatatttaatatatgcagcttataaacaaaaataaaaggcatacaagtatggtatgtaaagtatagaaagtatgattaattcaccggggaagaaacccaaacctgacagaaataatccatgaagaagactataaattaaatatactaaactaacttttttttattattacactttaagttctgggatacatgtgcagaatgtgctggtttgttacataggtatacatgtgcaatggtggtttgcggcacccatcaacccgtaatctacattaggtatttctcctaatgctatctttcctctagcctcccactccctgagaggccctggtgtgtaatgttcccctccctgtgtccatgtgttctcattgttcaactcccacttatgagtgagaacatgcagtatttggttttctgttcgtgtgttagtttgctgagaatgatggtttctagtgtcatccatctccctgcaaaggacatgaactcatccttttttatggctacatagtattccatggtgtatatgtgccacattttctttatccagtctatcattgatgagcatttgggttggtccaagtctttgctatggtgaacagtgctgcaataaccatacgtgtgcatgtgtctttatagtagagtgattcataatccttctggtatatacccagtaatgggattgctgggtcaaatggtatttctggttctagatccttgaggaatcgccacactgtcttccacaatggttgaactaatttatgcttctaccaacagtttagtagcattcctattactccacatcctcgccagcatctgttgtctcctgactttttaatgatcgccattctaactggcatgagatggtatctcattgtggttttgatttgcatttgtctagtgaccagtgatgatgagctttttttcatatgtttgttggctacataaatgtcttcttttgagaagtgtctgttcatatccttcacccaatttttgatggggttgtttatttcttgtaaatttgtttacattctgtgtagattctggatattagcccttagtcagatggataaattgcaaaaattttctcccattttgtaggttgcctgttcactctgataatagtttcttttgctgtgcagaagctctttagtttagttagatctcatttgtcaattttggcttttattgccattgcatttcgtgtttaagttatgaagcctttgctcatgactatctcctgaatggtattgcctaggttttcttctagggtttttatggttttgggtcttacgtttaagtctttaacccatcttgagttaatttttgtatatggtgtaaggaagggatccagttttagttttctgcatatggctagccagctttcccaacaccatttattaagtagggaatcctttccccattgcttgtttttgtcaggtttttcaaaaatcagattgttgtagatgtgtggtgttatttcagaggcctttgttctgttccattggtttatatatctgttttggaaccagtaccatgctgttttggttactgtagccttgtagtatagtttgaagacaggtagtgtgatgcctccagctttgttctttttgctttggattgtcttggctatatggattcttttttgtttccatatgaaatttaaagtagttttttctagttctgtgaagaaagtcaatggtagcttgatgggaatagcattgaatctataaattactttgggcagtatggccattttcacaatattgattcttcctatccatgagcatataatatttttccatttgtttgtgtcttctcctatttccttgagcagtggtttgtagttctccttgaagaggtcattcacgtcccttgtaagttgtattcctaggtattttattctcttggtagcatttgtgaatatgagttcactcgtcatttggctctctgtttgtctactattggtttaaagaaatgcttgtaatttttgcacattaattttgtatcctgagactttgctgaagttgcttatcagcttaaagagttttggggctgagatgatgaggttctctaaataaaccatcatgtcatctgcaaagagagacaatttggctttctctcttcttatttgaatactcttcatttctttctcttgcctgattgcccgggccagaatttccaatactatgttgaatagaagtggtgagagaggatatccttttcttgtgctggttttcaaagggaatgcttccagcttttgcccattcagtatgatactggctataggtttgtcataaatagctcttatttttttgagatacgttccaccaatacctagtgtattgagagtttttcacatgaaggggtgttgaattttattgaaggccttttctgcatctgttgagatgattatgtggtttttgtcattgtttctgtttatgtgatgcattaaatttattaatttgtgtatgttgaagtagccttgcatcccaggtataaagtcgacctgattgtcatggataagctttgtgatgtgctgctagattcagtttgccagtgtttaattaaggttttttggcattgatgttcatcagggatattggcctgaaattttgttttttttgttgtgcccctgccaggatttgatataagaatgaagctgggctcataaaatgagttagggaggagtacctctttttatattgtttggaatagtttcagaagcaatggtaccggctcctctttgtacctctggtggaattcagctgtgaatccatctggtcctgggctttatttgtttggtaggctactacgtactgcatcaatttcagaactttttattagtctattcagggattcgacttcttcctggtttggatttgggagggtttatgtgtccaggaagttatccatttcttctagattttatagtttatttgcgtagaggtgtttatagtattctctgatgatagtttgtatttctgtgagatcagtggtgatatccccttcatcattttctgttgtgtctatttgattcttgtctcttttcttctttattagtctggctagtggtctattttactaatcttttaaaaaaaaaaacatctcctggatttgttaatttttgaagggtttttcgtgtctctctctccttcagttctgcttttatcttcatcatttcttgtcttctgctagcttttgaatttgtttgctcttgcttctctagttcttttaattgtcatgttagagtgttgattttagatcatttcccctttctcctgtgggcatttaatgctgtaaatttccctctacacactgctttagctgtgtcccagagattctggtacattgtgtctttgttctcattggtttcaaagagcttatttatttctgccttaatttcgttatttacccagtagtcattcaggagcaggttgttcattttccatgtagttttgcggttttgagtgagtttcttaatcctgagttctagtttgattgcactgtggtctgagagacagtttgttatttttttcaaaaatccagctggattcattcatttttggaagggttttttgtgcctctatattctttagttctgctctgatcttagttatttcttgtcttctgctagctttttaatttgtttgctcttgcttctctagttcttttaattgggacgttaaggtgtgaatttgagatagttcccactttctgatgtgagcatttagtgctatgaattttcctcttaacactgctttagctgtttcccagagattctggaatgttgtgtctttgttctcattgatttcaaataacttatttatttctgccttaattttgttatttacccagtagtcattcaggagcaggttgttcggtttccatgtaattgtgtggttttgagtgagttttttaatcctgagttctaatttgatcgcactgtggtctgagagactgcttgttttgatttctattcttttgcatttgctgaggagtgttttactcacaattatgtggtagattttagaataagtgctatgtggcactaagagtgtatattctgttgatttggggtggagagttctgtagaagtctattagttccacttgttccagagctgagttcaagtcctaaatatccttgttaattttctgtctcattgatctgtctaatattgacagatgggtgttaaagtctcccagtattattgtgtgagaggctgtctctttaaattcacctccccttgaggtcccaagataacttggggatcctggacctgtcagaaagtgaaactctttactcacaataggtcaggaatcctgtatggaaactctgtagacaaggtatgagggcagttttcccaaggggcttttattggctctttaagtcaagtgtgtttccttaaagaaaagcacaccattacagtcaaagagttggtaaaaataaccagttcctccaatggcttcctgttgcaaatgcaaacattcttactgctcttttgcaaataactatattgccataagttaagaatactcacaaatagtttgcaaattctggataagtcaggtagagagaaacaaatatgctccaaatctcgtgcacaggagtataatttactcaattgccacaagctgtaaatagctcaatggaaaagttgttttgactctgaaaaacaaaacaaaggatcagcaaaaaagtcaaaaagggttacttcagtcttctgttagtccagatcatgtaggtaacttctgttctgcttgatattcatgaacattacagcttgctatgcgagtcctgatagttttttcctctattttagtgttacaatcttcaaaattatcagagccctgcattcaagaacacctgctagatttttctagcttattataaaaccactttctaaagaggaccaaaacaagacagcaattgtatgtggttgacaaaatgttttaaggcagtcacagtcaaagtcacaattgacaaggaaatttgttatctctttggcacatagtaatttaatataacaattataagtattacttataacctacactaagtcatatcaggaattttccataattttgaaacatataccaataacatatttatacagatacagcccaaagaaagccaaatacaatttcatgtttgacaatgcttcctgtatgatttttgtaccaaatacaccaaatttgtcatttttggactttagggaacttaatatttaaaagattaattaggtcagaaaaggacataactgataatttgattttggaaaatttgtcaaatatcaaaggtttaaaatgcttgatatcacaaaatagaatcacaggtgattgtaaaataagtcatttatttaaccaaagtaataactcagaaatttcaaaacaaaagttgaaaacctttattctttgagaaaggagacttaatttttcaaacagcaattcctaatacaaacagcatgtgttcaactaaatttgcttttcacaattttataaacaatctataaatttttaatcatcttgaccataagatattacatcttataatataagccttttataagcctttccataagtcttttataacctttaaaacctctattaaagagtggtttaatgcctcaagaaaaccttgttagtgtgacacaggcgcccatatgctggtcttgcatcagtgtgtctttgacattaatgattaatttatagagaaatcaaacttattttgtctcttgaaatccacccttaaaatctcatgcacctacttcttctgcaatagtccctgagccttgaggagttgaatacctttaatttttggccccttgtctcacaaatgtaatttcttttgattggcatcttctactgggtctgaagatgaggctttaactactatcagtgtcaagatttatcaggagtttgtgtccttttttaattgtacaacgactttaaaagcacacacagaaagttaaacagttaactcaaaaaagaagttttaatctcagttttttctaaggaaactaaagttagtaatgatggtataggaattatttcgataaagcataatatctgtttattaggccagttacacaaaggcaaaagaaagggccttctgccatatgactgctgttccttatgggggatattatgttgggagggtacataagatacatttgcttcagacctctaagagaaaactttttttttttaagtgtgaggccacaacagttaaaacccagaggaaaaaaaaaacttgtagtatctgaaaatgagttgaataataaagttattatttcaggcctttcaagggggagagaaagctgaaaacagcaagatgtaataaaagttaaactttgtgtaaaaaattataatgtcttgtaatttattaagaatcaagcaataccttaagaaaattttatagtttgaaccaattgtttaaagtgtttttttaaataaaaacccaatctctagaaagaccatgataattttctttaattatagacaacttagtcctattaaagttgtttccataaatcctctcattatgacttacacagaccatttagagcatgcttagactttctggtttctcctgaacatacctttttttctttaaactttcctactaaaaatacctctttatttctacaactttctttacatttcttttatttcctggttccttttaccttgttttatacataacctttacctaagcttagaattagacaaatattattcaccttttgaaaaggacacatattttttagaatgtttttctacagtatttttattggaaaatactaaattaatgaaatgttcattatttgatttaatgtaactttagattctaaattatgacttgtttgtctacaagtacttatcccattacatttacctaattattttattttagtggtttatcaagattatttatgaaaactgagacagtcatcatttaaagttataaaactgccgttgaaaaattataattgagacagtgaaaaagatctcacctaacccactccatcttgcttctaacctccaaggtgtttttgttcattcctgggtgtaggtctaactaactttagaaggaagttagtttatagtttagctttgaaacaaagataataacagtcatttgccaaaacaaacccccttcctgcctggggactagacttcctaaagtcacatgattacaagtaacagttattttacaacataatgcaagattctgacaccttatagtacttggtagggataactatgaagctgcttgatcagtaactgcaaagaaaaatgtttgctggaaattcttaagacacttctaatattttatcaataattttaaagctagcttaataaaaaatttacttaagtcatgtgcacttaaaaagcatttgggtttattaatttatgagtactccttaagacatcttgtggccaaaatgcaacaaaatacatatacatacacacaaacacacatatacacactcatacaaccaaagatcctatagcttatagcttttacttcagaactctagccatgagatactaatacgaactcattggtttgcaaaaacaataacaaaaagaaatggttggatgcaaacagtggattttatcttagtagaaaagtaacatcagctttaaagcatggagaaaagaaaatagaaaaaaaaagaggacttaggaactttatagtttgttgttcgaccttaggatttttgtttaacacaaactctaacaagttgcactgccagaaaaccaacagagtgccagaaagggggtcattatccttgttttcttctcattcttagattatttcccactttttctgttttttgtttgtttgtttgtttttattattattattatactttaagttttagggtacatgtgcacaatgtgcaggttagttacatatgtatacatgtgccatgctggtgtgctgcacccgttaactcatcatttagcattaggtatatctcctaatgctatccctccctgtttttgttttttcttaaaaggagaaactgacctgtggcttaaggtttttgtggagtgggtcaaagtgtgtgctggttgtgaccaggactccacagtgtgttaccaatgagtcattgctgccctcttatgtgtctcagtttctctctctggaggtctagcacctccagtagggcacagattgtagattgacgagctcccatatgtgcttcctggatgagcctttttaaaactaattttcctgggggttccctgtaggacgactgcatgtcattgggggtcaacccactagacactcccatgaggcccctggtcacccatgggtgccttttagctgggaagagcaaaatgctttttctttttggagctgtggaaactcggtctctcatttacctattaaaacaacagtacagttcctcacacaaatgtgcacaggcaaacgaaattgagactctttggggagaaaaatcagtgggggaaacccttgagaatgcatccttgaactagaagtaagattcttaaacaacttcctaggagagagagagaggaaaaaaaaaagcaacaaccaagactacttcctgtaaactgtcctcagccactgctaactttgtagctctcatcctccattacacacaccaaagtcaagtcctctcacagtacaaggtaatttctggtactcccaaagacaaagaggtcaggtaatgccatacaggaaagcagagctttagacctaaagagaatctgcccatgatacttgaaaatccacaaagaaaacagaacaccggaacggggtgagtggtgcctttgttctgagttatttaaggggtttgagttattagaagacttatctctagatttttcttggtactgaagatggcaaagggggaaggaggttgatatggtttgtctatgtccttacccaaatctcatcttgaattgtagtttccacaatccccatgtgttgtgagagggaccttgtgggagaaaacctcttggtgttccccatgctgttctcatgaaaatgagtgatttttcatgagatctgatggttttataagtgtctggcatttcccctgctggcacacattttctctcctgccaccctgtgaagaggtgccttctgccatgattataagtttactgaggcctccccagccatgcggaaccatgagtcaattaaacctctttcctttatacattacccagtccagggtatttcttcatagcagtgtgagaatagactaatgcagtaaattggtattgaggttgtggggtgctgctgtggagataacaaaaaatgtgaaaacaactttggaactgggtaacagacataggttggaacagtttggagggctcagaagaagatagaaagatgtgggaaagtttgtaacttcttacagacttgttgaacggttttgaccaaaatgctgatagtgatattaacaataaattccaggctgaggtggtctccaaaagagataaggaacttcttgggaactggagcaaaagtgacttactatgatttaaccaaaagacttctggcattttgccactgctttagagatctgtggaccttagaacttgggagagatgatttagggtatgtggtggaagaaatttctaaagggcaaagcattcagaggaagcagagcataaaagttttgaaaatttgaagcctgacaatgcaatagaaaagaaaagcccattttcaggtgaggagttcaagcctgctgcagaaattttcataagtaacaagaagccaaatgttaatcaccaagacaatgggaaaaatatctccagggcatgtcagagaccttcacagcttctcccatcacaggcccagagacctaggagggaaaaattgtttcctgggctgtgtccagggccctcctgctctgtgcagccttgggagatggtggccagctgcttcagctccagcagtggctaaaaaaggctaagatacagcttgggacattgcttcagaggatgcaagtcccaggccttcgtgttttccatgtggtgttgagcatgtgggtacacacaggtcaggaattgaggtttgagaacctctgcctacatttcagaggatgtatgaaaatgcctggatgtccaggaagaaggttggtgcagggatggagcccgtatggagaacctctgctagggcagtgtaaaagggaaatttggggttggagcccccacacggagtccccactgaggcactccctagtggagctgtgaaaagagggccactgtcttccagactccagaaaggtagatcaacccacagattgcaccaagtgcctggaaaaccacagacacttaatgccagcctgtgaaagcagccaggaagggggctttaccctgaaaagccacaggggtagagctgctcaaggccatgggagcccacctcttgcatcagcgtgacctggatgtgagacatggagtcaaaggagatcattttggaactttaaggtttagtgactacctattggatttcatacttgcatggggcctatagcccctttgttttggtcagtttctcccatttgaaatgagtatatttacccaatacctgtaaccccattgtatgtaggaagtaactaacttgcttttgattttataggctcataggtaaaagggacttgccttgtctcagatgagactttggacttggatttttgtgttaatgttggaataagttaaaactttgagggactgttagtaaggcatgattctgctttgaaatgtaaagacatgagatttgagcggggccagggatggaatgatatggtctggctgtgtccccacccagatctcattttgaattgtagttcccataatttccatgtgtcatgggagggactcagtgggaggtaattgaatcatgggggcagtttccttcatgttgttctcataatagtgactgagttctcacaagatctgagggttttataagcatctggcatttcttatgctggcactcattctctctcctgccacctttgtgaagaggtgccttctgccatgactataagttttctgaggcctccccagccatgtggaactgtgagtcaataaaaactcttttctttataaattacccagtttcaggtatttcttcacagcagtgtgagaacagactaatacagaggtatagggtggaagaaaaattaaccaaagaacatattttttaagatgggaaggaaacacagaaaccaagcacatgctttttgttgttgttgttgttgttgttgttgtttgttgctgtagtttttcccacttttgcagctgcaaggaattttagccaattcagagaggccttgttcaagttgtcctgcctttctggacaaaatcaatttacatcttaggtatatcgattgatgtctcatgtctcacaacttggttgggaccgagctgtgtcctgacccccttgcacacatgtcatcaggacctcctgaggctgtgtcatgggtgaatatccttaactttggcaaggtaaacttcctaaattgactgagaccagtctcagatatttgtggttcacttttggtaaccatggagggaataatttgaaattctcattctgatttgaccaagtcattcagatttggtcaaatctgacagagaaagactggaacaaacaacaacagacccaaaaatatgattactgggcactctaatggtaaggagaaattaagaccaaatgattgttaatcatagctttagccaagacgaaaccttattgtagctacttatgtggggatgggtctcaggctgaagagtgttctctaccattctagaagcaggaaaaaactcaaattcaccttctctgttggaagcaagttcaaattccaggaaggagttccctgccttctattgtcatggaagcagaaaaacttgcttttcttactggaagcaggtaaaactccaaaaaaaaggagttatacagcaaaataaactttagatctttgccaaatttggggagatcaggtattctctggagggggtgtgtccaggcctcagcatattgtcctattggttggatccataaagatagctcaagctggtatcaagcactgataggatattagccaaagttcaggggcacctccactcagaatccctccatggttaccaaatgtgaaccccaaatatccgagacaggtctcagtcaatttagaaagtttattttgccaaagttaaaaatgtgcacccatgacacagcctcaggaggtcctgatgatatgtgcccaaggtggttgggacacagcttggttttatacattttagggatatatgagacatcaatcaatatatgtaagatgtaaattgatttgtttcagaaaggcaagacaacttgaagttggggcaggggtttcaggtcatagatagataagagacagatggttgtattcttttaagtttctgattagcctttccaaaggaggcagtcagatatgcatttatctcagtgagcagagggatgactttgaatagaataggaggcatgattgcactaaatacttcccagattgacctttttaattttagcttagtgatttttgggtcccaaaatatattttcctttcacttgactaatcaggatttatctcaggcaggaagagaaaaggaaatggagaacattttaattaagcactgtacaaatcttaataaaatcagtgcatgtaatacactgcattaataaaatgtaggaagaaacacatgacatctcagttgacacctaaagagtatctgacaaaatccaacatgctttcatgtcaaaaacactcattaaactagtaaaaagaaaaaaaaaactggctcaacgtgacaaaagacatttatgaaaaacccagagctgacagtatactcaaaggttaaagaatgaatgctttcttcccaaaactaaaagaaagacaagaatatccatttttactacttctattcaacatagtactgtaaaatttagctagagctaattaggcaaggaaaggaaataaaatttatccaaataggataagatgaagtataactatctatattcagaggcggcgtgttttcatgtattaaataaaaacaaaaaaaaaatccaccaaaaatctactggccctagtaaacacattctgcaaagttacagggtacaaaatcaacacacgaaaaacatttgtgtttctatatactaaacattccaaatgaaaattaagaaaattctattacaatagcatgaagcagaaaaaaatagctagcaataaatttaatcaagatgttcaaagactcatttattaaaaatttcaaaacattgctaaagaaaattaatgaattgtaaataaacagaaaatattacgtatcataaaatgacaaacgtggtattgtcaaggtgtgaatactaccataaatgatctacaaattcaatgcaatctgtatcaaaatcttaatgaccattttagcagaaatgaaaaagctgattctcaaattcatatggaatttcaagagccccaaatagtcaaatcaatcctgcaaagaacaaagttggagaatttatacttcgttattccaaaacttactgtaaagttacaataatcaagtgttgtgcagttataaggatacacatatagtacaatgcgatagaactgaatcgccagaagtaaacccataaatctatggtcaattgactttcatcaagggtaccaagaccattcagtgaggaaagaattttttcttcaacagatgacactgagaaaattttatatctacataaaaacataaatttggatgcctatatcatacaatatacacaaaatacctcaaaacaaattgataacataaatattacagctatgattttataaaactcttagaagaaaccatagggataaatatttacgattttgaattttgcattggactcagatataacaccaaaagtatgaaaaacaatgaaaaatagataaatttgaacccatcaaaattaaatacatttgtgcatcaaaagatgttatcaagaaagtaaaaacacaatatagacaatgaaaaggaatatttccaaattttatatctgataatgttccagtatccagaatatataaagaatttttgtaattcagcaacaaaaaccaaacaacccaattaaaaaattagaaaagcattcgaatggaaatttttccaaaaacgatagataaatgggcaataagcacatggaaagaagtgtaacatcactagacattagaggatataaagccaaaccacaattagtcacttcacatctataagaatggctataataataataatactttttacatttttaatttatatggatacataatagttttacatatttgtggggcacatgtgatgttttgatacaaacacataatgtctaatgatcaaatcagggtgattgggatattctttacctcaaaaatatatcttttttttgtgctaggaacattccaattccactcctctagttattttgaaatatacaacaaattattgttaactacagtcaccctattgtccaaatagtggatcctatttaacctatctaactgtatttttttactcatcaatcattccccactttttccccccatctcctcgtgacccttcacaaactctagcaactatcattctactctctatctccacgagttcaatttttcttcagctcctatctatgagtgagaaaatgtgatatttttctttctgtgcctggcttatttcacttatgtcctgtagttcaatctgtgttgttgcaaatgtcatgattgtattatttttatggctgaatatttcatggggtagcacatttttttaatccattcatctgttgatacacacaggtagattctataacttggctattgtgaatagtgctgtaaaaaacatgggagtgtatatatctattcaatatgcttatttcctttctttacatatatactcttagtgtctgtattaccatctacagtgtaaaagggctcccttttctccatatcctcaccagcatttgttgtttctgttttctttttgagaaaagccattttaactggggtgacatgatatttcattgtacatttctgtgataatttgtgattttcaacatttttaagacacctgttagcgacttgtatatcaccttttgataaatgtttattcatatattttgttcatttgataccaggattatttggtttctgctatgttttgattttgtttttgtttttttgtttttgtttttgttttgatattgagttgagtttctcgtatattctggtcattattcctttgtaagttgaacagtcagcaagtattttttcttattctgtagattatctcttcatttattaattatttccgtggctatgcaaaagcttattagcttgatgtgatcccatttgtccattttaagtttggttgcctatgcttttgcagtcttactcaagcaatatttgcccagaccaatgtccccatgtatttgccctatgtattgtctcactagtttcatagtttcatgtcttacagttaagtacttaatcaagtatttctttgatttttgcatgtggtgagagataggcatctagtttcattctttggcaaatatatatccaggttcctataacaatttattgaaaagtctattccttcccaaatatatgcttttggcatctttgtcaagaatgagttgattctaaatgtgtgaatttatttatgtattctatattttcttctgctggattatatgtctgtttctaatggcagtaacacgatgttttagttactatagttttgtactacaatttggtttttattttttttccataggttttttaggaacaggtgctatttggttacatgagtaagttctttagtggtgatttgtgagattttggtgcacccatcacccgaacagtatactctgaacccaatttgtagtcttttatccctcaccctccgcccaccctttccctcaagtccccgaagtccgttgtatcattcttttgacatttcatcctcatagcttagctcccacatatgagtgagaacatacgatgtttcgttttccattcctgagttacttcacttagaataatagtttccagtttcatccaggttgctgtgaatgccattaattcattaatgtttatggctgagtagtacttgattttatatatatatatatatatatatatatatatatatatatatatgccataatttctttatctactcattgatggatgggcatttgggctggttccatatttttgcagttgcgaattgtgctgctataaacatgggtgtgcaagtatcttttttgtgtaatgacttattttcctttgggtagatacccagtagtgggattgctggatcaaatggtagttatatgtttagttctttaaggaatctccacactgctttccatcgtggttgtactagtttacattcccaacagcagcacagtgtagaagtgttcccttttcaccacatccatccacgtcagcatctattattttttaattttttgattatggccattcttgcaggagtaaggtggtattgcattgtggttctgatttgcatttacctgatcattagtgatgtcgagcattttttcatatgtttgttggccatttgtatgtcttcttttgagaattgtctattcatatccttagcccactttttgatgggattgcttgttcttttcttgctaatttgtttgagttcctgtagattctggatattagtctcttgtcggatgtagagattgtgaagctattctctcactctgtgggttctccgtttactctgctgactgtttctttttctgtgcagtatctctttagtttaataaagtcccacctatttatctttgttattgtttcatttccttttgggttcttggttatgaaatcattggctaagccaatgtctagaagggttttatcaatgttatattctagaattttcagagtttctgatcttagatttcagtctttgatccaccttgatttttgtgtaaggtgagagatgaacatccagttttattctcctacatgtggcttgccaattatcccagcatcatttgttgaatagggtgtccttttcccacttcatgtttttgtttgctttgtcaaagatcagtcagctgtaaggatttgggtttatttctgggttctctattctgttccattggtctgtgtgcctatttttataccagtaccatgccgctttggtgactatggccttctggtatagtttgaagccagataatgtgatgcctccacatttgtttttttttttttttgcttgatcttgctttggctttctgtgctcttttttgtttccatatgaattttacgattgttttttctagttctgtgaagaacgatgatggtgttttgatgggaattgcactgaatttgcttttgacagaatggtcattttcaaaatattgattctacccatccatgatcataggatgtgtttccatttgtttgtgtcatctatgatttccttcagcagtgttttgtagttttccttgtagagctctttcacctctctggttaggtacattcctaagtattttatttatttattttttgcagctatcgtaaaagaggtagaattcttgatttgattctcagcttgatcactgctggtgtatagcagaactactgatttgtgtaaattatttttttgtatccagtagctttgctgaatttatttatcagttctgggagctttttggaggagtttttagtgttttctaggcacacgatcatatcatcagcaaacagtgacagtttgacttcctcttcactgattgggatgccctttctttctttctcttgtctgacttctgtggttagaacttcaagtactatgttgaagaggagtagtgagagtgggcatccttgtcttgttccagttctcagagagaatgctgtcaactttttcccattcagtattatgttggctttgggtttgccatagatcgcttttattacattgaggtatgtcccttgcatgctgattttgctgagtgttttaatcatacagagatgctggactttgtcaaatgctttttctgcatctattgagatgatcatgtgattttttgtttttaattctgtttatgtgatgtatcacattattgacttgtatatgttaaaacatccctgcatttctgatatgaggagtcttcaaaaccatgcgaatacatggaaattaaataacctgctcctgtacgatctttgggtcaacaatgaaatcaagatggatattaaaaaattatttgaactgaatgataatagtgacaaaacctatcaaaacctctgggatacagcaaaggcggtgctaggaggaaagtttatagccttaaatgtctacatcaagaaatttgaaagagcacaaatagacaatctaaggtcctcaaggaactagagaaacaataacaaacagaatccaaacccagcagaggaaaagaaatacccaagctcagattagaactaaaatggaaaaaaaaagtataaaagataaatgaaacaaaagattatttgaaaagataaataaaattgatataccatttgcaagatttaccaaaaaaaaagaaagaagatccaaaatactcaattagaaacaaaatggcggactgtcagaaacaactgacactgcagaaatgcagatgatcattcaaggattctgtgaatatctttacgtgtataaaccagaaaacctggaggagatgaataaaatcccagaaatatgcaaccctcccagattaagtcaggaagaattagaaaccctgaaaggaccaataacatgcagcaagattgaaatggtaataaaaatttgccaacaaaagaaaagtccaggaccagagagattcacagctgaattctatcagacattcaaagaagaaatggtaccaatcctattgacactattccacaagaaagagaaagaggaaatcctctctaaatcattctatgaatccggtatcaccctaataccaaaactaggaacggacataacaaaaacagaaaactacaggccaatattcctggtgaacacagatgcaaaatttcttaacaaaataccaactaaccgaatctaacagcatatcaaaacgataatcctcatgattgagtggatttcataccatgcaagcaaagatggttagacatacgcccgttgataaatgtgatacaccccataaacagaattaaaaacaaatatcacctgatcatccaaatagatgcagaaaaagcttttgacaaagtccagtatctcttcgtgattaaaacagcaaaatcggcatataagggacataccttaatataataaaagccatctatgacagacccacagccaacataatactgagtagaaaaacgttgaaagcattccctttgataactgcaacaagacagtgatgtccactcttaccacttttattcaacatattactgtaagtcctagccagagctatcagacaacagtaagaaatttagtataatttgaagtcagttagtgtgatgtgtccaggtttgttctatttgattaggattcctttgactactctaggtcttttgtggttatacatcaattttgaggttattttttctatttctgtcatgaatgtcattggtattttgataggggttgcaaggaatgtgtaaattgctttcgtaacatggacattttaacaattttgatttttctaatccagaaaattacaggtatttatgagaattagagaaatgttagtctttgtataagatgatgggaatgtaaaatgttttacatgctgtgaagcaattttgtgtgtgatatggctgtatccccacaaaaatcccatctttattgccgctcccgtaattcccacgtgttgtagaagggatgtggtgggaggtaattgaatcatgggggcaggtttttctcatgttcttcccatgatagtgaataagtttcacgagatttgatggttttataaagggcagttcccctgcacatgctcccttgcctgccaccacgcaagtcatacctttttccctcctttgccttccgccatgattatgaggcctcccaaaccatgtggaactgttagtccattaaacctcttttttctttataaattacccagtcttaggtatttcttcatggcagtatgaaaatggactaatacaatgtgctttatggtgattcttcaaaaagttaaacatagaattatcatatgacccaacagttctccttttgaatgtatatctctaagaattgaaaacaaatactgaaagaaattcttatacgtaaatgttcaataaaactctgcacaagagcaaagaggtgaaaacaatccatccatcaatgggtgaatggataaacaacttgtagcatatttatgcaatgaaatattttgtcataaaaaggaatgaattactggcacataccacaacatggatgaaactcaaaaacattatgctatttgaaagaatccagacacaaataagcacacgttttatgatttgatttatataaattatccagaataggtaaaaccataacagaagacagattgatagttgccaggggttgggggcagaggataataagtaataactgttcaatgaatatgacattttctttggaagattagttaaccatctaatagcgttgtgagtgtactatatgccattgaattttttatttcattatatttactgttgcagcaagcaaaaattgttcactttaaaataattaatttaatgtcgtgaatttcttcttaataaaaatgacacatatgttcataaatggccatttatgatgaactatctctgggaaaagtgacggtaagcagcatttgcctttcagtatcaaacaaggaggaaggaatcataaggacaatgtttctgcttgaactatttaccatgtgcatgtattatctttatagtaaaacattaaatcgattgttaaaaataaatgacaatgagaggtattctaaagttgtagtagcaaagtttgctggtaaacttcgtctttggataaaggaaagaggagtaagaggaagcaaaagaccatttatagtggtagtagaaaataggagaatggaatatattaaacagacttttaaaaaagcttaggaaatgagactgggatgggaaaacaaattggccactgtgaagtataggagctataaggaagttaggaaggtcacatcactgtacatcctttacaggtccatagcccagtaatgctaaataaataaataaacaataatagtgcgtctctcacacagcaaattgaatatacatgattaattttagcaaacatttttcagcaactactagaaacaaggcattatggaccactaaataaagcaatcacagtttcccaagagtatagggcatcaagtgttgcagggtgagccaatactaaaaaagagtgtggatgctaaatttttaccatcaaaagcttattcatggtgcgtcatggaaatgtatctcttaagggaacttcagtaggactggatcattctgtaaggcaaataatcttgtataatgggtcccctgccttatggacataataagagtgtaaagcttctcttcagagagagttcactaattctccatgattagaaactgtttcttaactatgtacctatttgtactgtgcaatatcagcagaagcttctcttattccccaaaataagcatcttgcagctataagcttgaaaaactgtgcagtgcacacacagagtaatcataaattcttcaacctcactctttggtgcaaaaagactgtgttagactagaacaaactaagtgaccttaaatttaaaaaatagaaacccaacaacagagattgtaaaagagcaaaatattttagaatcaaatgaagaaaaaacaaaaatcaattggattctttcaaaagaattcattttcagcttggataacatccatctaaagattttttcccctagaaattaatgctataaaagtcttaggctgtgataactctaattcagagctgttttgtgtctgctaaatggaatgtgacggggatctaaaacagtgctatgttatagaaaataattagttgagaacaaacttgataatttcaccacagagaagaatggactgaaaacaactttcactttaattatgtgtaaagaaaaagcataattacctgcatagatagtaatcaggaaaaatgaaaatacatttctctgttatctggtagatagcaaggtagctttttaaatctgttcacctcttgtataataaagataacaaactggttattgtaatgccatcaaaatctcaccccagagtaaaactaggaaaaaaaaatacaaactatgtttctaatgtaataatattcttatttttcctgttggtatttatccttaccaggaacatttgaggaatatacttataagaattcttcccaggatattaagataatgacatcaaagcaaagtggtaatttactggaggcttcaattaaggcacaaaaaacatttgaaccattagaataatactatgttttttcatcctcatttaaattcattagcttttgcctttttaatgctcaaggaacaggactcctctgaattgtagatatcagtatccgccatggacatttggaatgcatctacacactcaacagcaatatagcattcacaaaaatttgggtcggtccaatcagcttcagtgtgcatacataaaggcagaattggcagacatccttggctctcagcagctgatatcacaggctggccagttgagatgcaagttagagccaagtttttgagccacagatacttcaggctgaataattctacattgctgtgtgaagcaacttgaaatttggatatagcaatctaaatttcaccacctatctaaagcgctagggaaagtggccactttcagtaatttcacatttcatctgtaagccttttctgtaactcagggaagccaagagcatggtggcctagttgggcagtaaagatgccaagtaagaagtttcttcacttcctgccacaacaccacctttggagtgtgattacatcatgttgttttcatttaatttcttttacctatgtctctaattgctccagattatgagagttgacaagtccatagtttgataagaactagtttgagatgataaaccacgttattatttcattctttatagttccttgtggtctgccttgtatgacagctactgtagaaaataaaactgtgccacataataaaaattactaagacttaaagttgcatgcagaaatggagtgaaacttaagaatccataagatttaagtagcaattagatgaattgacacttggcttaatctacttcccaattaggaccaaaaccattgtcgagggaaaaaaaaatagaaaaaggagagtgctttccactccggatacaatctaacatctaagacatgttaaagaaagtgtgcaaagagaaaagaagaaatggaggttattagaacaatgaatagtataaaggaacaaaaggaagcggagggttatgaaggtggctagaatccaaaaaaaccacagtggataatattatctaacttatgtgttacaccaacctacaatctcaaaagacctgatagaggagtttaatgctttaatcatggaaatgtggaatttcttaatgactccttagagaaacagaagtatttattgagacacaagacaaatttaaaacaaaaaaaaatgtgaaatgaaactcagggatctaaaagtatgcatcacttttccctccgggaggtagaaaaaaaaactccagaaatatgaataaagaatgaaatcacagaggtttcaggaaatgagaaacttgtcaaagtaaccaatgaatattcagaaaggccattcttagtcatatacaatggtagagattcaggccagaagcaaagaagatcagagatgaagctgtcagaggtgaaacagctctctacatatgctctaaatattatatatattccaattgatcattgtgcattatcatcttgatatgctgttggattcggctagttggtattttgttaggaaattttgcatctctgttcaccaggaatattggcctgtggttttctgtttttgttatgtccattcctagttttggtattagggtgataccggattcatagaatgatttagagaggatttcctctttctctttcttgtggaatagtgtcaataggattggtaccatttcttctttgaatgtctgatagaattcagctgtgaatctctctggtcctggacttttcttttgttggcaaatttttattaccatttcaatcttgctgcatgttattggtcctttcagggtttctaattcttcctgacttaatctgggagggttgcatatttccgggattttattcatctcctcgaggttttctaatttatacacgtaatgatattcatagaatccttgaatgatcatttgtatttctgcagtgtcagttgtaatatccgccattttgtttctaattgagcgtatttggatcttctttcttcttcttttagttaatcttgtaaatggtctatcaattttatttatcttttcaaagaatcagcattttgtttcatttatcttttatacttttttttcattttatttagttctgctctgatcttgggtatttcttttcctctgctgggtttggattctgtttgttcttgttttcctagttccttgaggaccttacattgtccatttgtgctctttcaaattttttgatgtagacatttaaggctataaactttcctcctagcaccgcctttgctgtatcccagaggttttgatagattttgtcactattatcgttcagttcaagtaatttttaaatttccatcttgatttcattgttgatccaatgatcatacaggagcaggttatttaatttccatgtatttgcatggttttgaagactcctcatatcagaaatgcagggatggtttaacatacgcaagtcaataatgtgataaaccacataaacagaattaaaaataaaaatcacatgatcatctcaatagatgcagaaaaagcatttgacaaagtccagcatctctgtatgattaaaacactcagcaaaatcagcatgcaagggacatacctcaatgtaataaaagcgatctatggcaaacccaaagccaacataatactgaatgggaaaaagttgacagcattctctctgagaactggaacaagacaaggatgcccactctcactactcctcttcaacatagtacttgaagttctaaccacagaagtcagacaagagaaagaaagaaagggcatcccaatcagtgaagaggaagtcaaactgtcactgtttgctgatgatatgatcgtgtacctagaaaacactaaaaactcctccaaaaagctcccagaactgataaataaattcagcaaagctactggatacaaaaaataatttacacaaatcagtagttctgctatacaccagcagcgatcaagctgagaatcaaatcaagaattctacctcttttacgatagctgcaaaaaataaataaataaaatacttaggaatgtacctaaccaaagaggtgaaagagctctacaaggaaaactacaaaacactgctgagggaaatcatatatgacacaaacagatggaaatacatcccatgatcatggatgggtagaatcaatattttgaaaatgaccattctgtcaaaagtaatctgcaaattcagtgcaattcccatcaaaacaccgtcattcttcacagaactagaaaaaacaatcgtaaaattcatatggaaacaaaaaaagaggccagaaagccaaagcaagatcgagcaaaaaaaaacaaatgtggaggcatcacattatctggcttcaaactataccagaaggccatagtcaccaaagcggcatggtactggtataaaaataggcacacagaccaatggaacagaatagagaacccagaaataaacccaaatccttacagctgactgatctttgacaaagcaaacaaaaacatgaagtgggaaaaggacaccctattcaacaaatgatgctgggataattggcaagccacatgtaggagaataaaactggatgttcatctctcaccttacacaaaaatcaaggtggatcaaagactgaaatctaagatcagaaactctgaaaattctagaatataacattgataaaacccttctagacattggcttagccaatgatttcataaccaagaacccaaaaggtaatgccacaataacaaagataaataggtgggacttcattaaactaaagagatactgcacagaaaaagaaacagtcagcagagtaaacggagaacccagagagtgagagaatagcttcacaatctctacatccgacaagagactaatatccagaatctacaggaactcaaacaaattagcaagaaaagaacaagcaatcccatcaaaaagtgggctagggacatgaataggtaattctcaaaagaagacatacaaatggccaacaaacatatgaaaaaatgctcgacatcactaatgatcaggtaaatgcaaatcagaaccacaatgcaataccaccctactcctgcaagaatggccataatcaaaaaattaaaaaataatagatgctgacgtggatggatgtggtgaaaagggaacacttctacactgcgctgctgttgggaatgtaaactagtacaaccacgatggaaagcagtgtggagattccttaaagaactaaacataaaactaccatttgatccagcaatccctctactgggtatctacccaaaggaaaataagtcattatacaaaaaagatacttgcacacccatgtttatagcagcacaattcgcaactgcaaaaatatggaaccagcccaaatgcccatccatcgacgagtggataaagaaattatggcatatatatatatatatatatatatatatataaaatcaagtactactcagccataaacattaatgaattaatggcattcacagcaacctggatgaaactggaaactattattctaagtgaagtaactcaggaatggaaaacaaaacatcgtatgttctcactcatatgtgggagctaagctatgaggatgaaaaggcataagaatgatacaacggacttcggggacttgagggaaagggtgggcggggggtgcgggataaaagactacaaattgggttcagagtatactgttcggatgatgggtgcaccaaaatctcacaaatcaccactaaagaacttattcatgtaaccaaatatcacctgttccccaaaaacctataagaaaaaaaggtttttaaaaaagattatgtatttcccaaaattataggtagaatgagtgattggagaaagaaaattttggttatagagtattgcaagtacaggggcaataaagggactcagctcttcctactccatgagctgtattatgatccagagaaatgcaagcagttggtaatagtctcaggaaaagtaggagagcagatcaaaggtaaaggttagtacagaattctttccgtggcaggtcatatcggaacttttcttttttttgtttgttagtttgttttttattttattattattatactttaagttttagggtacatgtgcacaatgtgcaggttatgtatacatgtgccatgctggtgtgctgcaaccattaacttatcatttagcattagatatatctcctaatgctatcctttccccctccccccaccccacaacagtccccagagtgtgatgttccccttcctgggtccatgtgttttcattgttcaattcccacctatgagtgagaacaagcagtgtttggttttttgtccttgtgatagtttactgagaatgatgatttccaatttcatccatgtccccacaaaggacatgaactcatcattttttatggctgcatagtattgcatggtgtatatgtgccacattttcttaatccagtctatcattgttggacctttgggttggttccaagtctttgctatcgtgaatagtgccacaataaatatatgtgtgcatgtctctttatagcagcatgatttatagtcctttgggtatatacccagtaatgagatggctgggtcaaatggtatttccagttctagatccctgaggaatggccacactgacttccacaatggttgaactagtttccagtcccaccaacagtgtaaaagtgttcctgtttctccacatcctctccagcacctgttgtttcctgactttttaatgactgccattctaactggtatgagatggtatctcattgtggttttgatttgcatttctctgatggccagtgatggtgagcattttttcatgtgttttttggctgcataaatgtcttcttttgagaagtgtctgttcatatcctttgcccactttttgatggggttgtttttttcttgtaaatttgtttgagttcattgtagattctggatattagccctttgtcagatgagtaggttgcgaaaattttctcccattttgtaggttgcctgttcactctgatggtagtttcttttgctatgcagaagctctttagtttaattagatcccatttgtcaatgttggcttttgttgccattgcttttggtgttttagacatgaagtccttgcccatgcctatgtcctgaatggtaatgcctaggttttcttctagggtttttatggttttaggtctaacatttaagtctttaattcatcttgaattaatttttgtataaggtgtaaggaagggatccagtttcagctttctacatatggctagccagttttcccagcacatttattaaatttattaaaaacagcacccattgctcgtttttctcaggtttgtgaaagatcagatagttgtagatatgcggtgttatttctgagggctctgttctgttccattgatctatatctctgttttggtaccggtaccatgctgttttggttactgtagcgttgtagtatagtttgaagtcaggtagcgtgatgcctccagctttgttcttttggcttaggattgacttggcgatgtgggctcttttttggttccatacgaactttaaagtagattttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcactgagcagtggtttgtagttctccttgaagaggtccttcatgtccattgtaagttggattcctaggtattttattctctttgaagcaatagtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttccagatatacaatcatgtcatctgcaaacagggacagtttgacttcctcttttcctaattgaataccctttatttccttctcctgcctaattgccctggccagaacttccaacactctgttgaataggagtggtgagagagggcatccctgtcttgtgccagttttcaaagggaatgcttccagtttttgcccattcagtatgatattggctgtgggtttgtcatagatagctcttattattttgaaatacgtcccatcaataactaatttcttgagagtttttagcatgaagcattgttgaattttgtcaaaggacttttctgcatctattgagataatcatgtggtttttgtctttggctgtgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttcttttgattggaatagtttcagaaggaatggtaccagttcctccttgtacctctggtagaattcagctgtgaatccatctggtcctggactctttttggttggtaagctattgattattgccacaatttcagatcctgttattggtctattcagagattcaacttcttcctcgtttagtcttgggagagtgtatgtgtcgaggaatttatccatttcttctagattttctagtttatttgtgtagaggtgtttatagtattctctgatggtagtttgtatttctgtgggatcggtggtgatatcccctttatcattttttattgcgtctatttgattcttctctcttttttcctttattagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgttcttgcttttctagttcttttaattgtgatgttagggtgtcaactttggatctttcctgctttctcttgtgggcatttagtgctataaatttccctctacacactgctttgaatgcatcccagagattctggtatgttgtgtcttcattctcgttgatttcaaagaacatctttatttctgccttcattttcttatgtatccagtagtcattcaggagcaggttgttcagtttccatgtagttgagcggttttgagtgagtttcttaatcctgagttctagtttgattgcactgtggtctgagagacagtttgttataatttctgttcttttaaatttgctgaggagagctttacttccaagtatgtggtcaattttggaataggtgtggtgtggtgctgaaaaaaatgtatattctgttgatttagggtggagagttctgtagatgtctattaggtccacttggtgcagagctgagttcaattcctggatatccttgttaactttctgtctcattgatctgtctaatgttgacagcggggtgttaaagtctcccattattattctgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaactcctgccttgttttgttttccatttgcttggtagatcttcctccatccttttattttgagcctatgtgtgtctctgcacgtgagatgggtttcctgaatacagcccactgatgggtcttgactctttatctaatttgccagtccgtgtcttttaattggagcatttagtccatttacatttgaagttaatattgttatgtgtgaatttgatcctgtcattatgatgttagctggtgattttgctcgttagttgatgcagtttcttcctagcctcgatgatctttacaatttggcatgattttgcagtggctggtactggttgttcctttccatgtttagtgcttccttcaggagctcttgtagggcaggcctggtggtgaaaaaatctctcagcatttgcttgtctgtaaagtattttatttctccttcacttatgaagcttagtttggctggatatgaaattctgggttgaaaattcttttctttaagaatgttgaatattggcccccactcttttctggcttgtagagtttctgacgagagatccgctgttagtctgatgggcttccctttgtgggtaacctgacctttctctctggctgcccttaacattttgtccttcatttcaactttggtgaatctgacaattatgtgtcttggagttgctcttcttgaggagtatctttgtggcgttctctgtatttcctgaatctgaattttggcctgccttgctagactggggaagttctcctggataacatcctgcagagtgttttccaacttggttccattctccccgtcactttcaggtacaccaatcagatgtagatttggtcttttcacatcgtcccatatttcttggaggctttgttcatttatttttattcttttttctctaaacttcccttcttgcttcatttcattcatttcatcagtgatggaagatatcagaacttttcaaactcaaagaccaaaaaaaaaaatctgtgtctcaaatgtttgaagtcaaatgtattcttatgtacttatttacttgcaacattctctgctgattatagtttttccttcttaattctgagtctttttccccaatgtctgttattgatcactatctgatattaaattgatactctaccagcctaaatagatgaatatttcagtgaactatttggggaaaatccaaagatatgtgatgaaaagttaggttacaatttcatatatagaccagagagagaataaagccaagtacgcctgctggattctagacaacagtttatgtttttgaattaaatgtgacagcttacatataggatgacatcacagataattccaaacccaaatacatgaaaaaaaagttaaaaaagagacctgcatttatttcccccctgtaaaaagtgagtgtcaaaaaaacataattagttatgagaatatgtgaaattaataggaccattaattttacatctggacatctaagataacattattttgcacttagatttatgtcaactgcaagatgaagaaaaatatatgtttctatcacataagtgttataagaaacaataaatatgtgcaaaatttatataaaaacctaagtgctataaacaaaaatattattggtgacaaaagtttattcactaaaaatattcataggttacttatgtcagagattgcttttaacaaatataatgggagggggaagagttgtttctctaccctataaactttccattgttttttatattttaaaaaatgtaaataattttaaactgatagataagtaacacgaatggtaaagaaaactcggacatatatgcaacccgaatttccaaacatttaaattttgtttcagttgcatttgttgtctctgtctctctctctctctatgtatgtgtgtgtgtgtgtgtgtgtgtgtgtgtgtgtgtgtgtgtgtgtttatatggaggaatcatcagtggattcaaaattaatagggaggattgatgaagagcagggtaatggtatggtctcaaagtgtcttgcacatagagggattattaattgcaaagtaaaagctagtaactacacaatggagaaacctgagaatggagaaactacaatgtagtaactatagaaaagagaaatcttgcaactagttttatatatatatatatatatatatatatatatatgcatatataatatatagtaatttatatatatatatttaatatacaacatataatgtatattataggaatatatgatatatactatatatttactatatatgtagagagaaggaaccttcaacattacataatataacatatgattagttgcaattattataatatatttttagttgcaattattatatattattagtttcaattattataattactttattattagttgcaattatattacacattaattagttgtcatgtattattagctgcaagatttcttcattgtatagttactatgttgtatagtttctccattctcaggtttttctattgtgcagttaccagcttttaccttgcaatcaataatccctctatgtgcaagatcctttgaggccataccattaccctgctcctaatcaattctcctcactcagttttgaatccattgatgattcttgcatctttatgatgatgatcatgcaatggttatccccaccttcaattccaccacttctttcatgtttatgacagcattatactgtagggaagcatcttctcatccctcttaatttatgcatttattaatcatttatatttttatgatcagcataaactcatggattccactttttaaaaatcaatgggttataatacattgctcttattttttattttgatgctacaattgtctaagatttgaccagtggggaccccttcaagccgtattttggatatgcttcatgccaccttttgaatactttcttactttttggcaaaagatgtttcaggctcattttgtgctttacctatgctaatgctggcattagacatttatctaagaagctgtgcttctgtagtgtggattgatatttagaaaccataatctgagagctaagtgggatatatttacttgcaggacctttcctctgtcaaagctggaaaatcatgagtttatactaatatctccaattccagtttacccccgtatagtttgcactactctgttccatagtcatattccccatcttccataagaactcaagctcttcctccaaaagaaagcacatatttacatattttcttgatcctgcagtatataaaaacttgtcagtatatccatcatctatctatgtctatatgtgtttctatgtatcatcaatcaaaaagagttcaagagttacagttccatttgcaatccttttttatatagtcaacgtactgtttttaaatgttgcatggattagttccctttttccttccttaagtttgattatgtaatctatgtgaaatacatttgggtacatttgtttctatctgcatgtagttttagagagttttttcccattctggtttacttcattttattccctgtatatgtagagcatcacaacaattgttacttaccttcccaacccttccatgctgtccaccccaacacacacatgatttgtaggtaaccaatttcatagtttctgatttatccacgtatgttatattttgcagataagtgcatgatttcaatttctcttataggcaagtacctctgtgtattatatataaagagagagacatttaacctaccctgtgatgagttttctgtaagctacagtaatcatgacaatcgaagtgacataattgttagatttatatacggtgtaagtattagatgaggttaaaatactgtttaaacataactatttgtatgcatgataatgtcataatacaaaaggaggagtgggataattcagatgtaggcaacatttggccttccttacttagactttttttctattccaatctgaagataaactaaaagcattaccatgaatgataaggtatttccatgattatattagatttactaggctgtaatcccagctactcgggaggctcaggcaggagaatcgcttgaacccagagaacccaggagcagagttcgtgccacttcactccagcttgggcgacaaagcaagactctgtctcaataaataattaattaattaattaataaaactaggtacactattattacaacaaaattatatactgtattttattgcagccatatagataaccctctggaaagtacagtaaatacataaaattaaaactactggattttaataccaaaggaatctcaaattttcaatggttcttaatactcctgaagttacaactttaaaaatctctttaaagttatagagtctcaccaagaaaaaaatgtacatataccataccaaaatatgcttctaattttgaggtttcacaaacactccagagtaagaagtacaggtgtccttgatcactactgctaactgttgtgggtttcttcagaacttattttaagtcttgctggatatgtatttcattctacaagatgtaacacatgactatcattggttactttgttacttaagctgttcaaacattggccatttgaagatccttcaagttggaccctatgtcatttgaataagttcccatatatattttttaacattttcttaatttcttacacagcaatatgtcccaggcttgttgtgtactttccatgacctaatcctggaatcgactatttctccaagtaatattgcttccttgtagtgaagaagaggagagaggggaggatgaaaagaagtgggttaaagggtacaaacatacagtaagacagaaggaataaattcaaagtttaatagcaggatagggttaatatacttaaaattgtatcatacttggattgtggacaccctaaataccctgacttgatcattgtgcatcttatacatgtaacaaaatttcataggtaaccttaagtttgtacaaatgaaaaataaaccatccattactactattagcaaagaagagcccacaccttcttctgacaactggtatttaaggaaaattgacaaaatgaccactttaataataattcattatactcttcaattttcccaacactttcttttcattagatcaaaaaatataatattgtagagtccaatcactttgaactaattttgataatcacattgtttcttcttacaaaactctataagcatgtaagtttctaatcagcaaagaatacatgcactgttcaaaagttattttttcctacaaaggagattgtctgtttcatctaaaatagacttactattgtgtgtgcaatatatagtttaaggattttgaaggagatataataaatcgtagcatgtttcattacttactttgtcacctacagaattctctacatttttttctttatgagaactaatccccaacccccttcacagctctttttacaacggatgtagagttctgcattaccacaacaaaagaaaaccatgtagaaaaaaaaaggaagaacagaaaagaaaatgtttacagagggaaaaagtttcctttccttctttgtggttttctgtgtaaaatcttagtttggcaatcttgatatcatccattaatttattgatgaataaaatgtgtcactcataaacacttccagaagtgtcttaatagttgtcagaaaagtatttgccagctattcaaataaagacagattacttggatagcaaagacaatctggtattcaataccagcatctggccacttactaatatctttatctccctgaaatctcaagaagattaaagtttttctgaagtctcaggtgttcatttttgtaagcttgcccagattccaagccttcattttcccagcccagggtactatgaaaaagagtgtctgctatgttcatcagagctcactggacatgctcacaaatacatggcgtttcaactgagcataaacttccaattttatgttaaatttaagcaatctcccttttcataaaagaaaaaaaagttgtttttttttttttttttttttttttttttttgagacagagtctcgctttgttgccaagctggagtgcagtggtgcatctgggctcactgtagcctccgcctcccaggttcaagccattctcctccctcagcctcccgagtagctgggactacaggtgcacgccaccacacccagctaatttttgtgtttttaatggagacggggcttcaccatgtttgacaggatggtctcgatctcttgacttcgtgatccacctgcctcggcctccgaaagtgctgggattacaggcgtgagccaccgctcctggccaagaaaacatatattatttttataacactaaaatatgtggcctacacacaggctttaaaagaatttctctaatgctctaattaatgggtttatttttcatgcaggatgtgtgtaaggaaaccaccatgtttctccttcatccagctccatactgcactgtttgggatccggtgtgatcctatctaaaattaacactttccttttgaaaatgtattgggtttcttaatgcaatttctctctcttcaaagtataacatggggtgatttcctggtcaatacatttaggaatggtggagaaggagaggaaggagtgagctatggtctttgcttactttgaaacttgatttttaatgtttactttctcttatttttgtctttatgacactggatcactgcttctactagtgtgtctccttctttcacaaacagacaattgccttaatataaacaaacctctctagtggctgacaaaatcttccaaaactgttcatatattttaactgtgatgcagattataagtgtcaacactacataaacaaagagaacaagaacatagacaccaatttatctttatagtggggatgcatacttgctatagcattatattgtttagactttaacaaattccactataattataggttaataactatcaggtgttttgtagagttaatacatacatttatccatttcttaatgtggaagataaaaagtagttgagattgtgttggttgaccaattatacatgccttactaaataatatatgagaactttgcactagatttggaaggatggaagacatccaattaactgtcccttttccctcaagctgcaagggtctgatcataagaataattgggaacctccagtagtgtggtacaaatgcctgaggctgtagtgccaaccacgagaaacccctcctttagaagtgcctggagagggtgaaaagcaagtgtgagaatgtgaatccagactgtgaaagaccttttactgtcaattcccgctctgttttgccaaagggaagggacaggcactaaaaaaatcttcaacttgcaaaggatacagaaaatgctcagaccttgttaaaaacaagaagccacattagtggttcttcatgaaatatctgagtcctaagtcattctatatacattaaaagcaccttcttagcattacagaacatactgctgtcacttctggaggcattgaaaagttttctcggggaaggcattgctatgttccactatttttcagtaacattccttattgggttcttcttttccatccgtccctccgtcccttccgtccgtccgtccgtccttccttccttccttccttccttccttccgtcagtccttccctttctatcttttgtctcttttctccctaggttaatacctgtttaaaaagccatgaagctaataatgaaggaaatcaaaaataatagcagatacataagtgcatgcttgcaataataaattacatgagtactaaagaattagagcagcaagaaattttacagtttaggattgtggaagagggtaattgtctcatttttctaagagctgaaaccttgaaagagaatacaaaatcaactactactggttctgttactccaggattttcactaataatatggctctctgccctttcttcctacagcatctgatttacgcctcttgttttattttgtagttcaatatttttctttcctcagtggaatgttggtggtggtggtgtttattaagggtgcagtgttatttaaccattttgatcctttccattttataagaatcactgaaaggaacgtctttgaaagccctaggggggtggaagttgatacaaatacctgaagccaatttcttacaagcaaagcagcctacactggaaaataaataaataaataaataaataaaaacctttattccaaaaagttattttttctttaccattaatctctatttaccacaccagatacatcttttaaatatgtgtgtatgtcaggggaggagagagatcaaggtacatagattcaaaataaatacgtaaataatatgtgaaggagaaatctatcaactgagatagtcaaactaggagataggcaggtctccatagttccaaggtacatttattcttcacaaaacctataaacagaggagaacgatgttgactatggatactataatgctatcattgaaaatcacaaaagtcaagaagtacacagagacacagaatgtgattgttgtagacttcataatttcaatgttttcttgttctcttttctagaactaaacattctcatatttaaccaaatctctgacctgaactaaaatatcaatataaatagtaatcttcagaatagcattaaatgaaaatggtttcacacccttccattgacaggtctcagaacctgagacagtataaaagaatcactattttttaatcatataaatgtccaaataaaattataaaagggaactcagatctttcaattttgtgaacagcattcttccttgtatcttttctgttaaggatggggtttttttcctatggtacatttttcaatgcattatctaattttaaatgtctctagaactgagacatccactttttcacaatcagaaatatgaaatctttatttaaaatcgtatccatcctaaaatcccccttgtttgcctttgagtcttagttatattttgaagacttcctaactgcttttacttttctcttgcttatttttctgtatctttcatagatgtgatggaaatactatattccaatgttttatgcttaatatcaatagtaatgctgcagagctgtgtgttatcagaagtgggaatatgctgtagaggtgaaaaaaaagttcaggttccagaatcagtctacctggctttgagtcccaactttgccacttgcatttctgtatctcaatttgtttatctgtaacaatcatagcatatataaagtccatagaaaaatatttaacacatacatgctcacttaatatccacttttttattatgatcttaagagtatgcaacaaatatcgatttctcaaaggaaattggttatatatatgatatacatataattgactttaaataaaattttaataatctataaatcgtttacataactggaattgtttacgactacttctcattaaacagaaaattaccccaatcacttcaagctacgattgaggcattatgataaaatgagaaggcagtatggtaaaaggaaaagagcaggcttttgatttagaaaacctgtattgaaattacagctctaacatttacttgttgcatgatcatagacaagtttcttaccttctctgagcctttatttgtaaaataaggataaaatagtactaacctcataaatttgttgtgagcattaattagcacattggaaatacttattgaatgccagacattcacatattatatactcaaaattgttaagagatcttcagtcagactttctgggcttacatctgtgatggttaattttgtgtcaacttgaaggtgtgtgtttctgggtgatattaacatttaaattggtgaactttgaataagcagattgccctccataatgtggatgggctttatcctggatagaacagaaaagaagaacctccctaaacaatagggtattctccaaaagactgcctttaaactttatctgcacattagctcttctgggtctccaggaagcctggctttggactggatttgcaccacttggatctcctgggtctcaaacctacactgcaaatttggacttgctagccttcataatcatgtgaaccaactccatataataaatatttgtctataaatatatgcttcctattggttttatttctctggagcatcctgactacacagtatcacagctctgcaacttagttcttaggtgaccttgtacaagtttcttaaccactctgagactcttttcttcatctacccattagaaatagcaatgcctaccctcttttgattattgggagaattaaatgagttaaagtctataaagtgcctagcagactatttggcacccacctaggaagctctcagaaatgagcttcatagagtacctaaaaacaggaggcactgactatttccccagatgaggatatggctgattttagttctttgttttgttaaagaactaagagagcacaaggtttgtaaacattctctttaaagcaaaatgtaaagatttccagtgtaaattatttcaacaggtgaattaggtccaaaatataaaatatgtggggtatacaaaaaaactttactattgtgtcagatccagttatttctcagctctagcagggcccatcatgtgtggacaatgtaacctataagcacacattccctcagggaactggaaccatgagaaagctatcccaagatatgttgcatcttgttttgccttgtggggttccctgcttctgacaaaatttgtatatgaccactgtgtgggtgtggtcatacggtgtcttctcaccaacttgcaaccattcttaaaacactgtatagattgatgacaaaaaaactgtttactcctctgttactctgccataaattgggcaatgtgttttcttctcggtttcattctctgaacatgcttatgaaatgggtgcaattttaagccatatttgataaatatggaaactggggctttttaagattatgcattttgtcagagtgcagaccctgcacagagcaagatctttccttaaaaaaaaaaaaaaaaaagaaagaaaattactgctctactccagtagttctcaaacttcactgcaatcagaatcacctgtggatttttcaaaactataatcatatccaatctccagaaatttcaattaatttttggtggagtcaaggaaccagtaatacgtaattaaaaattcttttcaactttttctactgtgcaaatttgagaagcctttttctaaaccattacactatatcagtgttttccaaaattgtttgactgaaatcttcagtaaaaaacatttaacatcatcaaccaatatacatataaatataaaactgaaacaaaagttttacaaaacaatgcacttactacctgcaagcattctgttaatttatcttctattctattatatactatatcttttattttaattgcaaccttctcaattgatttcataacccactggttggttaccaagcacagtttgaaaaatcactgctcagggccaagtgtggtggctcacgcctgtaatcccagcaatttggaagacagaggcaggtggctcacttgagcccaggagttcaagaccagcctgggaaacatggcaaaaccctgcctctacaaaaaatacaaaaattagccaggcgtgatggcacacacctgtattcccagctacccagctacttagcaggctgatgtgggaggacagctgagcctgggaggtcaaagctgcagtgagatatgattgcaccactgaactccagagtagatgacctttccttaaaaaagaaaacaaaagaaaggcaaataaaagacaggaaaatcactgctctgtacaatgcttaataaaaatatgctccatttccctaccctttcctgatatatattctattttagcctcctctccaaattggagaccatttattcctgagtgctgagagatcattccactgcactcccttcttggcaacactccgctcgctctatatcctctttctacagctgaatacctatgcatgacaactgttctgacatactttcttcaaatatatgattcttaaaacaagtagtgctatggttcaagaaagatgaccccttttaggtccaagaaagggtgacaagtccatacattttattccattctgaagtagaatgaccaattgcatttgtagtattttattgctgtgtaacaaattaccacaaatttagtggcttgaaacaacacagtgtccatggatcagatagccaggaacaggatggcttggtcctctgctcagggtctcaccaggctgaaatcaaggtgttggctggggctgtgatctcatctgaggctcgggatccttttctcagctcactggttgttggcagagttcagttctttgtggctattgaaaactaaaataaaaccataaagcaccccaaactgactggaccctctcttgaccaaggggatcccagagaaactttggaagctgtgtttctggccatgacaggaagggaggtcagacacaccttattatatcccctccattttgtggtttagacacaaaaactgacaagcattaatgttaaaacagaaatcataagacaaatagaacagactctttatagcagtaagatatcaaattatatacaagacctaaggccacaccaggaagaggttaagtcacacaccctgcacttaagaatcagctgtgttctaattgttataagattttcttaatttatttctctcgagcagctaaacaatcactggccttgagataagcaatgtgtaagcagttgcagcatacccaccaccagtcgctgactaactgagccccccattccacaagccataactataactttgactggacaagagactgagttctgtaacttttcctgataaaagaccactggccatggattggttctggccagtttacagaggctacacacttgagtgcttctgtgtccctacttcacgtttttatgtgtaggtccaaactgtaatacatttaaatcttaagtctccaccccaaaatgaacatggatcacatgtaacatgcatgtttgcttatgacacataggcacgaccccttgtcatgaatattcatagtttctcctatatactcttaaatatggccattcagcttaaatgcctgatttactcctcactccctcaaagtgcttgcctttcaggctctaccacaggctacatttctcaacatgtcagaatggctaccttgaggtctgtagccctttataagaaataaagctcttctttctaactttataaattgtgtaatttctaagctaatgctgtaagactcatggtaatttttaagctaatgctataaaacttaagtcagcaggagaatctctttttaggaatggcttggtgccttttataaagcatcacccgattaggtcacactcacatagaataattaccttcgtgataagtctcaatccacagattagtagcctaatcacaagagtggtaccccattcacaattcctacccacattcaagggatgagaatcatacagatatacagaatcatacagatatagatatacagaatcatacagatatgtacatcaaagttttaaggaccatcacagatgtcagcctaccacatcagccatctcaattttcttcagtatgttctggttttaccactgaaagttccacaacccaagggaaaatcctaggcaaactggtacagtggtccccttaccagtggaaagcaaaatctctcacctagcatcctttatgtcacacacctaacgaaagtccaattacagaaaacctgaacatagagtttattcctattctcctctgatacaatgcttgtaaagatgagttaagtcatgtgcttatagtcagagatgccttagcgtgagcaccatagaaacacttgaccaataacttatttttcttctagagcatatcccatccactatacccaaaaaaaagttcatgaataaaactatgatgcaaagggaaaagtactgcattttcaaatttccttcatgtcacatgctatgtgtgtctgttaataaatacagtataatcccaatggtgtgatataaaactctaagtgcaggcaccaatgctaaagttagcagtgctttcagaacaagcctaatttaaacatcaaacctcactaattagcatatttttccctggcaaattttgttttacaaactccggcctaaatctgaaaatcatggtagcttaataatcatagaattgtagaataataaacacggtactgagcacaacattgaattgcagttaagaagaaaacctgaattatatatgttatgcaattttctttcttcccatgattgaaaaattcttcttctaaactaaaaactgaaataaagacagttgcctgttttctatcaatttatttctactcagattattttaaagcatttagaaatggaaattccaagggagaaaaatcaggaatatctcttcccacagtctaatataagtttccagcttctataaatattaggtccctggagttcttgacattgaaatgtgatactttgtattacttttgtctatttcaaaggatagatcaatggctttttttattattattatttgattctagcttgaatttttctttttctctttcctctgcttggaacaaattcagttgcataaaaagacagtccttaggcacctactcattataaatcacttctcattctactttactaacgttgtaccatcagtttaaaaaggttcttcagaatattaaaagacttagaacaatacctctgaaaatggaattgggttttctttgaaatttcagatggttttctttttcatatggatatttgttgcccacatcccattccatttcttttcctaaggtctgcttcagtgtagaggtgataatcattccttgattcactcgaaacatttccgatataatgggcttctacattggttgtttacatctgtgtacgaagaatctcttcagctttctagtttgactagtaagcaaacatcagcaagacaatacttcactgtcttacttccttggcatcataaggaaaaaggccatttcagcatccgaaacctgggaagtcttttatctcctttccatttttataggtttaaggtgatttatttgaagaagcacttaggagaaaagagggcaagaatttaatacacatcacaggattctgcactacatgcctcactatatcttagtaaaacatattttggcataattggtggtgctggaatctttcccagaagcacagaattgcctacaatgggggtaaaactgaactgcctatgctaaatctagacagtcatttcagactgttaattccaccatatgaaaatgtcttttcaggccttaaaaatgaaaaaaaaaagcttcattcagaatgtttaagtatatcaaagagtactgtttcatggctagtgccaatgttcactgttaaacataggggcctcaaaggaaaaacagactgcttagaaatagaatattcatcaagttataatggttgataattatattgctacattccccagttgttttctaaagaagacggaaagcaacatttacatgttggcatcatatcaccaccaactggccaagagtgtttactaggaatgtttactaggaagaaaataatcaacttctaaaaacaaaacaaacaggaatagacaaacacagtatttgataagctcatggggaagctaaatactcctcaacttgcttttctttttttaattggcaattgagattgaatttcaacatcaaatctgagaaatactggcagctgagattctgtcaattctgtgagtccaccacttgtcaatctatattttagccttgaaaaatgttcaagagttggttcactaagtctgttttctgctttatgaacctggtccaaataaactattttatgcaattatttggtgacaacattagctgaatattcagtattttaaaaggtgatactgcttcctggtggttaaactttatttagaacaaccagatataaaactggaaacctgactggatttattgttaacctaagtgcagttctgacaatattcaggagcttctagtacttatccaggaagaatatatttctagttcttatcaaaccctcaaattcaccttctcaattgcagaactcatattatgacagagtacatatcttgtagatgtttgtatgtggtcaaaggtgattggactctattcaatacatatgtatttggaaaactatagtccgttctacagtgatgatccttgtagctttgtttagatgattatgtcagctctttccccttaatatttacctcatcaccaatacaattatttggctataggcaggggaaatgaggcttctgagtggctaactcttcagtatagatacattcctgataattatatacactatttgaccacatcactatgtcccttttaacattattatttctcattcaccactaaggaagcgtggtatctaatagcattcgagtttggcgctttgtctcaactctggctgccactactcttatctaaacctccttatttacaataccacaacaatttccaaactaatttcctagtctcaagtctctttgctctcaaatccattttctgcaccattgcccagctcaccattttcaaggatcacttgcaacttgtagtcttataattacaagctactggaaaggtaccctgttgtctactggatcaaatctaaattcatcaattggcaaagcaaacaacctataatctaacacaacactccctcacactagccaccaatattgaccttcagttctggccaggtgactcctcttgtcatcctatttcaactcccacaaaagtcatgacacatttttataatttaactattttttaagctgcaaaatgaatattataataatagaaaaatacaacagaattctcacaatttcataacaaatatttttcttttgtctatataataatagcaaatagtaatagtgatatattgtttgctatggattgaatgtttgtgtccccctaaattttatactgtgaaatcataatgtccagtgtgatagtcttagtaagtggggcctttgggagataattagatcatgaagttgaagccctcattaatgagattagtgccttttaagaagaggcatgaaagcttgctctttgtctctgctctctgccacttgaggatacaacaagatggccagttgcaaaacaggaagcatatcctcatgagacactggatctgctaatgccttaatgctgtacttctcaatctccagtactatgataaacaaatttctgttgttcaagccatctaattgatgatattctgttatagaagcctgaactgattaagacagctcttatcaggtttcatgccctattctaacgtctttaaaaatgtgacctctatacacagcatctattttgattggttggtgccagtgtcatactgcttctaaatacctgtatggtgaatatcattctggggagcagaagtggtcagagaggtttacatctatgctgaattagaagcaggagtactgaataacatttcaggcagaggaagtgacaggccaaggggcaccagggtccaataaaacatagcaaatttgggaaattgcaagagtcccagtatgcttggggtgaagagagagtatggaactgagaaagaatgcttgaaagaaacactagagtctgattactaagagccttaaaagtcatgaaagcaaagaagggactaaagttaggaaattgcctgttcagactagtatttcggaaactacttgatatgatttggatttatgtctccgcccaaatctcatgtcaaattgtaatttccagtgttggagatggggcctggtgcagggtgattggatcatgagggtggacttacccttgctgttctcttgataacgagtgagttctcatgaaatctggttgtttaaaagtgtgtagcacctccctttcactctctttctcctactcccaccatgtaagacagggctgcttcctctttgcattccaccataattgtaagcttcctgaggcttccgcagccatgcttcctgtacaacctgcggaactgtgagtcagttaaacctcttttctttacaaattatccagtctcaggtagttctttataacaatgtgagaatggaccaatacacaactactgcagcaatgtgggaaatagatttcagagattaggttgcaggcgtaaatagttgtatggggaaactctcttctgactttgtcacatttggctcactcaaactgtattctgtgaacagttttaagctttaaacatctttctcaagcacaaatggactacaccattttttttttttatcttttcagaactagctcgtgtgtgtccaacaggagcatccatttctgttctgtcacctggtcaccttttagcttaatgctttctaaggactggcaatcaaagttaaaataaaatccaaagtccttcctttggcttacaagggccaatatgatcttcttctctgcacatgtccatgtgttcatctcatatcactttcacactcacttaccatactccagtgacactggttttattactattatttgaataaatgaagtatttggcaatagttgttttcttctgcttgaaatgtacccacactctccccttctcaatctccagtgttactcagctggatcctttcgtgctcttcagatctcagtttaaatattacctttacaaaaaggtcttccctaactactaaatctaaataaccaaaacacttacatatccaaggtaaaattccatgcatagcacatattattctctgccacttttcttgtaatttgtttgttgatttcttagcaagttattgtctatatttcttcaacactaaaatgtacattatgagaagacaagaaacatgtctatctcattcattgttgaatttccaagtataggatataatatatgttcaataaatatttgttgacggaatagatgaaccaagcgagcactaaccatactgattcaagaaagctagaaatctgtttactatatatcaataaacaagtattaaaaataatacttatggtattgtttatgctgtgtttttctgcatattaaaacacaactgatgaacatacatggtgtgaacctcaaagaataacacagttattctgtattttgcaagcccttaaggaaatgtattctgtggagtttctcagtttgagagaagtctagtattgtactaataatatatgagcaaaaaatatagtgaagatgtggatgcaaaatataagagaccttgatccatacttaccagaatttcttgaatgtacacatgctgctattcacactacttttatcacacaaacatatcatctaggaggttcactggtggatatgactaaatgaatccatttctagtaactttttgttataaaacagacctatttattcaggagattatgttgttttgttgaggctttacatttacatatacatgtagtgaagataaacctttcatgcactcatttgttaaataataaattattgattactgcagacaaaaaaaaactgaccaccaagacagaagaaaaagtgcagtaataaatccatacatttttctttttaaaaaattttaatttaagttctaggatacagaacatgcaggtttgttacataggtatacatgtgccatggtgatttgctgcccctatcaacccgtcatctagcttttaagcccctcatgcattaggtatttgtccaaatgctctccctctccttgcactccaacccccaacaggccctggtgtgtgttgttcccctccctgtgtccatatgttctcattgtttaacttccacttatgagtgcgaacatgcagtatttggttttctgttcctgtgttattttgttgagaagatggcttacagcttcatccatgtcccagaaaagggcatgaactcattcttttttatgactacatagtattccatggtgtatttgtgtcacattttctttatccaggctataattaatgatcatttgggttggttccaagtctttgctattgtatatagtgctgcaataaacatacgtatgcaggtgtctttatagtagaatgatttctaatcctttgggtatatacccagtagtgagattgctgggtcaaatggtatttcttgttctagatccttgagaaatcaccacacttgtcttccacaatggttgaactaatttacattcccaccaacagtgtaaaagagttcctatttctccacagccttgccagcatctgttgcttgctgactttttaataatcaacattctgacttgcgtgagatggtatctcattctggtcttgatttgcgtttctctaatgaccagtaatgaggtttttttcatgtgtttgttggccgcataaatgtcttctttgagaagtgtctgttcatatccttaccccaatttttgatggtgttgtttctttattttttataaatttgtttaagttccttgtagattctggatattagacatttttcagatgggtagattgcaaaaattttctaccattctgtaggttgcctgttcacactgatgatagtttctgacctcttcaaggagaactacaaaccactggtcaaggaaataagagaggacacacacaaatggaaaaataaaaaactttcctgctcatggataggaagactcagtatcatgaaaatggccagactgcccaaagtaatttatagattcaatgctattcccatcaagctaccattggctttattcattgaattaggaaaaactactttaaatttcatatgaaaccgaaaaagagcccatatagccaagacaaacctaagcaaaaagaacaaagctggaggcatcacactacctgacttcaaactatactacaaggctacagtaaccaaaacagcttggtactggtgccaaaacagatatatagaccaatgaaacagaacagaggcctcagaaataacaccacacatctacaaccatctgatcttcagcaaacctgataaaaacaagcagtagggaaaggatttcctatttaacaaatggtgctgggaaaattggctaaccatatgcagaaaactgaaactggacccccttccttacaccttatacaaaaattcactcaagatggattaaagacttaaatgtaaaaccccaaaccataaaaaccctagaagaaaacctaggaaataccattcaggacataggcatgggcaaggacttcatgactaaaacacccaaagcaattggaacaaaagccaaaatagacaaatgggatctaattaaactaaagagcttctgcacagcaaaataaaccatatatttttctaaaatgctatttatgtcaatcaaatggaaatatcaggaaaactatttgagaagaattcacgaaagagagtatgcacgtgattaagaaatacgtgaaaagttgataaaccttattagttatcaagaaaatgcaaatgaaaccaccatgaaatatcctataaacccaccagaatgactaaaataaaaataccatattttggcaacgatatagagcaactataactctcttaccttgtgggtgggaatgtaaattggtgcaacaactttggaatactgttaagtagtatctactaaagctgaacatatgcctatcccatgactcaacaattccactttgacaattttgtatataaccagcacaaatgcctacattttgttcaccaagagacatgatttagaatgcttatgtcagcaccatttgtaagatcctcaaactggaagttttctattaacagtataatgaataaatattggtatattttacaaaagaaaatagtatatagtaatcataaagaaaaactgcaactgtatcaagtaacatagataaatcttactaacataatgctgagtgaaaatacccagaaacaaaaaaaaatgctactgtatttttcaataatataatgcagcaaacagacaaaactcatctatattagtagatattctgatagtggttacccttaggccatgagtaatgatgaaaaggaagcataaattagtttctagagtgctggtactcttttatgttttatctagatactgttttacattatagtgataagtcagcgattatttattagcccgtatacttacattatgttcatttttctgtatgtatatttaaaatgtaaacaaaaatttgaaaatgttgttttgagcacctcctatgctctaggattttttttttattgtggatgcatatacagatgaacaagctgatgtggttcctgctctcagagagcttactttttatttagagaaaatagacaagcagacaataagtatttacataataaaataataaaatatcagtgttataataaacatgacaaatatgttgcctaactacactgagtttactgttcactagaaaaactagaccattaaactgctaatttcaacaaaatgtgataaagttatacactctaaaataaagtgcactatgctagtctggagactgcagaaaagaagaagaatatgagttgagatctgaagcacgaggtagtagttagagaatggggaaggatatgtatgtttctaaataaatttaattccctgaaactctgaagctaagtttaaagagaatcactgaaacttgaagaccaaggggaaaatacagcagaatggggtacagtggtcatcaagaaccctattattaggccgtgtggacctagttcacaaacttggattttattctaagtgcaatgcaaagccaaattttaaggacaggggtcacaaaatatgatttacagtcttaaaaaatcattctggctgcaaggttaaaagaatacgtagctagatatcggttaaactattgtagttcaccaggatagatgataagttgggacaaaatgatagcaattggactggaaaaatggttaccagaggctagaattgatagtgggaaacttgggggaggtggggatggttaatagatacaacaagtagttggaaaaaatgaatacgatctactgcttgatagcacaacaaggtgactatagtcaataataacttatatgtacatttttaaatgactaaaagagtctaattggattgtttgtaacacaaggataaatgactgaagggatagaaaccccattctccatgatgtatttcacattgcatgtcttcataaaaaaatctcatatactccataaatatatatatatactatgtacccacaaagattaaatatttaaaaataaaaaataagtagactaatatgggatatattttgaagttaaagtgaactgacttagttcccatgttaaaaagtggtgagggactcaatcgtctttgattgacacttgtttggtacttaaatagctggatagtgcccattatgtaattcttacctatatataactggctcactctcttacttcatttaggtatctattcataaatcacctaatcagagagccttttcctgacttctctatctataatattagcaatttccatcactctttctctccttaccctttttattttccttcttaccatttataacctgacattttgttttttatttgttgacactttcatcagtagcagacatactccataaaatcatgaacattgtcagttttgttcattgttatagccgtcatctaaaatgatatctggcataatatatgtacaataaagttttgctgagtggatacatttttctgaatatatagaatactaatgagggtaaaagttagaagaaaatcaaagttttcattatttgaagtttgagctattacacatttcagtagagatcatgagtaggcagtggatctacaggtatgaaggtcaggaagaggtcaggaatagagatataaatttatcagaatatctatggcttctaaaatggttgaacatcataatgccatggtgctagtttgaggccttgcagttttgctcttgccctcttagaatgctgttctgagacttccatgtgaagaagctgtcttagcctattggaaaatgagagaccacatgaagacctgaggtggcacagccaatgctagcaccaactgcaaaatctatgagtgataccatcttgactcctacagccattatagctgccacctaaccatacaaataagatggatgagaacagaatagtcagctcacaagtttgtaagtaatagtaatttggtatgttttacaccaataaactttgtaatagtttgctaaatagcagtagctagctggagcagtcaacctgggtgaaactgaagaaaaacatgcagttagatgaataaattggagaaaaattgagacacattttgatgcatatatttgggtggtagaatggaacagaggggaatggaatgaatgtgttaaatgacaagaaatcctaaataacttcaatgttctatgagttgacagagaaagtaggaatagaaaaggagacttagaagaagtagccaaggggataggagaaaaagcagaaaaataaaatgtcacagaacaaaataaaatagttcacataaagagtagtaaattgtatgaaaaacttctgatagatgaaaagtacatgaacattctaaaataatcattatatttagggagatcacataaacaaaaataaatgtgatatatattataatgaactactgaatggatacataaattattcaaaaagtttaaactctacattatacaaacatcattgataattgatttaatatattggtaatcattttcatttttaaatgtattgttactgtgccctttactatgtaatctcctagtatgaaattgtttctaagagaaaacaatatttgcgtaaattatttcatcttgaaggtttttgtaggaaaaactaagttacaactttgaataatttatttgattaggaaaaaagtctggtactcaagaagggtagtatggcatttgccattgttgaaataattttagtctgacaaacatacctctcagaattctcttatgaaaatttacctttaaatgcaagaaatacttctttaaagctgaaatatattacctcattatttttctctgaaagtagacaacagaaaactcaattacttgagttttcaaaatttacttttaaatttattttatacatcttagcaattcataatgaattcaaagggtacaggaaatcaaatgcaactttataacaaaaacacctagaaaaagcaatctaagcatcttgcatatgcccatttgattattttacactgttgacacttgtgaacatcaatataagactataatggagactgacctacaaatatgctgcttcccttacctgtttacatttgagcattgttctgtgctacttctctacttactcactcttactgttttgatgtttaattgtcagaagcatacatgaatccagaaatatatagaccttttcaagttactaaattactgtacattgcctcactagtcaagtgaggttattgatgtaaagaaacttactgatgtagcagaaacattttatccttctgtgtgttgagcatttataattacttcaactgaaacccaaatagaaacacacacacacacacacacacacacacacacacacacaattgtcactacatcctcttcaaccctttaattctagcgcaagttgccataacaatctcaggtttcaatgaaaggtgtatggaaagatttatagttgaaaacgatgaagttaacttggcattttctctattttttctcataaatcactgaaaagcaaacagtatggaagaaaaaaatacaaactatatctgcaaagaaactaaaaggtgcctcaaatttcaaaggctaaaataagagaaagtctgcaaaagtattgatgggcaagtaaaattgaggggattcaaggagacggaatgcagaccttagtgaaatctggcaagtaaatggcatagcctgaaatacaaaatcaatgttcatttgtttgtcacatcaaaaagattgagtgatggtagtaactgaagcttttctgggccacattaaacataaagtcttgagaagctgtgaaaatgaggctgaatataatataaacatgcaacatttacaggaaattgactaccaataattcagggaaaaaaagaaagattctgcctacgctgattctagtttattgactctgaaaatagcacactcacaaccctttggcatcaggaaaatatccgagagtttagattatcatctttctcccaccctcatgcaggttttctaaataaacttatcttaggaaaaaatgtagctcattaagaactatgtaaaaaaaattaaattttggtttaaactctgacatatgaaatacttagaagttgtcactcctgtccttataagaaaaagctgaacacattgaaaaaaaaaaaagtaatttcaatgaatcgcaaaaggctgagtgtggaccaccattaagagtgacaaattcctggggatataatctttagggtgcatccagactattgtagattttgcctccaggaatttgatgaggttttcatagccagaagacaagaaagactcatcttcattctggtaaaagaggagaagagtaaccactttgaaatacacccacagaatttttttaaattacactttaagttctgggatacatgtgcagagcgtgcaggtttgttacataggtaacaatttatgaatttcttcataacaaaatcctaccaaactttagcagagccttaggccacctgggagaagggtatttctttcaatctagaaccacctattcttcctgttttatctaaggaaagaaaaagccaaggaatatttggaaagtcacagcctaaagacgcaggcccactaagagactgagatttaatcataatattatagaatacttctgctactctacatcttactaccacacaacagggatccagtatagtaacagtggattatagctgaaagaactacaagatacagactgtctgaggagaagtacctagggaagtccaaaggcaagaaggtatatgaaaacaaagacaccagaggattttgaagactttggcacctacagctacagcaaacattctaaaaagttcaactactagccaagttaacataaatcctaacactagaaggcatttatctcagatcctattacctgacacgtctggctttaaacagaaaatttcaaggcacaccaaaatacaagaacaaaacaaagtctaaagatacaaaccattcattagaaataaactcaaatattacaaagatgggattatcagacagtttaaaataacaatgattaataagttaaaagttctaatggaaaaagtagacaatttggaagaacagatgggtaccataagcagagagactgaaactctacaaaacaatcttaaggaagtattgaaaataaacactgttacagaaatgaagaatgtattggataaactaattagtagaatagacactgctgaggatagaatcagtgagttggaaacaggtcaataaaaacttccaaaacttaaattcaaagagaaaaaataactaaaaacaaattcagggctgggcgcagtggctcatgcctgtaatcccagcactttgggaggccgaggcaggtggatcacgaggtcaggagatccagaccatcctggctaacacggtgaaatcctgtctcttctaaaaatacaaaaaattagctgggcacggtagcaggcgcctgtagtcccagctactcgggaagctgaggctggagaatggcgtaaacccgggaggtggagctggcagtgagccgagatcgcgccactgcactctagcctgggagacagagcgagactctgtctcaaaaaaaaaaaaaaaaaaaaaaacaaacaacaacaacaacaacaaaaacaaaaacaaaaaaactcagaacattaataactatgggacaataacaatagatataacgtatgtataatgggaatatcaaaagcagaaaggaagaaaaaaattaattaatgataactgagaattttccagacaccaaaccacagatccaggaggccagagaatataaaacagaaaataaaatcaaagaaaaataagaaactacacttggggaaatcatattcaaacaaacaaacaaacaaaaaaagaccaagagaaaatcttgatgaaaaccaaataaataaagtgcattgccaatagatggacaaatgaaacaaattcaatggatttctcatctgaaatcatgcaagcaataagagagtgaaataaaatatttaatataatgaaagaaaaaagaaacagcaacccagaattatttactcagtgaacttgttcttccaaagtgaaggagaaataaaaactttttcaaacaaaaatgaggaacttcatcactaacagatctgtccagaaataaatgttaaaagtagctattcagagagcatgaaaatgatatagatcagaaaggttaatctacaaaagaaaagaaaacatcagaaaatgaataaaggagaataaaataaaatttttaaattaatcttattcttaattgagataacataactttcttgaaatcaataataataatgtattggatgattatagtaaatggataagtgaaacgaatgacagcaacattgcaagggatgggagggaggacttgggaatactctgttagaatgtatctaagtacatataaaatgatagagtgttatgtgatactgaacttagttaaaactacatactgctaactccagggcaaccactgaaaacagttttttaaaaagttgaaactgatacgcgaacagggagataaaatgagttcatctaagattttcattggaaacatagaaggcagaaaataagggaaaaaatgcaataaatagaaaatagttatacatatagtacatattaatacaaatctatcaatgataactttaaatgtgactagactaaaatataccaattgaaagacagacacaatcagagtgaataaaaaacaaggatcatgtatatatcatctacaagaatctcactttaaataaaaacaaataggttgaaagtaaagaaatggagaattatatactatgttaatactaatcaaaggaaagcctggatagctatattaatttcatataaagcagacatgagaacaaggatgataaacaggaatacaaagtgccattttacaatgaaaaaggggccaattatccaaaaagtctaaacaatgctatgtgtatgcatgtgaaaacagtgtcaaaatatgtgatgccaaaaaactgttagaaatgcaagaagaaataaataaatatactattatagttgcttggaaacatcaacatcctctctcagtaatcgatacatcaaacagaaagaaaacagtaattgacctaaacagaagtatcaaacgatttgatataatagacacaaagacataccccatccaaccacagtagaatgcacattcttctcaggtttgcttagaactttcactaaaaaacaatattcttgataataaaacacccctttacaaatttgttaaaaataaaaatcataaaattatgttctcagacaatggaattaagctagaaataaataccataaagagagctgaaaaatctgcaagtatctggagatttaacaacatatttctaaataacaaaaagaccaaagaagaaaactgaagaaaaaaataaaatattttgagtgacatgaatataaaattatagaccaaaaaaatttgagaggtgcagtaaaaatagtgcttaaatggaagtatatggcactaaattgatataatagaaaagaagaaagatacagaatcaaaaatctaagcttccaccttagaaaactcaagaggaagtcaaattatccctgttttcagaccacatgatcctgtatctaggaaatttcatagtctcagcccaaaagctccttaatctgataaacaacttcagcaaaatctcagaatacaagatcaacgtgcaaaaatcacaaacattcctatataccaacaacagtcaagccaagagccaaatcacaaattcaatcccattcaaaattgccacacacagaataaaataaaacaactaggaatacagctaaacagggaggtgaaagatttctacaaggagaactacaaaccatttctcaaagaaataagagatgacataaataaatgggaaaacattccgtgctcatggatagaagaaatcaatattgttaaaatggccatactgcccaaagcaatttatagattcaatgctatgcctattaaattaccactgacactcttcacagaactagaaaaaaatattttaaaatttatgtggaaccaaagaaaggctgaatagccaaggcactcctaaagcagcgggggcggaaagctggaggcatcatgctatcccactacccaacttcaaactatactgcagagcagtaagcaaaacagcatggtgctggtacaagaacagacacatagaccaatggaacagaatagacaacccagaaataagaccacacacctagagctatctgatcttcaacaaacttgacaaaaccaagcagtggggaaaggaatccctatgtaataaatggtgctcggaaaactggctagccatatgtggaagattgaaactggatcccttccttataccatatacaaagactaactcaagatggatgaaagacttaaatgtaaaaccaaaaactataaaatccctggaggaaaatctaggtgataccattctggacataagaattggcacagatttcatgccgaagacacaaaaggcaattgcaacaaaaacaaagattgacaaatgagatatcattaaattaaggagctcctgcacagcaaaggaaactatcaacagattaaatagagaacctacaggatgggagaaaatgtttgcaaactatgcatctgaaaaaggtctaatattcagcatctataaggaacttaaatttacaagaaaacaaaacaaaacaaaaaaattaaaaattggccaaaggacatgaacacttttcaaaagaagacataaatgtggctaacaatcatatgaaaaacagctcagcatcactgaccattagagaaattcaaatcaataccacaatgagataccatcttgcaccagtcagaaaggcttttattaaaaagtcaaaaaataacagatgctgctgaggcagtggagaaaaaggaacacttatacattgctggtgggagtgtaaatgaattcaaccattgtggaagacagtgtggtgattcctcaaggatgtaaaaagagaaatactattcagctatggaaataattataataattctctagtatgtctttcagacagtagaagcagagggaacatttctaatttattctttgctatcattactgtaataccaaaaccagataatgatattacaggaaagaaaaattataggacgaatttctcatgaacataaatacataaatgcaaaaatccccaacaaagtgttagtgaattaaatcccacaatgtatcaaaataattagacatcatgagcaagtgggatttattttaagtatgcaagactgggatttattttaagtatgcatgactgggacttactttaagtatgcaagactggttaaacatccaaaagtaaatcaatatattctaccatatcaataggccaaaggaataaaagtcatatgatcatatgaataagtgcagaaaacacatatgacaaaaaccaacactcatgattgcatctctgatgaagaaaattaaagaacgtctacataaatagaaaactatttcttcttgtaagagtgagaaatttaatattgttaaatgtcacctcttcccaactgtatatacagatttagtgcaatacaaatcaaaccaagctattttgtacatatggacaaactgattctagtagaagttttatagaacccgatatgggtaatttataaagaaaagaggttaaattgattcacagttccacaggctatacaggaggcatggttgtgggggcctcaggaaacttacagtcatggaagaagggcaaatgggaagcaaccatgtcttcacatggtgacaggagagagagagagagagagcgaaggggaaagcactacacacttttaaactacatgatcttatgagaactcattcactgtcacaagaatagggagggggaagcctgccccatgattcaatcaccttcttttaggcccctcctccaacacatgggattgcaactcaacatgtaatttgagtggggacacaaagccaaaccatattattccagcactggcccatcccaaatctcatgtctttcttacatttcaaaacacaattatgccttcccatcaaacccccaaaatcttaactcattccagtattaactcaaaagtccatgtccaaagtctcttgactttgacatggacttttgagttaatgctggaatccttcttgagacaagttgagacaagatgagttaatgctcatccttcttgagacaagccaagtcccttctgcctatgagcctgtaaaataaaaaacaagttagttactttcaagatacaatggggatacaggcattgggaaatggtcccattccaaaaggtagagattttccaacacaaaggggctacaagccacatgcaagtctgaagccagcagggcagtcattaaatcttaaagtcccaaaataatctcctttgatcccatgtctcacatccaggccacactgatgtgaggggtgggctcccaagttcttggggagcttagtccctgtggctttgcagcatacagcccccatggctaccttcattggctggcgttgagtgctagtggctttaccaggtgcaaagtgcaagctgttggtgggttctaccattctgggttctggaggatggtggccttcttctcacagctccactaggcagtgcctcagtggggactctatgtgggggctccaaccacacatttcccttctgcactgccctagtgaaggttctccatgagggctcaagccctgaagcagacctctgcctggacatctagatgtttttgtacattctctgaaatccaggtggaggctcccaaacctcacctcttgctttctgtgcacctgcaggctcagcaccacatggaagccatcaaggcttggggcttgcaccctctgaagcaatgatccaagctgtaccttggccccttttagccatggctggagctggagttgctgggacacaggatgccacgtcctaagggtgcacagagcaacagggcccatgaaaccactttttcctcttagaccactgggtctgtgatgggaggggctatctgaaatgccctggaggcattttccccattatcttggccattaacatttgactcctctttacttatgcaaacttctgcaaacttctgcagctggcttgaatttctccttggaaaattttttttttcttttttaccacatggtcaggctgcaaactttccaaacttttatgctctcctttccatttaaatacaagttccagtttcagatcatctctgttcatgtatatgaccgtgagaagcagccaggtcacaccttgaatgctttgctgcttagaaatttcttctgacagataccctaaatcatctctctcaatttcaaagttccacagatctctagagcagggacataatgcccccaggctctttgataaagcatagcaagagtgacctttactccagttcccaataagttcttcatctccatctgagaccaactcatcccggacttcgctgtccatgtcactaacagcatttttgtcacaacctttcaacaagtctctaggaagctccaaactttcccatcttccttcttcttatgagccctccaaactgttccaaactctgcccattacacaattccaaagtcacttccacattttcaggtatctttatagtaatgccccacttctctggtatcaattttctgtattagtctgttttcacactgctataaagagctacctgagactgggaaatttataaagaaaagaggtttaattgactcaaagttccatagactgactgtacaggaggtatggctggggacacatcctcagatggtggcaggcgagagagagagtgaagaaggaagtgctacacacttttaaacaaccagatttcataagaactcagtcactgtcataagaacagcaagggggaagtctgccccatgtttcaaccacctcacagcaggccactcctccaacacctggggattacaattcaacatgaggttttggtggggacacaaaaccaaagcatatcagagtcctgttcccattgcttattactgtcaactttgtcaaagatcagaaggctacaggtgtgtggctttacttctaagtttctctaacctgttccattggtttatatgtctgtttttgtataagtattatgccattttgatagctgtagccttgatgaatagtttgaagtttggtaatgtgatgcctccaccttgttctttttgcttagaattgctctgactattcaggcttttattgggtttcatgtaaatattagaatagttttttctaattctatgaaaaatgacattggtagtttgaaaggaatagcagcatggccattttaacaatattgattcttcctatccgttagcatgaaatgtttttccattttgtttgtgtcatctctgatttcttcaagtaatgttttgtaactctccttgtagggaactttcacctcctgggttagttgtattcctgtttttttgttttgttttgtttttggtttttttttttgttttttgatttttgtgtttttgtagcaattgtgaatgggattgcattcctgatttggccctcagcttggactatattggtgtatagaaatgcactgatttttgtacattgattttgtatcctgaaactgtactgaattttatcaattcaaggatcatttgggcagagaatggggtattctaggtatagaatcatatcatctgtgaagacatatttttactttctttctttctattttgatgccttttatttcattctcttgcctgattgctttggctatgacttctggtactatgttgaataagagtggtgagaattggcatccttgtcttgtcccagtacttaagggaaatgcttccacttttcacctgttcagtatgacattggatgtgggtttgtcaaggacatcacttattattttgaggtgtgatccttcaattcctagttttttgagagtttttaacatgaagaaattttgaatttttatcaaaagccttttctgcatctgttgagatggtcacgtggctattgtttttagttctgttcatttgatgaatcacatttattgagttgcacatgtttaaccaaccttgcctcccagaaataatgcctacttgattgtggtagattagctttttgatgtgctgctggatttggtttctagtattttattgagaatttttgcatctatattcaacaggtatattgatctgaagttttcttctttcattgtgtctctgccaggtttcagaggaaaactagctaaaatataaagacacaaataggttaaaagtgaaaataaagacaaagatattccatgcaaattataaacaaaagagatggctacactaatatcagacaaaatagactttatgtcaaaaacttttacaagacaaagaacaataataaaagtgttcatttttaagaagatataagaatataaatacataggcatcaaacattaaagctcaaaaaaataaagtgaaattaacaaaattgaagtgagaaatagatagctctgcaataatggtaaaagcctttaattctcaccttcaataatacatagaacaaccagagagaaaatcagtaagagaatagaggacttgaacagcactatagaccacttagatctaacaaacatatacagaacactttatgcaacggcaacagagtacaaatttttctcaagtgtacatgaaaaactctctagtatagatcatgttaggccacaaaacaagtctttctaaattttaaaagatttaaatcatacaaagtattttacccaatcactatgaattaaaactagaaatccatagcagaaagaaaactgagaaattcccaaatatgtgaaagttaagcagcataatcttaaatagcaaatggataaaagaaaaattcacaagggaaattggaaaatatcttgagacaattaaaaatgaaaacacaacataccaaaatttattggatgcagtaaaagcagtgctatgaaaaatatttatggctgcaaatacttagattaaaaaagaagaaatatctcaaataaacaacctttcgttccccaaggtactagaaaaagaggagcaaattaaacacaaggttaacagaacaaagaacataaaaaaattatataaataaaatagacaatatgaagccaatagagtaaattaatcactatgttctttgagaaaaaataataatatgacagatctatagacagattgagtgataaaaagaaacaattgtcaaataactaaaatcagaaatgaaacttgggtcattaatactaattttatataaataaaagtgattataaaagagtgctatgaagaattgtatatcaacaaattggattacctaaatgaaagtgacaaatttctagacacgcatggcctaccaaaactaaatatttttgtaaaagatagaaaatctgaatgcacctataactaataatgatatcaaatcagtgataaaaaaaaaaccttctaacaaataaaagtctaaaatctgatggcttcactggtcaattttatcaaacatttaaagaattaacaccaatatgtctcaaaatcttccccaaaattgaacaagaaggaatacttcttaactcattctatgagggcaaccttacctgataccaaatcaaggcaaagactgtaaaagaaaaccacagaccaacaatccttatgaattcaaaaactctaaaaaaactttgtaaaccaaattcaacagcacattacaagaatttattactgtgatgcaatgatggttcacaatacataaatcaatcaatgttaatataccacattaacagaatgaagaaaaacaaaatggtcatcttaattaatatataaaaagcatttgacaaaatttaacagattttcatgataaaaacactcaacatacttgaaattgaaagaaactacgttgacataataaaggtcatatataaaaactccacagctaacattttactcaaatgtaaaagcctggaagcctttcttctaagatcagaaacaagacaagcctgattttgtcacttctattcaatgtagtagtgagatttctaggcagagtaattaggcaagaaaataaaaggcatacaaaaagttgtgtaatctctgattacagatgacatgatcctctatgtctacataccctaaacattccacaaaaatgtattgcactaataaaacaattaggcaaacatgtagaacacaaaaataatacacaaaattagttgcttttctataaattaaaaataatcaatctgattagaaagttataaaaacaattccatttataacagcatcaaaaataataaaattcttaggaataaatttaaccacagacatgaaggtcttgtacactgaaaaccacaaaatattgtggaaaaaaaatagaaacaaaaaaatttaaaaattcaagtttattaatttgaggatataatcttgtgaagatgttaataccatccaaagagaggtgaaaaatcaacgtaatctctctcaaaatcccaatgacattatttcagaaatagaaaaataatcgtaaaattcatgtggatgcttaagggacctggaatagccgaaacaatgttgaaaaagaacaaagttggaggtctcatacttcctgatttcaaatactactatgaatgacattaatcaaaacagtatgttaccagcataaaaacagatatacaaaactccagaataatatagagagcccagacatacacccttgcatatatagtcaaatgatttttgataataattctaagaccattcaatggggaaataataagtttttcaacaaattgtgtgggggaaaactggacatccacgtgaaaaataatgaagttagacccttaacttataccatagacaaagaaaattgatcaaagacctacatttaaaagcagaaactatgatactcccagaaggaagtaatatggggaaaccttcatgatattgtgtttggcaataatttcttggctatgataccaaaagcacaggcaataacacaacaaaaataggtaagttggatttcatcaaaataaaatacatttgtgcatcaaatgacactatcaggagagtaaaatgtcaatgtacagaatagaagaaaatattcacaaatcatatatctggtacaggcttaacattcaggatatgtaaaggactcctacaagtcaacagtaacaaagcaagcaacccaattcaaaaatgggcaaatgattttaatagacatttctctaaataagatatacagatgaccaataagcatatggaaagatgctctacatcactacttgtcagaaaagtacaaattaaaactacaatgagatagaactttgcatccattagaatgtctattatcaaaaccacagaaaataataagtgttggcaaagatgagaaattggaactcatgaaatgcttgtgggcatgtaaaatggtgcagctactgtggaaaacagttcctcaaataattaaacataaaattaacaaagacaacagcaattccacttctgtctatataagcaaaagaaataaaagcagtgacttgaataaatactggcacacttatgtttatagcagtattattcacaatagtaaagaaatggaatcaacccaaatgcctataaatggatgattggataagcaaattatggcctatccatacaatcgaatattattgaaccttgactaggaaggaaatttggacaattgctacaacatggatggatcttgaaacattatgcaaagtgaaataaaccagacaaaaaaggacacatattgtatgattctacttatataaagcccccaaagtagtcaaattcatagaggcagaaaacagaatggtgttgccaagagccaagaagggggaacggaaagttattgtttaattggcacagagtttcagtttgagaagacaaaaaggttctggagttggatggtgtaatagttaatataaagtgttaacttgattggattgaaggatgagggtgttgccaaagggattaacatttgagtcagtttactgggagaggcagacccaccctcttatcagggtgggcaccatctaatcatctgctagtgcagctaaaataaagcaggcagaagaagttgaaaaagagcagacttgctgtcttctggccttcgtatttctcccgtgctatttgctttctattgtcaaacatcagactccaagttctccagcttgtggactcttggacttaaaccagtggtttgccagtggctcttgggcctttggccacagactgaaggctgcactgttgagttccctacttttcaggttttagagcttggactgatccatcactggcttccttcttcctcaacttgcagatggcctactgtgggactttaccttgtgatcatgtgactcagctatccttaataagctccctttcatatatacatatatcctattagttctgtccctctagagaaccctaatacagatggtgttcatgattgcacaaaaatgtgaatgtacttaatgtcattaattgaacgccatacttaaaatggttaaaattgttaattttatgttacgtatattttaaaaataacaaaacataactgcagatttgatattgcacagagcatgatacagcatgattaaataagaattcaataacaaaaaaataactgaagtgtccaaatgtacggaaattaagcaacacaattctaggcaattcataggttaatcaataaatcagcgtaaatcttaaaatattttaaagtaaatgattataaaaatatgacaggtcacaatgtgtgagatgcaacaaaagctgagagattatttatagcttttaatgcatattttagaaagaaaaaataaattatctctgtttccaactaaaaaaagcagaaaaagcacagcaaataacacttaagaaaaataaaggaaaaagtaatgtaaatctaatgtcagaaatgtaaaacagatatacaatagagaaaattcaacaaaagcaaacatttattattttataataaaattaataaacccataggaagattgaccaagaaatagacaatgcatggattaccaatatcagaaatgaaataagattcatctttaggatcctgaatacattaaaggataaaaagagcacattataagcaactttatgtaataaagttgacacattaaataaaataaaaaaattaaagagataatttgctaaaatgaatacaaaaagaaacaaagtttaaatagtaagatgatttattaaagaaattaaatctgcacttagacaaagaaaattctaatcctggatggtttcactggtaaactcttccaaacatgtaagaaagaaataatacaaatcttacacaaattcttatagacaagagaaattaaaaataaataccttccaacagtttgtatgaagctagtataaccataatatgaaaacctgacaaagatatttcaagaaaggaagactattggccatattaaacttggatgtaaaaattcaaaatattagcaaatataatccagtggtacatataaagcatagtgcatcatgaccaagtaaaatttattcagagaatgctaggttggtttaacatttgaaaatcaatcactataattctgcacattcacataataaaggagaaaacataagattatctccatagatgcagataaaatattgagaacattgaacagctatttatggtaaaatcctcagaaaattagaagaaagacatttctttaatgtggtaaataatgtccaatgaaatttaaagatattatccattttaatggtaaaatgttaaaactccctgaggttactactaatcaaagatgccaaccattatcccttctatttattattgaataaagattatagtcaatgcaataagacattgaaaaaataataaaagaatcacagataacttgtaagtatatgtataaaatctttaaaaatctggaaactattataattagtaaaataatacagccaagtcaatgagtacaagattaatacaaaatatcagcttttccatatactggccaaataaataggaaattatatttttaaaataccatttaaaatataaaatattaaatatcttgttaatatttctacagaaatatacacaagaattctacactaaaaactataaaatatcaccaagaaaaactgataacaacctgaataaatccaaggtcatggataagaggacttcatattgttataatgtcagttctccaaaaatttatctatagattccaatcaaaatctcaacaggctttttattgtgtccagtgagctgattttaaaatttatatagaaatgcaaatggcaaagaataaccaaggcaatctggaagaacaaagctggagaatttatactacaaaagtcatggcctcttactgaaatttaataaagtttaatattgacacaagaataaacaaatagaacaacggacaatctaagagggtccacaaatagatgcatacctgtattgatcatctagtatatgataaagttgaaactacatagcactgtggaaagtatcatttttcagtaaatgagtcacagggtcaatatgatatccaacatagggattaatttttgctcttacatgacatcataaaaaggccagataaacagaggacctaaatatcaaagaatttccataaaaatagaaatatcaaagaatttctttaaaaaatagaaaatttacgtgaaagtatataaagacacctttatgactttggagtagacacatattttcaaacaagacattaagattaccaatgataaatagaaaattgataaattggactatattatgacttaaacttctgttcatcagaagacgccaataggaagagtgaatagatagcccacaaagtgggaaaaggtatttacaaaacatattcccctcaaaaaaggtttagatccagaatatataaagagcttttatcaaataaataggaaaagagaaaatctttttttaaatgagcaaaaaactcaaataagtaccttacagaaatgatatttaaattgggagtgggtgctgagcttcattagtcatcaagagaaattaaaagtaaaaccagaactttataacactacataccctgtagaatggctaaattgaaaaagaaaaatgatgctgttgtaaacattcttctactaattgggtagaaatatacagtttatctgttgggtatatacttattagtgtaaagactgtctgaaaagtacacatatgttattttttgtataaacttccaaactgttttccagtgtttataccaacttgccttcccacagttgatgagagttctagtagctcttgaaatgtgtcttgatagcattcataataagcaagcagtagataaatggattctagtatgttcacaaaatggaatgctataaagcaaggaaaatgaacaaatttcaactacacacaaaaatatggttgaatcttataaacaatatgtaaaagaatctaggcacaaaagattacatattatattattttattaatataaagtttaaaacactaatctgcattttcagaagtcaggttagtgattaccttgatggtggagggagagaagtgtatagtgaccggaagtataaattttggtaagtgcaaagaaggatgggaaaggttaaaatattattggtgaaaagtgagcatgtgagcacagactttggtgtcacagagaggaaagagcccaggctttgggtttataccaaaagggatctaagtcttcactcttttactagctggttaaccctaagcaagttacttaacactctaatattcaagtattcacttattaacacagagatgaaaatccgtgctttacattgattttctgtgcattaaggaaaatagaacttaggtaaaaagaacttagtttcatggttggcatatgataaatcgtcaacaaatggtagcagttactatttttggtaacagaaattaacgtgtcacacagcgtacgataatgttaacctggtcctgtctgttgtaaatgatgtgtgctgtagagaaaagagctatatggatagataaactgcaactagagtgtaaagggcagggataaaacttgatattttaggcactggaaagccattgtagatttttaagcatgtggacaacataattcattcttgtgttttattgcaaggttgttttggcaatgaatatacagaggagactggaaagtaggcagtggcttctgaagtttaagttggtaaaagaaacttgcacggaaatccagattgactataatcaatcctaaaactaggattatgataaggtaaatacagtggtaagacaaatatatatttggaggaagaatcaacagagttccttgaaaagatgacagagattaaatctactgaggtgactctgtagttactaatgtggtagcataattttatcctttataaaaacgtagaaaataataggtaattttggaaaagatgctaattttattttggagcatatggaatttgaagtgattagccaggagtgggttttctataagctgtcaacaaaagaattttcacataaacctcctttatgtatgtgtgtgtcttatttttcactgttttgcattctgccaagttcttgctattattttccacagcttttactccagggttttttgctgaagattatttggaaggttaagctgtatagatttggtactttttggtgtggaaattagatctgaattaacatgaggaactacttagagaggaagccccaaagactgcttatttgtgcccaaccagccagctcctgcagagcaggtctttactatacttccacaggaattgtgtcaagacttgaagatcccactgtcacatcttacactcaacatgaataaagaaagctgcttccaattccagattgcacagtctgattccacaatcacgaatattttccccattagttgctgccaaggtaaacttcacttaaaattggtttatagactgacttcaagaaacataatgtaatgatgcatgatgagccaaacaaatagatagcagatattctcttcacataccactaatacttcttggtaaaaatttgcagtttcaggaaactgcaactcccctcaaccaagtctttttctttgtttctctgtctgcaaatcagagaaaaactaaatttctcataggagtgccaccaaaacaataagcctgattgatatcaagaattcatccagagtttatcctaccatgataatgtgctatgtgttgttcgagaagcttaaagtacaaagataactacttccagtttaaaaagtccttcaaccatttcatgaaatgagattccctgttgacagaacagaaccattattgacacgcaaagagagccatctatacatctaagtggtgcatgagtatgtataaaccctataatatatatactcatcagataggcatgcttacatctcagcaaaaattgacagtcatagtcattaaaatcagcttgggaggatttttttccttacctcttagtgagattttctgctctattggtgcaatggaaacaatgcttgtgctctccaattcaatctcttttacctactccatcaccaccaccagagaccactcattatctgtagcctaaaactatatgtttcccttggggcccaaggttctttgccaaattactttaaatgtttacgtttttttcctagtataaataactgattacaacatttgataatgagtattaatgttgaaataatttaaacaatgacataggattctaccctactccctttcaaaaggcagtaccactattttgttctatctgtacattttctttggatgagtctgtgtctgtgacaaaaccatccttcttctttctccaatacaattgctaacacaacatttatatttttttctggctttagcatagctacttacctgttataggataggatgaagaaaacttggaggactgggatctgaaacaaactctacacctggatgagaaacacacatttggaccaactcagtcaatggtgctgtgaacacaatccatcatccaacgtatagcattcaaagtgaataatagctgtactttgtaacctaggcaagcatgcctgtaggcagccatgtgcttcaactaatggatggataacagctatagggtagtgatactcaaagtctgggtaagcaagaggcagagtggaagatgtccaatggatagtagagctctagtcaccgtgctaaggttcagtaacaggaattaaggcaggaagatagaaatcaaagcaaaggcaagacccagatacaagagtattaggcagactacaaagccaaatgactcaagcacaagaatatgaactaaatcatatactttaaaaaaaatcagttacaatggaggaagttcacctgtagtaggggtaaactgactaagtctcagagtgctgaaaaacagctatttgtacatgttatcatctggatagaatttgtcctagagaaactgatagagatgaatgtacaggaaggctaattttttaagacaggggtcagaaaacttttctgtaaacagcccaacagccaatattttagacctaaggacaatgcagttacaactattacactctgccatcacaatgggaaagcaagcatagatgtaaacaaacaaacttctatgactttttttttaaattttaatttaattctggaatacatgtgcataacacgcagatttgttacataagtatacatgtgccatggaggtttgctgcacttatcaacccgtcatctaggttttaaccccacatgcattaggtatttgtcctaatcctcccctggtcccccactcccagacaggcccaggtgtgtgttgttcccctccttgtgtccatgtgttctcattattcaactccctcttatgagtgagaacatgcagtgtttggttttctgttcccatgttagttcgctgagaatgatggcttccagcttcatctatgtccctgcaaaggacatgatctcattccttttcatgcctgcgtagtattccgtggtgtgtatgtgccacattttttttttatccagtttaccattgatgggcatttggactggtccaatgtctttgatattgtaaatactacagcaacaaacatgcatattcatgagtctttatagtaggatgatttctaatcctgtgggtatatacccagtaatgggattactgggtcaaactgtatttctggttctagatccttgaggaatcaccacactgtcttccacaatggttgaactaatttacattcccaccaacagtgtaaaaacattcctatttctccacagcctcaccagcatctattgtttcttaaatttttaataatcaccattctgacttgtgtgagatgatatctcattgtggttttgatttgcatttctctaatggtcagtgataatgagctttttttcatatgtttcttgatcacgtacatatcttcttttgagaagtgtctgctcatatcctttgcccactttttgatggggttggttgttttttttcttgtaaatttgtttgagttctttgtagattctgggtattagacctttctcagatggatagattgcaaaaattttctcccattccataggctgtctgttcactctgatgctagtttcttttgctgtgcagaagctttttagtttaagtagatcccatttgtcagttttggcttttcttgcaattgtttttggtgttttagtcatgaagtctttgcccatgcctatgtcctgaatggtattgcctagtctttcttctagggttttatggtttggggttttacattttaagcgtttaatcaatcctgagttaatttttgtataaggtgtaaggaaggggcccagtttctgttttctgcatttggctagccagtgttcccagcaccgtttattaaatagggaatcctttacccattgcttgttttttgcaggtttgttgaagatcagatggttgtagatgtgtggtgttatttctgagatctctgttctgctccattggactataggtctgttttggtaccggtaccatattttattggttattgcacccttgtagtatagtttgaagtcaggtagtgtggtgcctccagctttgttcttttcgcttaggattgtcttggctatatgggccattttttgttccatatgaaatttaaagtaggttttctaattctgtgaagaatattaatggtacttgggcgggaatagcattgaatatataaattactttgggcaatatggccatttttacaatattgattctttctatccattgattctttctattctttttttccatttgtttgtgtcctcttctatttcattgagcagtggtttgtagttctccttgaagaggtccttcgcaacccatgtgagatgtatttctaggtattttattctctttgtagcaattgcgaatagacgttcattcatgatttggctctctgcttgtctattgttggtgtataggaatgcttgggatttttgcacattgattttgtatcctgagactttgctgaagttgcttatcagcttaaagagtttttgagctgagttttctaaatatagaatcatgtcatctgcatacagagacaattcacttcctttcttcctatttgaataccgtttatttatttctttatttctctctcctgattacccagaccagaacgtccagtactatgttgaataggggcagtgagagagggcattcttgtcttgtgccatttttctaagggaatgcttcccacttttgcccattcagtatgatactggctctgggtttgtcatcaatacctagtttatgttccatcaatacctagtttattgagagtttttatcataaagggatgttgaattttattgaagacctttactgcgtctattgagataatcatgtgatttttgtcattcgttctgtttatgtgatggattacgtttattaatttgtatgtgtcgaaccagccttgcatcccagggatgaagtcaattagatcatggtggataacctttttgatgtgctggtggattcagtttgcctgtattttattaaggattttcatattgatgttcatcagggatattggcctgaagttttcttttttcattgtgtctctgtcagcttttagtatcaggacaatgctggcctcattaaatgagttagggaggagatccttcttttcaattgtttggaatactttcagaaggaacggtaccagctcctccttgtacctctggtagaatttgtctgtgaatccatctgaccctgggctttcttttttttttttttttttttttttttggttgttaggctattaattactgcctctatttcagaacttgtttgtctattcagggatttgatttcttcctggtttagtagtgggaaggtgtttgtgtccaggaatttatccatttcttctagattttctagtttatttgcgtagaggtgtttatagtattctctgatgttagtttgtatttatgtggggtcagtggtgatatcccctttattattttttattgtgtctgtttgattcttctctcttttcttctttattagactagctagcagtctacctattttgttaattttttcaaaaaaccagctgctggattcattgattttttggaagcattctttgtgcctctatctccttcagttctgctatgatcttagttatttcgtgtcttctactagcttttggatttgtttgctcttgcctctctagttcttttatttttatctttattattatactttaagttctgagatacatgtgcagaacgtgcaggtttgttacatatgtatacacacaccgtggtggtttgctgcacccatcaacccgtcatctacattaggtatttctcttaatgctatacttccccaagctccccattccccaacaggcctcagtgtgtgatggtcccctccctgtgtccatgtgttctcattgttcaattcccacttatgagtgagaacatgtggtgtttggttttctgttcttgtgttagtttgcagagaacgatggtttccagcttcttccgtgtccctgcaaaggacatgaactctagttcttttaatagtgatgttacagtgtcgatttgagatctttcaagctctctgatgtggccatttggtgctataaatttccctcttaacactgctttagctgtgttgtctctttgttctcattggtttcaaagaacttcttgatttccagcttaatttcgtgatttacccaagagtcattcaggtgcaggtcattcaatttccatgtagttgtgcagttttgagtgaatttcttagttctgagttctaatttgattgcactgtggtatgagagactgttatgacttttttttttaatgttcaaaaaacaggtagtgggtctgatttggcccacaggctatagtttttaaaccctcttttagggtgacatttaatgatatcaggcgaaaggagaaataagcttaacaacagtggggcaaaggccaggccaaatactcttttcactttaaacaatgaattgggcttaagaccacagtcagccttttcttttttcattccttcctaactctaccaaaggactactctcaaatactcctgttgagtctttgtaattgaataggtctgttcatttatgtaacttagaataatataattaacttaaaaagataattatctaagaaaataattgagctaataaccaaaaagcacactagattccactattttacctatctctttatatacctgtgtttcctttctctagtttcatgattgcaatgtaacaaaatccttcttcaaagaaactgcataacctttgcctgtaaattctttacaacatagctatggcctagtcctttcagatgactgtataactaggaaaatgttcttacagaaaattaaggctacttcttattttgaagctttaagtaacgtaggtcagaagatataggtcagtaaaggacacacagaaactgcaaattctcagagagccctaaaatgttttctgaataatttatttgactgaaatcatgtggtgacctataggctgcaaaatataaatcatatgatcccactatactatctcctggtttggcttaaatgtggaaaatcctgactaatatagcacgcaatgatttttaaaaatacggaatttcccagaggaaaatataataataagctctttggcttggactaaataatattgaaaatatacattttcatgctttcctaacattatacagattgtgcagccagtcaatcgatgttattccattatctcagttgcatttacttctttggagtcaagacctttgaataaagtagttatacaataaaaagagtccatcccacgctttaagtgatactggtgcttatgggagaaagccattgtgagttgacaggtttgtacctagtctttcaaccaaacagcaaccactgggagttgacaggtttgtacctattctttcaaccaaactgcaggtatcatgttcaataaagctgccagccttttcactgaaagtgtacttataggcagaaaaataactattaaaatgactccatatggagtcttggggctccatgtttattctctttcagtgatttccagatcagatttgctcagtttataagtaaaaagattttcttcctagctctcggtccaggaaattcccattaggataaaaacatagctgtattcactcaacctctgacactatcacttggaatgacatttctgcaaactgagtttcagacaaaatcatattgaagtataaaccaaaagctgcatcagttttaccaacttccccgccacttgtaatacatttgttgccttctattattatggaaatacccaccctgtccctttaccccaagtaaaaataatattttaaatgacagtgaagagctcaaattcttaaatgtgatatcatatagatcatttatcccataactcttaacacatggtagaattcagattagattcttacacataatgtaactatatttctaggaagttcttaggctatatagcatacattgaagtaatcgccaccaaagattcagttaatagttgtattagtcagagttctctaaagggacagaagtaataagatatacgtatatatgaaggggagtttattaaggagaattgattcacacgatcacaaagtgaagtcccatgataggccatctgcaagctgaggagcaaagaagacagtctgagtcccaaaacctcaaaagcaggggacccgacattgcagctttcagtctgtgactgaaggccaagagcccctggcaaactactggtataggcccaagagtccaaaagcagaagaacttggagtatgttgttcgaggacaggaagtatccagcacaggataaagatgaagtcaagaagactcagcaagtctgctccttccaacttattctgcctgctttgttctagctgcactggcagctgattagatggtgcccacccagactgaggacaagtctgcctctcccagtccactgactcaaatgttaatctcctttggcaccacccttacagatacacccaggaataatactttgcatccttcaatccaatcaagttgacactcaatattaaccatcacaatagtgttatagctaaatgtctgattgaaacttttgaaaagacctatccaaaatatgctagaccagaattattaatggcattaaatacagaatccctgcttagtggtccatatctaaaaattcagcctgatccaactttacgttccttccaccattatcccatactcttagtatccattcccatgccggttctccagatttctgcttatataaattagaaaactgaaacagttgttttggagtatagcacactttctcatgggtcactaactagtatactctctctggtccctcttttatagccagtatattatgaaatttgatgagttaaaaaggaaaaaaagtatatgtgattctttcaaattgttgttgatcttagaatttttgggctattttcacacatttacaaatactagcaataaatactttccatagactgtgatactcactctgcataacattttaaaacactggctcaaccattttatataaaaagccaactgacaatcctttaaaaaatctcaaaataaggaccatatggctgcatatggctgtacagttacttaatataactggtgtattaattttctatcattgtgtaacaaattaccacaaaatagtagcttaaaacaccactcatttattagttcataattctgtagaagtctggcaaactatgattgggttctctgggtagaatttcacaaggctaaaatctaggtatttggcttgagtttttatctggaggtgctggggggaattttcattccaagctcatgaatgttattcacagtattcagttccttgtggttttagactgtggtccccaattctttttttatatgtactttaagttctggggtacatgtgcagaatgtgcccttttgttacataggtatgcatgtgccatggtgctttgctgcacccatcaaccagtcatctacattaggtatttctcctaatgttatccctcctctagccccccacccaccgacaggccccggtgtatgatgttcccctccctacgtccatgtgttctcattgttcaattcccacttatgagtgagaacatgcggtgtttgcttttctgttcttgtgatagtttgctgagaatgatggtttccagcttaatccatgttcctgcaaaggacacaaactcatccttttttatgaccgcatagtattccatggtgtatatgtgccacattttctttatccagtctagtattgatgggaggtccccatttatttactggctgtcagctgagtgtcactctcaactactaaaggtcatttacattttttgcatcatgtccctttccatattcaagctagcaatgacatgataagatgttctcatgtttcaaaccactgacatcttttatgactagccagagaaaatgctgctttaaagggtttatgtgattatgtcaggatctcccagataatttccctatcttaaggttgactatgccatataacataatctaatcacagaagtaagattcacaatatttacatcccaggtacagtgcaggatgcgtatatggtgggggaggaggaggttagtggtaaattgtgggtgccattttagatttccatctaccacacttaggaaaattggacttagtattattaattcatttaataaatagtttgtaatcccctactatgtataaggtgctgttctatttgaggagttattactttcaaccagaaattaaggtttaccttattttataattctgtaacaatatatgacagtgtcttagaacacaactttggtatgaaacagaccagagttgaatctcacttatatcattactggctacataatcttggatgcgttatctgagcttgtttctttgtacaaaaagtgagagtaataccagtatgtatttcacagggttgctgtaagaattaagtgagataatggctgcaaagaatttattaatagtacaatcttaatatatcaatcactgaataaatggtagtaagaagtgctgttacatgacttttgaaacacatatgacaatttggctgtggggtatttatatttttttctttgcaagatcaggcaaaatatactttatattcccagttttttctttcactgtaaactccactggaaggtatgttgatattcatgtttatggcaatgccttcaggcaccagttactataatatatatcaaaattacaattagctgaggccaataatactgaccctttatctgaaaagaatggcagctctgtagtgcttggattatctcagttcaacatttctttagctaagtggtctctgaaggatcattcttcctcttattataatagaaattagaaaaatgcacacacacacacatgcacacacacgtgctcactatgctcatcataattgtacctcaatatcaaagaaggaatgatgagaatctaaccactgaatttcactaatactgaaaacaccagtctctcattttagctgatagattagaaaacttttcagtacgttttaaaaatggctactttctaccactaagcacgtagtctatgagaaatcaaatttactaaaagataagtttaacaaagttcacatttgacgaagtacagggaaatgtacaaaaggcaaggcttggcagagcaatttatgagttttcactaatggagaactattctaaaatcaaagtaatacttatacttgtttaccgtctttatacagataggccaacaaccaactgccacatcttaaactcttgaaacaaatattttccatatggccttagagaaatagagttgttacataagttaggaaggatgatcctttatatttatcctgaaatttaataacgcagaatattgatcatctaatttaaaaactgacattaaaagaaggatggatcacattattgttctcattttcatcataattttgcttaaggctgaagttataatgacggagtgtctgcagcttacatttggtggcatcagggcctattacagttttaatttgctgattgcatttatttacaacagagctattccaataaacatgtgccaatggtttgttaccagggagatggttagttaccagggagattcaaagttgataaaagtctattgaagatgatgctccaatacaatggcattaaatacatttatacatatcaatactaatgtgcaatatttgaagtgtgagtattctattgatgatagccagtctctaccccaatatcctccagatactcatagcccacttggagtcttcagataggcactgaggcgcatagacagtcaactccatatcttagtcatcaaattaaagatttggtgaataacaacagcactgcaagctatttcttgagataactctatagaatttgaggcagttcaaagcagtccctacccagtgggttagccaatctaattaagcacctaattttgaaaatcgagccctcgattttattgcatactaagcagatggcttattgcaaaatgggggtgggaagaggtgggaatgaaaacttaaaaacttaacaaaagttacttgataagtcactctgacagtaaaaactagcagaaatcagataacaatataaactatgacttaatgctgacctttgagagtggccagcacactaaaaataagtcattttaattaaatacagatgatttaagagaaatcatatgcttctggcctaacataggtggattaggaaaagggaatattattagtcattagtacttttcattaataatttctggttctccttctggacaaatggcagaattatacttcctgtctccttggaattagatgtggccttgtgactcattttgatcagtgaaatggtgacctgtggcattttcagatggaagctttaagagccagtgtgagacttactgacttctttccttttctttgctacagtgactggcaatgtttgggattgcagaggctccagtagcctgggaaggtgagaaataaactttgatactttaagccaccaaaacattgggattctttgtttccaaaatatcctcctggcctatcctgattgctacagaaaccattgagctgatttctaggcgaagaaatgataagctaactaggatgaagccttatttctacatatgaggaagatgggcacaacatccagctctttccttaactttggaccaaaaaaaaaaaaaaaaaccctcctgaatctggatccaaaagttgttgtacacacttgcacaagttgattagtgcttgtagtttatgcttttatgcaatatttgcattgcagagagagtttcaagtaaaattaagaataaaacatacagcaaatttatttaaagtcctcctcgaacattaagtcataggaccaaggtcatgcatataactgttttggttgtatcatacagctattgatttttttttcagttggtattatttaagacagaagaatctctcccatgaatagtcaataagttttttacaagatgacatcatcagctatactatcttgtcttaggatactggcctaattttatgcattaaatgtagttatggaaaacacagtcttggaaactaaatgtgtacattaaattatatttgcttattgacttccattataattttagagtttatttcctattagaaagcatgcttacttgaaaatagaatatgaactacattttcaaagcctaacattcactttgagtggtattatcttggtctatgtgcatttaactatcttatgaaatatctcacagtaagtctgccaaatggaaaagtcattccttttttctattgtttgttcactgtttcttcaactaacatctactgcatgcattctatgtactatggaagataaaaagataaataacacatggttcctaccccaggaaagatcatttcataattatttagattatatattgaatattaaaattcaccataattattttatatccttggaaactctcatttactccgttaaacttaaatttaaaattaagtcaccacattgacacttcatgcactcaacagagctcactagttaaaaaactgtcatgaatataatttccattctgaattcaagaatttttaagtgattattacgtattactagcaataatgatagtaaaatttttaagtctttggaaagtgcaaggcataatatcattccatttttcttcaataacttttactaaatagtcaataactaagtatttctattactgaaacacagaccgaaattgtgtgaacagcagcagaatagatcttactataaagaaaccaaacttcagaaagctcaaagcattaagtaacatatgtacatctaatcagatgaaaggttgagtccagggacattgtctgaggcagcaaattcagtaacaggtataggcttgtaagctgtagcatacaacaggacagacgagttaagaaaaatggttcttaatccagtctatcattgttggacatttgggttggttccaagtctttgctatcgtgaatagtgccgcaataaacatacgtgtgcatgtgtctttatagcagcatgatttataatcctttgggtatatacccagtaacgggatggctgggtcaaatggtatttctagttctagatccctgaggaatcaccacaggcctgttgtggggtggggggaggggggagggatagcattaggagatatacctaatgttaaatgacgagttaatgggtgcagcacaccaacatggcacatgtatacatatgtaacaaacctgcacgcttgcacatgtaccctaaaacttaaagtataataaaaaaaaaaaagaaaaatggttctatgaagtaaatgactatggtggtgaattatgaatgtggtatgctagctgtttaatgtctaaccactttacattcctttctattccttgcttctcactgctctcagagagagggggagctctgtaagaattcttctgaggttccacttgttaaggtaggcctgaaaaatgcaaagatagagacctgttgctaagtttcccaggatcagtcttataaaccacattttttcctcagtggataaaatcttagaggtccacccagattcatagaggtgcccccagatttcctaggtatgaaggctttcctaaacacaatatggatttctttatgcctttgaacagctactgtctaggagagtgaggagagtcacatatggactttcaagaagaggagaagaactgtatgtgaacttccacaaagggttagacattcactctggaagtgaggcctattgtatggctgtctgtaaaccacacaatgaagctctgtggcatcttgagacatggcccactttccttggtgcagggttgccactgtcatgtgaatagtactagaagtccataaaacaagagatggaaagcaggaaagttggttacagcatgaaaaattaagaatcagtgtgcaagagcacaagacttgagataagctctgaaactagaactgtggctatttgctttctgtcctattttatacgtcctgttgtatggagttaggcagggtttttcaggcaagtgtttatagccagcaggaggggctgggccctgtaggtgcagctagctactgtctaagctaagggcaaaggcacgggccttttgggaggtacttacatcagtctttaaaggatctttgccactttggcagcacctttgatggcaggagagatgctgcaggcaagattccacctggtggaagagcctgtgcatgagcacatgttagccatacagatacgtaatctcattcactgccttactttattaattgaataaaacccaaagcaaaattaaaccaatgcaaaagcatggcaaacttgtatgtttaatatcatattaatggtcttgctgataaatatttacgtcatttattcatgattaggacatctttttatatagattagaaagacatacaaatggtaaggagcatgttctcttcaaactcttgagagactaatattaagtactgcccaggtttactcaactgacattcagttgtctacattttcaacataaaagtgagtgaactaaaggcagttttaaaaatctcttctaaaatcagtgtatatcaatcagttttgggagctacaagagacttcagcttctagtatgtcaacaaccctccattgctcaaccttcatggctttggggacctgcttcagtgctcctagtctttcctgtcctaatggtacaagtggattatatcaaggaaaacttgagattgctggaggcagcactgattcatctgtggaggtcaagggctgtacagccatgactttttgcaggttgatagcgccagaatcttaataagaggacccatgttagtgaaagaaaggtgactgcagcagctattcactcaaccctgaaaggctgaaaatggggtcacctgtcttggtatttcaattagggggttacagctactgctgccattgctgcttcaatcatttgctcattttttttcctgagaaggtacttctgatcctgggtctcaggacacctttttgactgggagtcttctgactgttggtcatcagcaaattgaggagcagggggggatttgagggagaacataaagagatgctgtggatgtatttcacatcttagataaaatttcagctgtgatctgtgtaggcagtagatattgctaataaaaaattctgctgtgaaaaaaattttttagtttgttctgagtatccctggatgagtactacagagcataatttgctctgtcctcacctaatcacagtagggtttggggcttctacattgaagagtgagtgtggtccttgccaaagagcagataagggaaataatagatcatctatttccctagggcaactaacactctaggtcttctacatctcaggatcccagtttcttcaggtttaatgtctaaaatgaggtgaagctcacagtctgaatccaattatatatatatatatatatatatatatatatatatatatatatatgatatagattaatataatctctatattatattattaatataatagaatacagatattaaacatatatatatggctgtattttatatgaaaacaatcattctagaggatgttgtaagctatttctagattttttgcaaaataaaacttggtcattatataataactgacaatgataatagttacaacaataaataagatactgtttttcaatggtgactacatgtacatgccagtcactgtgtcaggctttttccctttatttgtaactaaattgcaataggagaatatatcatattatgggggtagggataactctggccatctcagaggaaaaaacagaaaaagagaggaaataaatgacattaattatgtttgctttgctgaagagtgtgtgaaacagagaagcaatccaagaagccacacatatgaagatgataatagaaacaataataaccatttactgagtacttatgtagcagttatcttattaaataacaatacataaattatattgtttacttcccaggaaactggcgttcaaggaggtgactaatctaaggtcatctagctaagtgacagagacagtattcaaactaaggtgcctctgactccaaagactattcaaacttccagactttgctaaggacttccaacaactgcattatactgataaaagttgcctgtcagaacctgcacgttgtgcacatgtaccctaaaacttaaagtataatattagtaaaataaaaaaaaagaataaagaggatgttccataactcagtctgtgagtcagacaactgaagaagcctaccttctgccacataggtaagtgaggagtgtctccaagttcatttagtaagctggagaaatattactttctgcatgaaaatactagctcagtagattttttaaaaatgtactaattacatgtttttaaagttaactctgtggtaagagaatttgtgtgtttcatacattcccatgagtgttaggaaaggataaaaagccaacaaaggccatattctcacgaacaagagagcaattcccattggcaacaaaatactgaaattcgttgcaatgatttgttacagagagtatactagcctggaatgcactgattgtcaaggaaatggatctctgaatttaaaagaccagtgccttttagggaagcagaaagagaaggtattgccctaatataacagtatcaaatctcaaaccaaagagatttatggagcagaagaagtcttgattgccttctatagaactataaaagctcaatgtgctaaagaaaacctttggcttcttttgagccactcaattgtttgattattgtcatgttcatcatcatcataactgaaatgtgttgaatacttaacacatgttgagcactatacatataacaattcatttaatccccatatcacactatgtggtaatgactattactatattattttatatttgaaggaacagtggcaattagagattagattacttgcctttggtcacaaaggtagcaaattcagatctggaattctttacttgggcaatctgacttcagagatcttctaaaccactatactacacctactcctgaaactgaaatggtaggtattattatcactatcattaacctgaagcttagtcaattttagtattagaataatattcatggttatttgtcttccttgggctggaagtgggtacatatattgaatggcagaagatatgattggcagcttccctaacatgaacagaaatgggtcaactataaacagtctgagcaaaagaaggtattaagggtacaccaatatatgcgtacaaaattaattgcttgaaagaaggaccattctattctaattgtataatgctcaaatggtctttccatctgtgctgctttttggctaagggataaaaagaaataaaaataaaagaagcagaactgcaaaaagcatcccactgcaaataactgctggaatcttaatccgaagataacataggtgtatgtattttatgaaagtgactgctactcgtatataaatcatttggaaaattatatgcattgtgattataagtttttgacataaaaataaaattcaattttacaaattctagttccactaatttgaaattatgatattgattgtcacaatttattaaattcctgctgtgatttaggtactaaactgtggagttaagcctaagttaacttctttacattttattttaaaagctacaaagtataatatgtatatgcttattttacagttaagaaacgtaggctaaaataagcaattttccaaaaatcacactactggaaactaggctttcatcttaatggggaaagaatagagtctaatacttttgacctactgtgtgcccagtactgatctaggcaattcacaaacattgtctcatttacatatatattcaggggaaggatacaaataatataatataatagatcacgatagtagctgctgactgtttacttgctggaaaaaaggtttatggtcaggtgaaatagtgaataagcaaattttactctcagagacctttcttctttggtcagactgatcaaatgcacattgacagctcctgaaacagcaaatagaacctcagaacatgtttaggtatcagcattgtgttgtacatgaaaccatgccaccttgtttaagcagtggactatgtttctgagccgcataggcacatagctcaaaaaaacactgatggccaaaccatgattcccaaaatataaatgtatacagtagagatggttttgaacatgcctagccaataatgcaagttttagttctgtccggagagacaagggttacaaagagtttctataaaatattaataattttgcatattcatgacctaacaccaaaaatatcttttctcttttttgtaattctcagagagcagtttaagaattttacctaaagtcaccgtgcaagggggatgagctccagggactgtcatttttcacaggtgtgttttggattaaatttggataccttgttaaaaaacgagttttctttttctttctgcagagcacgtgtttttaccttcgtttttatagcaagtttaagaaaccattaataaattagccatcagtgactttaaaatcaatgtgtttctggccattgagaaaacctgttcacgtgttctagtggtgattgtttgctattttggggataataaagtgttgaatttttttttttttgagaaaggaatccagcagagctctgattaaagaggactttctaataaacagcagtttgaaacaactgctctagaatttaatagcccctttgcatgcaccagaattttgagctaaagctagaatataacaaagtcataaagggcttctcctatattcaagtcacatcaagatgaacccaaaagagcaccctcgcattctttcaacatccttcctctttctcttacatacatgaaatatcccttcttcacctgctacttcaaatacccattcattggtggataatatcctctatgatttgaaactcaaaatgtggtctgtggatttacatcatcagcatcacctgagcctttgttaattacagaatctctggccatacctcagacttactgaatcagaatttgcatttaacaagatttccaggtgattcatatgcacattaaagtctgataagcacagctctataatagagtttctcaaccctggctcaccattaaaatatacatagaagaggttaaaaaaatactaatgcctggccctaaccccttctgcccttttccaccaaaattcagattaagtgtcttggtgtgaagtccaatgattcatatatatatatatatatatatatatatatatatatatatatattcagatgttcagttatttcaactatttgccctaggctatagattgtccagctttgctgtattcccattcgttcttaacttcaatttctgataccaagttgctatattttatcttatttttgtaaataatggtcaatgtctttgagagacaaattgaattcatgttgctttgtcactgggcataattgtctttaatttctgttcttaaatggtggctaccagcactctcagatctaagccctgaatatttggcatgtgactagtttgggcctagctgggatgcatccctaaaatgggcaaccaaaaaatatctgacatgacaataaactatattcagtaagagtaggatttctaattacccattcaccttgatttgacagctattaactttgttattaaaatatacctaatgatggccaagatgatatttacaaatgtatttgttagagctgccatctatacaaaatgtcattgactcttcttggttaatcatatttagtaaatcctcattagaaaaatgacaaatactcttttattaagatcactaaccacaaagttatttgttattcatattgatataataggtagttccaaaggaattatggattaagagaaactttagtcataatactagtttatagtttccatgttcattatgcaaaatttagtgcaaatgataattcccagtcatattaaatgaacaggaaaacagaaatgatcacattttcatgaaagtgattaaagtgatattttcaccttgaataaagcagaagcaatacactgacagttttcattatactcactgtatcacttctcgagtagaaataaccatctcaaagctatatatgcatgtcacttttgaaatacagtgtgtgtgtgtgtgtgtgtgtgtgtgtgtgtgtttgtatttattttttatggttttgtcgaagacaaatttttaggtaattggtacttataactgctggcatagcattgaaaatccaataatttctcatttttaaatagttaatactatatttaaataaattgtttttatttattttgttttagtttagtatttgtgttgttgttatatcacagcctcgcctctacttccactccaggaaaagtcaaagtcacaaataatacccacagaccaaattagatttagatttttttataccaagattcaaatgctaacagatcaagatttttcaggtcaccaaaagaagggacttcaaaaaagtccttaaatcatttctgttctccaaggcatggcatgtgttgtactgtgcaactctccatgtgtacatcttataatgaaagtacagaacactctgggactgtgcacaaagaagataccaactaatgagatcactgcagcatttgtctacggcatccttttggaagttgataataagcagtgaaaataacacctttagtgccccaaaacgttgtttggactgaagtaacttgcttgcagcagtcacgatcaacttgagcaaactaaacacaaaataacaaaagcttagacccagagtccttggaagcttaccaataagactctgaacttgaatagcagtttttttctcaatatagacaacttttctgctcagttttggctgcggaccaaaaactagcacagtagattccaacttacccatgttattgagttaaatcacagatgttagcacttaccagagtactaggcatgcagtaggggctcaaaaactgacttgtgaatccaatttaaaattttgtatctgaaaattgagtttgggaaatgggtaggtaggaaagggaggaattgcatttgactctaataacagtgccaattagagactggaatgctactgttggagggaccgtattgccagacgtactgagattacctgaaggcaaataatcaagtagctatgatcttgaattgttcatgtcaggaaaatctcatctgaatcgaacccctgtctttctatgattgtgggttctctctatccgatgtatactaggttcttggattctaagtggtaataagtgacaatgccatgaggatgcactagtagcccttgttatgggcctgtaaatgcacaaagctatggcaatttggtcgtgcaatatattattttgcaatgtcgttgagtctacaaggttggaggaattacttctctttgtctctttcccttgctgcttattttgactctttcttcccacttaagtcacaagcagctaagttatattcattcttggaagctgtcttgagaagcctggagtacatggaagcagatattgtggcaaatcctcagccgccccttcctctctccacctgtctttcccttgctccttccctctcttctttctttggttcagctgacacgggatggctagaagtggtgtccccacacaggcttgaaaagatctagggtgcgacataactcactgaggatccacattgtaatatgggaagaatcataatggtaatatagttacttaacctggttatgtcacaggtttcttatctctaaaatgtagataaataaaggcatctacctcaaagacttacttcttctaagcattctataagaatgtatagagtgtgcttaaaatagcatccaggcttaagtaaaatctacgtaaatatttgattttatttcaataatttctaccaaaaaaaaggtggggtcatgtggtctgagcataaagatagtcagtgacatcttaatggctttatcactgtccaaaacatccaccaaaccctggtgccttcctaggccactgaagaaataccctggctccggcgaatgttataagaagataagaggtcttcatgtctaccagccagctattcctaatccaattggtgtatcttccttctgtttcaacgattcttatatctaggtatgatcacagtgatgtaaatcacattttttgtttttctacttttaagttcaggggtacatatacagttttattatataggtaaactatcatgggagtttggtgtacagattatttcatcatcatctaagtaatatgcataatacctgatagacaggtttttatatcctttccctccttccaccctccaccctcaagtaggcccctgtgtctgttgttcccttatttctgtccatgggtactcattgtttagctcccacttataagtgaaaatatatggtatttgcttttctgttcctgcattaatttgcttaggataatggcctacagctccatccatgttgctgcaaaggacatgatcttattcctttttatgactgcatagtgttccatggtgtatatgtaacatattttctttatctaatctgtcattgatgggcatttagattgattctatgcctttgatattgtgaataatgctgcaatgaaaattcacatacatgtatctttatggtagaatgatttatattcctctgggtatatacctagtaatgatgttgctgggttgaatggtagttctgtctttagctcttcgaggtattgccatactgctttccacaatgattgaactaatttacactcccaccagcagcatataaatgttcccctttctctgcaacctcaccagcgtgttatagtagttctgactgatgtgagatggtatctcgctgtagttttgatttgcatttctttgatgaatagtgattattattgccttgcctattcaggctctttatttaatttcgttttttcatatgcttcttggccacatgatgtcttcttttgagaagtgtctgttcatgtccttgcccactttttaatggggttgctttattttgcttgtgaatttcatgttccttatggattctcaatattagacctttgttggatgcgcagtttgcacatgttgtcttcccttctataggttgtctgtttactcttgtcatagtttcttttgctgtacagaagctctctagtttaattaggtctcatttctcaatctttgttttttgttgccattattttggtgacataatcacaaaagctttgccaggtcctatgtccagaatggtatggtatttcctaggttgtcttacagactgcatttctttttttttttttttttttttttttttttttttagttttgggttttatgtttaagtctttgttctatcttgagttaattttcatatgtggtttaaggtatgggcccagtttcaatattctgcatatggatatccagttatcctctcaccatttattgaatggggagtcctttcctcatcgcttgtttttggcaactttattgaagatcagattactgtatgtgtgcagcattatttctgggctttctattctgttccatttgtctatgtgttttattttttgtaccagtaacgtgctgttttggttactgtagccctgtagtatagtttgaagttgggtaatgttatgctcccagttttgtctttttgcttagaattgtcttgcctattcaggctctgttttgattatatgaattttgtaatagtttattctagttctgtgaagaatgtcattggtagtttaatgggaatagcattgaatctgtaaattgctttgggcaatatggccattttcatactgattcttcctattcatgagcatgaaatgtttttccatttgtttgtgtaatttctgatttctttgagcagtgttttgtaattctcattgtatagatctttgaccttcctggttagctgtattcctaggtattttatttttttgtgggctttgtgaatgggattcccttcccaatttggttctcagcttgtatgttgttggtgaatgggaatgctgctgatttttgtatattgactttgtgtcctgaaactttgctgaagaagttgtttttcaattcaaggaagcttttggtagagactattgggttttgtagttagggaattgtatcatctgcaaacagggatggtttgactccctttcttcctatttggatgccttctatttctttctcttgcctgattgttctggccaggacttctagtactacgttgaataggagtggtaggagtggtgacagaaggcatccttgtcttgttctagttttcaagaggaatgtaaagcagattctttgaagagcatgtaaggcaagtgtccttggtggatttgacttctggttataatctggcctgaaaggaaatactgcaagatgtacattgttggcctggcgcatgctgatcactctgacaagaaagatctccctctatgaaaagaattcacctagggacataggggtgtgtgtgtttgtgtgggcgggggggggggtgggggaagtgggggggaagaagacaaagagatacggagacatttgttttctagcctagaaacaaatgctaagcagtcttatctatatattttccaattcagtttttcatacccacggaattcagatggttggacatgactgaaccctggtttcaacgtaaccgtgtaaaataattgctgtttttcacattttaaagaaggatttcagacttgaagacaagaagctcctttctcctcaatagtgctcactcttctttagtcaaattttaaaaggctctgagctgctaatctgtacaaatataaaatacgaaaataaaatgaaagagctgttcaattattgcccggcatcataataagaaaacatactatctatctgttaactttctctttcacctctaccaagttcaccctttcacacctatcctcccttcagtgtgtgtgatgcagttgctaaaccctattacatactgcagttcttttattaaggattgattgggaaaatctacttgccttaagatgctattatggttttgattaatttgactaaattaatatagagagttaatatctagaaagaaatataaactatctagcgtaaagaacaaaaaccatacacctggaaattaaccctccaccaggaaatattagtattaagtagcacctggtacattcttgatttaggcccttgtgattgttctacaggaagatgccaactatgtgcagaataatgtttctcaggttatatctacattcataaagcattttaatttattatgattttattttattacaaaactgcttagaattcagtaattgacagattgtttcaaacatcactaagctcaacaatgtttgcttctctccaaattattctgtatatttaagcggtgcttctttactgagctttctaaccatatttaggtggcattcaagtacttacccattgtgcagataaaatgaaataacgtgtataaaagcacaataatataatatgtttaatatgtatgtgctccaaacaatgcaagtgtgagatagcattattaccatgtggcattcatccaggtggatgcaatggagtccaaatgaacctacctgtgccttggcttaagctctgttcctatatctctgtcccctatgatatccctggaaaaaataaatgctcccagaaacctgatgtacaaagcttcccaagtgtcttaatataatgggaatttaaatggaccaccactaaatggagctattgtgaatccaagtactgcttaaccttgtttgttagtcttttcaaagttattaatgacctttaactctcttcaaaattatttaactactctatctggacatgaatacacactctgtttccccctctctctctctctgtaaaatgggaatacaagttctaactcaattttggtttcatggtgataggaagatgggtttatttttacaaaatactttgtagtttaaaaggtctattccaacattaatgagtattattagaagatggcattgcagcttaatgaagtgatgcctcaactgacactacagtttgaattcggatcagccaattttaagcccactgagtctgaatgctcagatgtccattttttcagtcagtaacagattttgctagggttcatgtgctttaacagattttttcttggctatgtttatagtaaaaatgtaatagtaaattatgagcactgtaaaacagtgttgttcatattctgattctcccattagaaatatatggtcaaaatgttagaaaaaaattgtaacagaaatgtagagttattgtctgtctaggtaaggtattatgcttaataaataagattagtattttcattaagagtaaaacattgaaagttgcttgtaaatgaatttacgtataatagtcccatttttctattgactttcactgtaaaattacagatttgtttctctgctctccacaatggtcccaatacacaataatatttgaagatgcaacagtactttaatatgattcatctaaaggaaaatgttgaattttatacaacacagtatttattacatatatttagcatatcctaaatgtagttatgaatagaatacaagttcatgagctttgaggttatcatattaatattataactaacaaaattgggaaagataaagaggaaaagttcatttattcatcttttacactagataacttctggtataaatttgtctccctgaatcttggcacattattttactttgggtgatacttagctgtattatttcctcacagttttataattaaccaaaggagaatgggagcaaatttagaaaaaatgaatgctaatactcaaactcactcacaaagtataaagtagaaaaggttgctttgatgtttgacacagcagcttaaagatcccaaaagggggggacatttgaagtaaaatggactcacaagactaaactgaaaagcactgtagcatctattagagcctcctccttccccataacctccagctagagtacacgcatctctcatttcacaggacctggtaacggattcttatttctagaaaatgaatatgttgatctaacatgaagatacataggtaaaaatagcttaatccattttggtaccagtaccatgctgttttggttattgtacccttgtagtatagcttgaactcaggaagtgtgatgcctccagctttgttctttttgcttaggattctctcggctatatgggctgttctttggttccatatgaaatttaaagtagttttttctaattttacaaagaaagtcaatggtagcttgatgggaatagcattgaatctataaattactttgggcaatacggccatgttcacaatactgattcttcctatccatgagcacagatacatagaccaatagaacagaacagagacctcagaaataacaccacacatctacaaacatctggcattacacaaacttgacaaaaacaaacaacaaggaaagcattccctatttaataaatggtgctgggataactggctagccatatgcagaaaacagaaactggaccccttccttacatcttatacaaatattaactcaagatggattaaatacttaagtataaaacttaaaaccataaaaactctagaagaaaacctaggcaataccattcaggacatacataggcatgggcaaagtcttcttgactcaaacaccaaaagcaattgcaacaaaagctaaaattgataaatgggatctaattacactaaaaagcttctgcacagcaaaagaaactaccatcagagtgaacaggcaacctacaggatgggagaaaatttttgtaatctacctatctgaaaaagggctaatatccagaatctacaaagaactcaaacaaatttacaagaaaaaaacaaccccatcaacaagtgggtgaaggatatgaccagacacttctcaaaagaagacatttatgtggtcaacaaacatatgaaacaaagctcatcgtcactggtcattagagcaaatgcaaatcaaaatcacagtgagataccatctcacaccagttagaatggcaatcatcaaaaagtccggaaacaacagatgctggtgagactgtggagaaattggaatgtttttatactgttggtgggagtgtaagttagttcacccattgtggaagagagtgtggcaattcctcaaggatctagaaccagaaataccatttgactcagcaatcccattacttggtatatacccaaaggaatataaatcattctactataaagacacatgtttattgtagcactatttacaatagcaaagacttggaagcaacccaaatgcccatcaatgatagactggaaaaagaaaatgtggcacatatataccataaaatactaggcagccattaaaaaagaatgagttcatgtcctttccagggacatggatgaagctggaaaccatcattctcagcaaactaacacaggaaaaccaaacaccccatgttctcgcttataagtgggagttgaacaatgagaacacatggacacagggaggggacatcacacactggggtgtgttggggggtggggtcaaggggagggagagtattaggacaaatgcctaatgcatgcggggcttaaaacctagatgacgcgttgaaaggtgcagcaaaccaccatggcacatatatacctatgtaacaaacctgcacgttctgcacatctatcccagaacttaaagtaaaattttttttaaaaaaaaagaaataactttatccaaacagttacaattccaggtgaagcaacaaaaaactaaacaggagtgtgtttaataaaatggcaaatggacttgaaaagtatctcaaaaacattgtcaactgtttaacgagctggaccagtatacgcatctcctaaccactgtaggacactgaggaaacaatacattcatcagagatgattaatggtgctagtatgaccgtgtataacattttcctcacattacgctgtgacacaatggtaaacacttaggcatatcaaaaaataaagggaagattcaacattgctatgagttaagcatcttgttgtaagaacttgagtattgctacattaagactcagaccactcagatattccctacaggattgcaagagaaagttgaatatggcatctactaaagaataatttttgcttcaggcaattagtcagatttgaaaatcttgacctacctcatccattaaaatcatactctgctatccctatatacataccattcaaagatacatatttgatatgtgtacataccattcaaagatacatatttcacttctatgaagtacctcaaaaccagaatcactttctataacttgagattgtttttcctatttcttgtgcatccccattctgacaataaaatcaagtaccttcaagagcaggcacccttaatatgaaagtaattagtttgcaaatattttatcccattgtgtatgttgtctttttactctgttgatagtttcttttgctgtacaggagctcttaagttaattagataccatttgttaagttttgcttttgttgctattgctttcagtgtctttgtcatgaaatctttgcctgtttctatgtccaggaaggtattgcctaggttgtcttccagcgttttatagtttggggttttacatttaagtctttaattcatcttgagttgatttttgtatatggtataaggaagtattccagttttaattttctgcacatggctagccacttatcccagcaccacttattgaatagggagtcttttccccattgcttgtttttgtcagctttgtcgaagatcagatggccgtagatgtgcagcattatttctgggctcccacaaagatctcatattcaacatttataaagaaattaaacaaacttataagagaaaaacaaacaactcattaaaaagtgggcaaaggacatgaacagacatctttaaaataagacatacacgtggccaataagcatgtgaaaaaaagctcaatgtcactgattatcagggaaatgcaaatcaaaaccacaataaataccatctcacaccagtcagatatggctgttattaaaaagtaaaaaaatgacagatactggaggttgcagagaaaaggaaacacttacacactgttggcaggggtgtaaattagttcaaccactgtggaaagcagtatggcaattcctcaaagagctaaagagaaaactaccattcaacccagcaataccattactgggcatatactcaaaggaatataaatcattctaccataaaggcacatgcatgcaaattttcactgtagcattattcacattagcaaagccatggcatcaacttaaatgtcatcaatgagggattagataaagaaaatgtggtacataaacaccatggaatactatgtagccataaaaaagatgagattacatcttttgcaggaacatggatagagctggaggccattatccttagcaaactgctgagaccagctcagtcggggacaccctaacccagcagcgctagaggaattaaagacacacacacagaaatatagaggtgtgaagtgggaaatcaggggtctcacagccttcagagctgagagccttgaacagagatttacccacatatttattaacagcaagccagtcaattagtattgtttctatagatattagactcagatactcaactgaaagtatcccttttgggaaacgaagggatgggctgaaataaagggatgggttgggctagttatctgcagcaggagcatgtccttaaggcacagatcgctcatgctattgtttgtggtttaagaacgcctttaagtggttttccgctctgggtgggccaggtgttccttgccctcattccggtaaacccacaaccttccagtatgggcattatggccatcatgaacatgtcacagtgctgcagagattttgtttatggccagttttggggccagtttatggccagattttggggggcctgttcccaacagcaaactaatgcaggaatagaaaaccaaataccactgttctcacttatgattgggagctaaatgctgagaactcatgaacacaaagaaggagacagcagcactggggtctacttgagggtagggaatgtgaggagggagaggagcagaaaagataactattaagtaccaggcttaatagctgggtgataaaataatctgtacaacaaacccccatgacatgagtttacctatataacaaacctgcatcatgcccccaaacctaaaataaaagttaaaaaaaaaaaaacaaattactcatcactggatgtctttcatgtatatatgagatatggagttaataaacttgttttctcttaaaaatatcagagtaagtagtgcaatggaaatacatatgtccttaatagattttcatttcatttgcaaaataacagacatgcctctaattgcgaaagagagattaaaggagtgcagtgacagtctcgtactcagtctggcccacgcatctaggaacatctcaaaattttaggttaaaataacaccacagatgggtgaaatacagatgggtgaaatgtgtaagcatttctagactactgaagaagtaagattagccacaaatcatattttccaagtgtgtagcatgtggagtccctaagctctttggactctgtagctacatattcatttcttggaggtgtttctatgggtttattcccaagaggacccagcttcccactcattttatcaatcagctgtcattaactaacgtagaattagtatctgtgccaaaaccttcgtgagaaatatttgacccatgttaaaatagagttcattagggttctaatatttgaattattttctttccaattctgattcaaagcctaagtaaaacaactaaacattcaaagggggcctaaagaaagtgcagctcttaatgcctctggatcagtgatttttatccccaggtcccatcttgagattcttatttagttgaagacaatctgtaaatataatacatgcagttgtagatggccagcattccagaaggttaaaaatattattttagggatctctttgagaataagatgaaaactagttaccttcttaccatataaaacaatagtttgcatataatttcagtatcctggacacctgtggtctatccaaagggaccagtttaagatttggatctatgtcagagcagatcagtagaataaaacacactgaatgtgtaagtattctagttttcttcagaaaactttcactgatttataatttaatataattgtcatcagcctttacatcttattgatataaaaattgattgcataaaaagtttgtctttcccaccaataattcctatttctccatatccatgccagcatctatcatttcttgactttttaataattgccattctgacaggcgtgagatggtatctcgttgtggttttgatttgcatttctctgatgatcagtgatgttgctttttttcatgtttgttgatcatataaatttctttttttgaaaagtgtctgttcatatcctttgcccactgtttgatggggtggtttgcttttttcttgtaaatttgtttatgtttcttgtaaaatctggatattagacgtttgtcagatgggtggattgcaaaaattttctcccattttctaggttgcctgttcactctgatgatagtttcttttgctatgcagaatctctttagtttaattagatcccatttatcaatttttgcttttgttgcaattgcttctggtgttttcttcatgaagtctttgcccattcatatgtcctgaatagtattgcctaggtttgctcctagggtttttatggttttagcttttacattgaaatctgtaatctgtattgagttaattattgtgtaaagtgtaagtaaggggttcagtttcagttttctgcatatggctagccagttttcccagaaccatttattgaataggagatcctttccccattgcttgtttttgttaggattgttgaacatcagatgcttgtagatgtgtggtgttatttctgaggtctctactctgttccattggtctatatgtctgttttggtaccagtaccatgctgttttggttactgtagccttggagtatagtttgaagtcaggtagcatgatgcctctggcttttttttttcttagcattgtctttgctttacctggtcttctttgattccataagaaatttaaggtagtttttttgttttgttttgttttttttgtgaagaacatcaatggtagtttgatgggaatagcattgaatctataaattactttgggctttgggcagtatgaccattttcacgatattgattcttcctatccatgaggatgaaaagttctgctatttttttgtgtcctctcttaattccttgagaagtggtttgtagttctccttgaagaggtccttcacatgccttgttagctatattcacaggtattttattctctttatggcaattgtgaatgggagttcattcatgatttggcgctctacttgcctattgttcatgtaaaggaatgcttgaaccattgtggaagacagtatagcgattcctcaaggatctagaaccagaaataccatttgacccagcaatcccattattgggtatgtactcaaaggaatataaatcattctactattaagacacatgcatacgtatgtttattgcagcactatttacaacaacaaaggcatggaaccaacccaaatacccatcaatgatagactggataaagaaaatgtggtacatatacaccatggaatactatgcagccataaaaaggaattagattatgtcctttgcagggacctggatgaagctggaagccatcatcctcagcaaactaacacaggaacagacaaccaaatgctacatattctcactcataagtgggaactgaacaatgagaacacacaccagggcctgttgtggggctggggggaagggagggaacttagaggatgggtcaataggtgcagcaaaccaccgtgacacatgtatgcttatgtaacaaacctgcaccttctgcacatgtatcccatggtttttcttttcagaagaaatgaaaacaaaaaataaaaaagtttgttaatttcttctgagaaaagatgcctttgtgtctacatttaccctaaatgtatcaaaatattgaggcttctagctcccaatccctgctttggaggcttgggtttacacttcccccacacaaccgatgtttgtctacagtaaatttcttcacactagtgctacttccattcctttttatatccttcactttcttccttctgtaaccttggtacctaagataataggttctcaataaatacttatatttagtataattcattattttattaattacaaaggtgtaacatgtatcttgtagaaaatgtataaaatatagaaaactgcaaaataatgaccaactgcaatctcacccattttgttttgagatttttgtctggaaatgtattttaaaaatgaatcatcccctttcctaatcccaattctattcccaggagatggccactgtgaatgatccagtatctttaaagtgttttctctatttttatccacacaaatatgtatacatgcacatatacacatctatatcctttttttacaaataggattgtactattttgtgctgcagaaattgctttcttcatcaaccaaagtactatgaaattttctcagttctgcagatttaccttactcatttgaatttaacgctatttgataagtatttttgaacatacaaattaattatttgatttggaaagaaatgtcttttggctaacatcttattttattattttagaaatcagccagaccataagtaagtggttatgactattctttcttgtaagatagtataataaaattccggaattagaatgatctatgcatccttcgttcaggtttaagatataaactttctgtttcagaagctggccatatcactactggtttccaaagatcagggaataaacatgactttgtacccccttccataactaactacatgtaaaatttcttttaaccattgtcagttctcctgcttcattttgtcagaccactagactgcaaatgtttctcaaacttcaggggtcctgtcacctgccttttgcttcagacagcaggatactgaattctattgccatcacagtaacaacaatgataagcacagcggtcaggttttaatggcaccacttaatgaattctctgagaaaagaataatagcgagaaatctcaaggtcagcagtgtttactttgagaaggacctaacaatagatctgagaagtccttcaagtgtaccaggcatctttttctgctctgcctgcagttaactgagattttctttcctttttcctcgtcttcagtattacatgtgaagcaaaccaattctagtctcagaaaagtgatagcccttgatgttaacatatcaagcttgggttcgatggaaaggttaaaagaaaacaggcaagatcacatcctaacaattctcccatagatttagggtgagaatttggaccaataaatttgtttaacacagaaaagaggatgcatcaagaatccttagtggagagtctgaaattatggaaatgattataaaagtagcttggagctacactgtgaagagagttgagggtattcattgtctctagggattatatataatattataagtcttggagtaaacaaacaaaagctgaactacttaatatgaaggataatagagtttagaatacattccttaggacagcaattaagcatggacataagtataggtcaatttcatgaggaaaagaaaactgaccatgaaataatacaaaaaagaagaaattctgaattaagataaaaactgtgtgcagagacaaaggactagatggcatgcaaattttccatgcagttaacagtttccaagtgttttaaaaaatgcaataaaatatctctaaatgcatttcatgcatctctttaagttctttctcaaatatctatcctatattgctatgaagtagtgaggggaaaatagttattactctctctgtctctctcctttgttttacgtaagagagatgtttaggaaagtttgtgtgcgtgtatgtgtatgtatatatgtgtgtgtgcacgtgtgtctgtctgtctgcctctctctgcttctgcctctctgtctataaagcaggcctccttccaataattaactatggttgatttaggggtcactcgcctaaggccatacaccatgtcaaaatatgaataaagatttcagggaggataaaaagtgtttttcagctattcaaacaaagccactgacactataccaacacaaactactagagatgaaaagtatcttagagatcgatccctcattttctgtatgaaactgaggttcagcaagttatacgccaaaatccaatgttacccaatgctttaatggaagatctggtctactttttgaacatggtaagatctgagggttgctgcagggctccttgctccaaaatatttcctacacagctttccagaggacttgaaattccaaaggtcaaaatcttgcatcagaattattaatattctgctatcccaaatgataccttggatgacctatccacgcttttatttacgttcgatgcctccttttgtgttcctcttgcctactcaggaactctgtgtcaaaaattaatcatctatgttcaatgtagtctaatttttcctctctaatggacaattcccatcagcatgcttttattattatcttatgtttttattcctcccttcttgaaaatatgtactttagaattctctcttcaccctacattcattaccagttatggtcccacttctctgctccccttagtaacaaaattccctgaaagagttgtctacatttgttattgaatttctcccttcccattctcttttcaacacattccaaacaaacagaccatactaggccattcttgctttgctataaagaaataactgaggatgagtaacttataaagaaaagagttttaattggctcaaggttctgtaggctgtacaggaagcatagtgccgacatctgctcagccttccctgaggacctcaggaagcttacaatcatgatggaaggtaaagagggaaggtaaagaggcacacctggcctgcattctaaatgtctccttttgtaactttaatatatggtaacacttggagaaatataattacttttttcaacagtgatagtaattcacactattgtgtaactccctcacgttgaaaccttattaagttgttgaccagtgacaccatattggagaagtatcatggtttaagaagcacaaggataataagaaaagaaaaaaaaatacatttgggttgtataaaatgtataggtaaattcatgaattgtagttaaaaaacctttttttttttcaaataaaatatgatccaattctgacccttctattgaagtccttagctagaattccatttggaatttcagcctcctttcccctttattgtctcaaagtggaaaataggctaaactccaattgaaatactgtgctaattggaaaaacataggtgagcaaatgacttctaaggtgtgtgctgcactctgcattgtgctttagtcataagaatatctttaaagcaaaatgagatattcaacagagtcagatggaatcccctagcttgctagacagaagcaaggaacttcaaattaattctgacacatttttcattgaattatcccagtttcatgccctcaagtcactcatgactcattattcatatgctcttttagaactatacacatcggggcctgtcagggggtgggggactaagggagggatagcattaggataaatatctaatgtagataacaggttgatgggtgcagcaaaccactacggcatgcgtatatctatgtaaaaaacctgcacatttagcacatgtaccccagaacttaagtatagaaaaaaaaagcctatatttgtcacttacttacctgcctataagacctttacttcattaattttcttgcctgtttttttgttcgctattctttaatctttattatagccacgactgaaaattgacatatacctaggattgatgcctttgtcaagaacacatattacatatgcaaaatcacttatattgatgttatattatgctaaaatatttgtttccttcaattaagactaaagtaagagtcaggaatggcagggcacatttcaaaataagcgtgatctaacttagtacaatttgagagacaaaagtgatctcagaattgatccaggctaaatacctacctacccaatgtcagaatcccctcaactgaaatctaattccctgtaatttcagaacttcaacctatttatctatcctccccctgttttttttttcttcttagcaatgtggaataaatctaaatctaccacaaaataaaagtgatttgaagtatgggaaagacatatcatactctgttcccaaaatttctcttctctaggcaaaacttccttccattaagttccttagacaacatgtcatttttagcagcaggttgctcatcttcctctgagctcaatcctttcttaaaatatgacactcaaatgctaaattccagtattcatcacactaagattgtctatgtaagagtaatttacatacatgtttgcattatggtcttcatattttaaaagtccaatctaatgagatcagatacaaagcttatgaggaatgtttctaaaacgtggcctttagtaacaatccattaattatttttgagtggagtaatcccagtattatccagcccatgtaactcaatccttttcactaagttagtaaaatcaagactaaatttaagtctggcaaacctaacacaaaagaaaacgctgtaagcttggcatgtagttacttaagtcaatgtatttgggttctagtaatcactcttctctgtttaataaattaattttaatatatggcaatggaaatcaatactgaacatgaaatctgcttttacttcttttgaaaattcatacaaacattatccaccaccacactgctgatatttctctgtgttccatgaactctcaagcatattacttttatactggaagaaattacatgttacagaaatatttcagctgggtttggaatttcaaattaatttaagtgtattaaaacctgtcaagatatactcagggctacaactacattttggacacaactacattttggtaacaagactgcagataatatcttgaatgtgtaaatttcataatataaggcaagcagcacagtggaaatagtggagtctactaatctatgggtagaagtgacagccagaaaaccaaacaccacatgttctcactcataagtgggagtcgaacaatgagaacacatgggcacagggaggggaacatcacacgctggggcctgtcaggtgttgggggagtagaggagggatagcattaggagaaatacctaatgtagatgacgggttgatgggtgcagcaaaccaccatggcacatgtatacatatgtaacaaacctgcacattctgcacatgtatcccagaacttaaagataaaaaacaacttaaagattaaaaaaatgaaaaaaatatggcaagtgacactggtgaaaataaaaaatttataaagttaaaaaaaaaagtgacagccaggaggaataattatggctagtaagttaactttattggattgcccaattcagtgctcagaaagaaaccgccaattggaaattagaattagctacagtagatttgcaaacaggtcaacttactgatattcatgatataattcactaaatataggtatctttttcatttccctttacagctctcatttcttgccaataactccagatattgtcaaataatcacaactgtaccttattgctgccagtgaaaggaaactttccaaaaacctctgtgaggatgaaagctaatgtccagcccccaattattcaattagattttgaaaaagggagctgtcattcctcaatttacttcagcaaatgcttagtgcatgcaacgcataaggaatgtatactcaattggagggattcaattaaggaactaatttaagagtgaaagccacaatgtttgtgggattttttttaaatgatataggtatattcaaaacatcaagaaccagttcaaaccaaagttatataaattgtagaagcttcataatcaaatatttatgactctctctacggtgcttgaaatattaaattattaaaagcaaatattgtagcaaacaggttatcatcaatctcaataaaagttacgttttactatcactgtcacattattactttttgcttttagtcgtttaagattgaagagaggtaacaaactgtggtaacaaatcaaactttttcagtgtaatttactttgtgagtaatttctaattgattcagactgatgagactgcacagtctgatgtactgctgaagcaggagatactttggaccaagtaaatttataagctcctcttcttgagagaaaaatggctgctatatttcatgttgtcattttttagctttaacaatgtagttgtatacctatgcggattcttaaaaaagaataccaaataatgtgtacacctgtaactgtctcacccacctatcaatattggatttggcaggcccaaccttctacttgctcaaaataaaggatttaagcaaaatgcagaattaacccaaaaagaccagtctcatatatgaaaagcaaagctgcatagcaacatcactcagccacctgcagttcaaagttcatatcttattaacatcactaaaattagaacaatgcaatggcttggttgtgtgttttggtatgattgtttgtgattctgttgagattggctctgtgctttgcttaaaaatcctgaatgttatttttccaaaacatgattctagatatagatcccagtattttgaaaatgagagttggggggaaaagattgtgcttgtctgctcaaaaggtcagaagcacttcacctcaattcagtgacaaatagccttattttacagaagatgtaacactggaatatgaaaatagccatgtctgacacacctttggatttttactcaagatccccatccaatgtgtatgtcccttggctgataaaactgttctttttgatgtgaggaaaaaataataaaaacaaccaacaagttttcctctttactcatctcatccattctgggatggaatatccccagaggcttgagtctgaagggcttttttcaaatttcacaacgtaatggagacccctctatggaactcttttcccttttcacctaggtattatgccatctggctgaggagctacttgtcatctctgctgttccctgataggccagaaacaaaaggtgtccctaggtctaggtaaaagtcaaataaaataaaaaagaaaaacaacttgaggtgcaactttagaggcctcaagcatctcaaaggctttaacaagtctagttaagtacctgtggggccatagtgggatttcaatatcctcacatgacccaggactttataattccaaacattgtcttgtcattaactgtggaactcttgctaattgagtctgagtgtctaggagacagtaagggagatgatgaaaacaattatttgtaatttagcagagtaaactatgtaatttttcttaagctaaacattttaggcattcctcattataaacaagtcaaaattcctttccatgtttcccattcttgtccatttccagactggccttctgatttttaatttccaaaatgacctccattttgaaatttaaaattcagggatcatctttgaggcatttctctttttcatctcactatcaaacttgtcattaaataattacatttctctctcttcattcccagtatgctagtccagaatatccccaaatccatatctgaattattgccactgccacttcactctttttctagaatcaaggctctcctgcctgcagtccattttacttagtgctgtcaggatgaattccttaatatacctacaagcctgaatatgccccacattgacttctacatcaagaccagatagtttggccttattatcaatactctcaacaatgaggctccaacttatctgtccaaccttaccactctcttttctgctcagctctgtctttcctttgtattcatcatgcttattcctgtacttattttatgctgcgaccctccactaaaatgtaatgagtcttaatcctcactttcttaaggttgatgatccttcaaggtccaagttaagtttcactttcacgaaaccttctatttcaattatcatttatctgtccacacataaacgtagtataattgcgagtgcttaatatttccttattgaaatattcaaatagatgcttctcccacagatctttgcaaccctcgggtcaggagataccctggtgaacccactccaccaaggccttgtatctgacacacagtgctatgcgaaatttcagcagagcagacactcaggcaggcacagagacccaggaactttacatactccagctctgggatccctggaaatggtgactggaactcaggcaaagcaggaggttagacctccgtacatatgcctaggaagggggctgaagacagggagctgagtagcattagtctgcgagcctcatttgcagggcacctcacaggataagacccattggcttggaattccagccagccaccagcagcactgttgcacttacttgggatgggactgagttccccagggaaggggcaggctgccatctttgctgtttggaagactcagccatgccagcatgcaggcttaggggagtccaaagtgttggggggtaatgctattcccattaaactaccaataatattcttcagaaaactagggaaaaaaaactattttaaaattcaaacagaaccaaaaaaagcctaaatagccaaggcaatcctaagcaaaaagaacaagattggaggaatcacgctacctgacttcaaactgtactagaaggctacagtaaccaaaacagcatggtactggtacaagaacagacacatagaccaatggaacagagtagagaaccaagaaataagaccacaaacctagaactatctgatcttcaacaaacctgacaaaagcaatagggaaagcattccctattcactaaatggtgctgggagaactggctagtcataagcagaagattgaaagtggaccccttccttacacaatatacaaaaattaactcaagatgggttaaagacttaaatataaacccaaaactataacaactctagaagacaacctaggcaatatcattcaggacataggcatgggcaaagatttcataatgaagacaacaaaagcaattgcaacaaaagtcaaaattgacaaatgggatcttattaaactaaagagcttctggacagcaaaagaaattatcaacagagtaaaaaggcaacctataggatgggagaaaatttttgcaaactatgaatctgacaaacgtctaatatacagcatgtctaaggaaattaaacaaattcacaagaaaaaaaacaaccccattaaaaggtgggcaaaggacatgaacagacacatttcaaaagaaggcatacatgcagccaacaatcatatgaagtaaagcgtaacatcactgatcattatagcaatgcaaatcaaaaccacaatgagataccatctcacaccagttagaatagctattatttcaaagtaaaatcataagagatgctggcgaggatgtgcagaaaaagaaatgcttataccctgttggtggtagtggaaattagttcaaccattgtggaagagagtgtgttaattttttaaagacctaaagaaagaaataatatccaaccaagcaatcccattactgggtatatacccaaaggaatataaatcactattattaagatacatgcccatgtatgttcattccagcactattcccaatagcaaagacatggactcaacctaaatggccattaatgatagactgggtaaagaaaatttggtacatctacaccatggaatactatgaagccacaaaaatgagtgagatcatgtctttttcagcaacgtgaaaggagctgaaggacattatccttagcaaactaatgtgggaacagaaaaccaactaccatgtgttctcatttataagagggaggtaaatgatgagaacacatggacacatacagggggaacaacacagacttgggcctatcaaagggtggagagtgggaggagggagagtatcaggaaaaataactaatggatactaggcttaatacctcagtgacgaaataatctgtacgacaaacccctatgacacatgtttactttggtagcaaaactgcacatcctgaacatgtacccctgaacttaaaatgcaagtttaaaaaaaagattccagtaaatgatttcaataactttaaatttgctgtaatattatttattatacatgaaacatatattaatatatattcatagttgtaatatgtttaggcatattttcaaaagaaaggaaagtcacagagaaacacatacacacacacacatatatatgtatgcatttatgtataggaatatatatctttatacaaaagcatagaaaaacaacaagaagtatacttgcttcaaatcataaatggtggtcacctggtcacctccagcaatgggacaatgggagcaagattgacaaaagtgttagtaaaggagatctttcaggttctactctaaatacaccaatgctgctagaaattttccaagaaatatattcaagttttacttgtgtgatttttaaaaaaaaaattatttaattaaaggggaaaaataaagttatcagcaggccatcctgaggcctcaatatatgtaaagcacccttcctcctatgtgtacaaggatatattccccttttattcatagcctgctgcatccttaaacagtattttaaaataatcttttgcttttgttgttttgttatctccccttcccttcatcccataccaacttgttcactacacaaagtcagtagaacccacaaagtcctggaaacatagttcaaacacctaaaagagctctggttttcttgatgtagttaactcaggcagtgaattaataaaaattgagcaattttcaatagaattaatttaattaagccggaaatttctctcccgtaaacctaaaattactgtcaaacataaaagtattaaaaaaattctctttttttcatcagatccatattgttatttgttttaaatatcattttagagctatagtcgtgtgccacataatgatggtttagccaacaatggaccacgtatatgacaatggtcccataagattataatgaagctgaaaagtttctattgccctagtgacattttgatgatcctgaccctctgtaagcctaggctaatgtgtatgtttgtgacttcatttttaatttaagaagtttaaaaaaaaaaaaaaatagaaaaaatagaaaaaagcttgtagaataagaatatcaagaaaaaatattttgtacagctgagcaatatgtttgtgctttaagctaagtgttattattagagtcaaaagtttatcaagtaataaagttacagaaaactaaagttaatttattattgaagaaagaaaaagatttatatatatttgggacagcctaattatacagtccatagtagtgtacaataatgtcctaggtctttacattcacgtatcacttactctctgactcacccagggcaacttgccgtcctgcaagctccatctgtggtaagtgtcctatacaggtgtactgtcctttatcttttatactgtatttttactgcaccttttctaggttaagatacgcaaatactgaccattgtgttacaattgcctacataaaccatctagttttatgtaagtacactctataatgtttgcaccatgatgaaattacctaaggatgcatctgtcagaacagattcctgtcattaagagatgcataactgtattggctttccactaaatatatgacttttaatatttttttctttgcttttagtcatggggccaaattctattttcttaattcttcttcgtcttttgtataagatacattgttcctaataaaaaatgcaatttcatttagagacattttgctttacatttaatattttagaaatgcaagatatatcaaaggataactagaagaaagaaatgcgctgtccaaaataaatgtgctatcttttccaagggcatgcaaatacattttccctcaaagattaggaggtgggtaatgctagtacctgaaattccaatttttctcctttaaatataatcagtccccaccttatgaaggggttgtatttcaaaacattgtgcttgttgagttttaggaataaattctcactagaaacaatgtttatccatggtgaacatatgaaattttcaggcaatcttaaaataaaaacttattcatttctttttgtacctgaagttatataaagttaaatacaaatggttctttcaaatctaaccaccacatatgtcaatgtttctgtagaagttaacttttttagaattttaacctagtttgttaggaacgtatctacttccactgcagggagaacagatattcacctaactgcatgccaccaataatggccataatgatctgaaagagattctaggacacattaaggttgcttattcagccattcaaataaaacatcaccactgctatatccttggacctgaaaatataactgtgattagaaaagatatatttcttgctctcagtaggaatacttagcacagagacttaaagcatgttaatatatgagccacacagctattggaggtagactatttggggcaggtgaaacagcaagtgcaaaggccctaaagagacaaagtgcctggaatacctaaaaaacaacatgtaagtcagcattttagtcagtgtttctgaagtggcagtgaaaaggggagcatttattagaatatgaaataagagaaaaagaagacatagagccttattggccatttttagggcattgagtttcactctgaatactaattggaagaacagagcagtgacataatctgtattaggttttaaccttatcattgcgggtgctgcattgaagattttctgaagtgggcaaagggtgaactcagggaaatgagttcaaaggttgttgcaatagccccaggaagagaagatggtgattggagccatgaagtaacaatgaagcagaggaaaagtagtcagtgtctggatatatttgaaagcagagccaaaagttttttgatgataagtctaagataaagagagaaatcaaggatgatcccaaggtttctgagaaaatggaagaaattggcttgtcattagttgatataaggaagaaagagaggaaagtaggtttgaaggaaatgaaaaaaaactatcctaaattcaattttggatatgctaattttgagctatcaaaatccccaaaaggagatgctgaataggtaattaaataatatgaatctggaatttaagggagaggtcaggataggtgatatgaatttgggaatcattggtacaagaaaattatttaaagccatgagactagatgttcatacatcttaacctaatatgtagagtacaattgctatagcagaaagactgggtgatattggaatgtaaacaaggtgtatctaccttataatgatagccaggtttaatagaacagttgggaatacctttggagaaaagttgacatttacactgagaacaaaaggaaccatcagaatcagctagatcaaaaggttatggagtgattcgggaatgcgcaatgtcctgaaggcaatgctgatcatggtgcagtgggaggaagtaaaaaatgttcaaactggcagcatcatagactgcaagaagtggggttctcaagaggcaagaaaataagagttgtgcaaaatgagccttgagaagaagacagaggacagttcatctcacattttgtaagccatattattaagatttaattttagaacagttttaaaaggttggtaataacatattatgtaggctaaaccttctgacaatgatgcagaatacactctctccccataaaagatgcaactctatatatctaaaaatacatttctcagaacctagtaatgagtttgctctctgcttcatttctgccaatctcaaagaatagtttcttacttccctttctactgccaatacctactgcttcaaagactccctttttgacctctatcccaagttgtatgaagtgggaagacagcaactgtggaagctttttctcatatctccttatctttatcagcatcatcatcaccaggataaagaggtgcttttccaagttggcacttgggcaacacaggaaatttttaaaagggtaggatgagggagaagcaccagggagctgccatctaggtggcgtaagatgcacagcatcatttcaaaacaaatcaaaagtcagcttacaatgcaaagctatcgcctgccaggtttgccaagaaatgcttttgaggacagaagaaaacaagaaattcatatatttaatcattattcatatttaatataaagcaaagatgatgcaaaacttgaaggtgactccatggccctcaagggatcacagaatgttaaagacagaagagatatggagatgctatcgtccaatctcctaatctcttcatttccaagataggcaaactgaggcccccccagaaatgttgacttgtaaaatctggtggtagtccttcatagtatatgttcactggctttgaattgcttttcccttttaggattatttttgaggagacagggaccaagggtccaaatgatcccagtggctagtgcttagcaataaatgtttcagaatctatactaaatacagtggcttggatgttaactgattaaaattaaaaaagacagaactcctctctgtgggttcttagacagccccattgcaatttgaagaaaatatgtttagtggtttgaggtttcaatgttgtattgtctcggtactgttcttgttatgtctttattttgactctgttggtactagacttcagaaatattgctgatatgctgcctaatccatcaaaagtcacaacaaaagctcttagggtgaaagacgttgtctttaataatgtaagttctcattattgagatttaagtgccccatgcacagtggttttgaatttacagtgtgacactagatggtcctatcagctagttcatgttatgccagaaactcaatattctctctttcctttctctgacatgtaggtgagaggattaaggatatttaaaacagaggagacaccagaatgcatccagtactactggtagagggtggaaggacagatttagaggttttctaaagtagtatttttgcactgaagtagctcttaatgcaagtattcaatgaggaattttatctccagcatgtgagagtgtgtgtgtgtgtgtgtgtgtgtgtttgtatgtgtgtgtgtgtgtgtgattatgcattgtatgttgtgtttgtagataaatagcagcattaatacctgggtgatatataaggctagggagttctatatactcatctgccctttgtgtcccatctccctaaagcacaagccgtcaaaagaatttctctaaaataattagattgtagttaacaacctaacatctggtagaattcagcagcacaggctggaggtgtatctaaagcaggaaatattcaaatacctataaaagggagtaaattatgttgaaaataattatgatgatgagacatacagatatttcaagattactaggctgttgattcctttttcaaaagccttatggaggaaaataacagtggcctctattctcctactcttacttccacacaattattacatggaaatgatatggagctttaaacaatgcctttctccagaactcctgttgaaagcatgtcattgtttcttacagtggggataatattttctatttgtacgtggagaaaagagctaataaaatgttgcatgtatattaaatggatacctgactcaggaacacattaacttaatgatttatagccatcatgagttcatcttaaatggcccctggtaaaggaaaacaacgaatatacttcaagaaaactactgaatttaatatgtatcccttttagctgacagtgaaattctagcttgtgttcctctaaagagtaaaatatttcagctacaaaaattacctccacaaactctcatgtcttagcaaaagctgctattttatttgcacatttttcataagatgaccaattaaagttaaaattaaaggagctgatttgtacacataaatatcctacatagagtttctctcttatttacaagacttgtcatttaaaaacaaatattgaacagaatctccatgcactcagtacaactcataataagtagtgaaaatatgagattgataaataaattagaaactaaataatataatcaatttatgtacaattctgttgttaaagtagtgtgcatttgtcaaaaacatttggaagcatttcccaaagaagtcttaaaaaatgactaagggtttaggacaaggtgtcccttgcagatcattcttacctaacccaagttccagcctacatttgggtgtagagttatgatcagcctccttctatcagattttgtgtcctagtgagatctctatacatcactggaaatgaagagctgcatttgatcctcatctaacagcgttctttaaaaaataaaataaaaactgaaactttgtcaatcagagctgctcacaccatttacaaagagaagcttaaatagaaaatagcagcaacaacaggtggcatggattccagaatgggctagcaaccaagaggagaagcaacactgattcatgagcatagctacagggcctggtacagagccagctccaaatccctctgcttttagaacagcttttaattttttatcatcttatgaaatgagagcgaattagatgctgatggctggcagcactgttggcctacttttgccacagggatgtttattcaggtgtatcagcagtacccatagccacatactttaaatctaatctggagaaataacctttgggatccttcatcctgacaaagtttaatatgagaccagagatgataggtctttctgccttcatgctcactcatgaatgagactggagtacatcaacttgatttcattgagatcataatgatacagcttttccaaaggagtcctttttcactttctcttaacctgagggtactacgttttgcaaacagcgtacaaatgattcattaaaagagaatttgagaatcccaaaaacgaaaattatatttcagatctgtatggcagttgcctcaatgaggagagtggatatggatatccttgtttatgtccttgaaaaaaagacactgaaagcgaagtatcacgtccaaggctctactcacaaattactacagaattatttttaagttgttggtcaatgactctaaaattcaaaaaggaaaaaagaaatagaagacttgaaactagaagtaccaaataaaaagaacaaatggaagaggaaaaagacacaaatttaatcaggaaaataggatggaattgttgctgtgtgaccttgagcaagttttgtaacccctctgtgcttcactttctttatgcctcatctataaaatagggataaagacagtacttactttagatttgatctgaagattattttcacttataaaacatatagagcactactgttcctgcctcatgctaaaaactcaataaatgtttggctgtgataataattattaattaattaaatggtaattatatgtcaggctctgtgcttgttgcaaagtagtttataatataatatttgtataatacccgcaacacttcttatgattttttacaggtgaagaaacttaagcaactctcccagggcacaggtaacaaacagcagagccaagattatcacctaggaccacctgtttcttaagattatgccctctagatcaacctatgtctattattaccaaatacttttctacattctttcttttatgtaaaaaaaagaaccattctacaaaatgtaaacaatgatatcattttggcaaattttacatatctcctttgttatgccaaatataccaatttcctcatagatattaaattagtcacaatgggttcctgcaatctccagaagatataatctgcagcttgttaaacatccactagtgcagggacattgggaagcaatatatcgtatctgtcataattcttatctgctagtaatagtaatgaactgtagctatcctaggaaataaaaaggatttgttggaaggttataatgggtactattacattggctgagaaaacagacttctaagactggaaggaacaaatgagctttggagggataagaagcaaaacaaacaaacaaataaataaataaaattaataaccttttagccagaacgacctggccaggacagagccaccaatatttttaggcctccacctcctctacgcactaccattattaccgctggacatggtaacaactgcgccaaatcaattctaatcattattccatccttgtgttatgcaatttagattcatagtctgggctgatagcatctgattagctgagcctggcttatatacccattatctggctgccagaaggcaaggaaaggagcctccagtctttgatttttgtatgaaaggtgggtactgtgttcaattagtacattacacagtgaagaattggatgatgaacagccaaaaacacacagcaaatttccactatgccgattcaggtggcccagaatcctttctcctagtggcctatatataaaagatttggttaccccataaattcctgggtataattaaaaaattggagatacaccactttgtacacactgctttttgcagtggtttcctagaactgcttgttaatcaaagggcattactcttgtgttggcatatacatcaatgagattttatgcttaaacatacacttggaaaacaagacaacatttaacacttcaaatatatgtgtgtgtgtgtgtgtgtgtgtgtgtgtatgtatatataatatatatatgtgttccaaatttccctttcacatgttttcaattgttcttttcatatcaattgaacacaaatgacatttaccagccttcatcagcctgtatctcaaaatgttggcattatttatatgttcataagggctttcaaagaccattactgacactcaacacacaaccaccttttcatctttaccatagttcatcttaagtggaggaaacaatcttgttttacttacacacttttctgctgctatcttaaatgttcataggaatcaaaattatagctaagaattaaggtatttatagacatacatgaaactttagaatataggcagatagtatagcacatagaatatcaattcagtacttagaaaagatttgggtatctactatgaagtgtctagaaacatacaatagtatttgtagtatgtcattcctcactgatttgaaaagtaaaacaatttctaatgtttatattacatgatttgttaatagtatgcctggattgtaaataatacatctcctgagaccagcatggagaaccaagatgcgtatttttttaaaataaagaatggtgagaactacaaagtgattggctcacttttggtaattcacttattaaaataataccaaacaatatctaagaaaatacactaaatactatgaatatgctaggtaggttggaattatagtacccactcaccacctgccaatgcatgatggatctgattagcatagatgaaatgccaaactctcaaagaggaatactgaagagagagaagacactcaggcgcttgggactggcttcactgtaccatttttgcttttgttgtgaccagagccactgaaaaacaaaccatcaaaaatatttcaacttggcatttgtattcagaataatttaaatggacaaagataaacttgcatgcaaagctgatttgtttatttctttgctatttgtctgcatcctccttttaaaaatgaaagatattaattaaaaagaggtatgtggaacctatcaaggcacaatatttcagcaaaatgcagccctactttctaagtattatagacagtaatcgttctgtgtacacgaataggtattcaagttgactaataataaataggattagaaaacaggggtcctacaatattcctgatagaaaattagatacgtagataattttttcttccttttagactcataagcatctccttatcaagtctaaaggaaagaagagaaggcaatgaaggtaaatacagggcagctttttcagtctgataagaaaaataacattttgggaaagagtaagactactctttattttttaaaatgctgcattatatattgctccagagtatcatggggactgtattacatttaatttagttttatttattcttggcccttacaacataaaagttgactttttcaaaagtcataaggaagtatattcattgatttctcaaaactagtatatctaaaaacaaaagatgatactgcagcccacatataagggtgaatgaaatagcaaagcagtagaaaagcagcaagtgaaaaccatatgtgatgcatttgtggaaaatatatgatcatagcagacaggacacattcatagagaaagggacttttaaataacaaagttttgagacactactcaatgaaaaaaaattaaagtttttttgcctaaaatcatggagctttacagattcaactcccatcacaaatgcataggcatttttaaaaagggcattggcagaacaaactcacgttggaaggaagctgtgcacctggctttccttattatatagatgtgtgcaatgtccaatagaaaaacaagtctagatttttaaattctggttaatatttgtttgtgattcatttcaaagactgaaatgtgagtgattatagaacaaagacagaaacatctttgtaggtatcagattaatattagccaagatatgatacgaaggtcaggacctatttgatgcaaagtgtgaagcaacatggtcaaacacagatgtaaaactctgtgtgatataaaaccaaacctacaaaaaagaatattttaccagaaccactcatttatttacccagcgtttattgaatgaacacctttgatagaccaggcagtgtggggttacaaaagtaaacaagaagcatccctgacctcctagaactcaaggtgagaggggcagacatgtaaaccaataattagagcacaacttgacaagatactcccccttactgctcccagttaattaatcctccagtgataatggattgataagtaacaccaggtaagattatttgtagttgtatgcatgtgaatggtctattttaaactttaaagaagaaaaaataccacatctgcctccagaactaatcttctgttactggcataaattctaattcagaaactatgtgaaacagattttcttcttccaaagcaagagatctcttgtatcaaggtcatatttaattcttttgacaggatattctgtcaggtatcaagctaaaatagaagccaaagaagccagatttcatcctaatttcaggaaaacaaacaaatatatatatatatatttgtttgtttgttatatatatatttgtttgttatatatatatgtggtgtgtatgtgtgtgtgtgtgtgtgtgtatccaaaataaatcaggaaaaatgtaaaagaaagaaataaatagtgaaaactaataggaaatatattttaaaatttccaatcattagcaacatcttgtcagttacagacagaaggggctgcctatagaagagctgaatcaggcatcaggaaggggattgaaaccatcaagttcatattaaataatgcgtggtggcaaccccaggaggctggcatctggaggcagccagaatgagtttttaaattacttttattggaactcctcagctgcaggtaatggcttaagggctgcagaatatgcagatttgaaagaaatgcaatcttactatttcatagctttgtctcccctgactccctggcagaaatctttgagaatgtttctgccacctgcacgcccagcacattttcttatctttcacacattttcttctcttcttcccagtatcactagatcttggaaatgtaaacttcgacttgtggctatcctatactacccttcttcatttacacaaaattttgcaattatacaaaatagcacttcaatagtacataatatacctgcaggagcatagtatttcttaaacactcaaagagctatctttcatggaaaataccttaggttcaactgtcataagttctatcattaaaataataaggaaacgaattatgtacgtaaaatttttaaaaatgcaaaaaagtttatgcaaaataatgacctgtttgtcttgattattataatgaaaacattaaactcagctacatgtgctgctgctctaattgtcagatatctcacaattgctcttgtcttagaactactcatctactgtcctgtttctatgatatctatgaagaggtagaaggcatactgaataaggaaaaataatgacaatagaaaatccctgctgcagaaccatctggatcaccccagtaactttggcatctccagtgttatgtcaacataagggaaagggtcctttcaccatctttgccaccccagccttggaggccaactcccaaatgacagtttacttggaattttgtctaaaaactgtgtcccagaacacattttcatccgtccatgcctagggaaagatatttttttttaaatctggagaaaaattagaaaatcaggactaagtgaaatagatttctttttttagtaaatgtatccaataagtagataatctgtccttgaattaggatggaccacaatttacctcttttctgaattggtttataacttgttttacaatacttatggtcttgcaaaaagaaagaaatttggtctagtgctatgtttcagttagtaagaaattcatgatgtatttaaaatgatagcagagtacacagcctataattactggttgttatctcccacccaaaactcaaaatctgaaagataagcacaatggggaagtttattttaacatcatcagtagcagctacagcaacagcatcacaaacacctgggtagtacaatagtttatgtagcacattaatatcatgatatatattaagcttcctaaaattttatgaattgacagggaaggcattatctttagcatttctagaaatgaagctctgacaaactatacatgtaatatttgtctatttttttctaccaggttgcttctcacaagtacataaaacatagtaatcaattacaaaagcattttgtagaaaaaagttgagtcagggctttgcaccaatgtgtaacatgataattcatgaccagagataaaccttgcttatctagtcatgacatagatgagtgatacacttttgattaagagagattcgaattcttcatggaaaaatgtgaaggcccaagctttcacggagccgttttgccacattgtgttcagttaagcaataagcttcttctattatattggaagagtaggggttttccagggaataaaagtgatacagtggaaagaagaaaagctccaggtaaagtaataatttgggccttaaacatttgcctggagatactatcaaaagaatgatagttagtagagactaggaagggtgtgtatgtaagtgagggataaagggaggttggttaatggatacaaacatgcatttagacagaaggagtaagttccactgttcactagcatagaagggtgactatagctagcaacaagatattatatatttcaaaatagctagaaaatttgaaatgttcccaacacaaagaactgataaatgtttgaggtgttagctatcctaaatacccggatttgatcatgacattctacacatgtatcaaaataccatatgtatcccataaatatgtacaaatattatgaatcaataaaaagtaaatatctgttactcatttacacttaatctaaaaacaattaacttttctctggaaaaagcatcttctttaactgagcacacaacttacagatagatgtacatgtgcatcaatcagaatctgggcataaaaccagtcagatcacatgaactggatattctgaggagagtttgaaagagggagtagttccaaagatatgagcagtgtatggggaataccacaagaaagtataaggcaaaatcttggagctagtaagaggtgaagagagccacttttaggtctaaataggccagagaagtggatgatgacaacaacattgagatgaagtggctatgaggcctcttgacaagatgcagctagtccatgttgaccacacagaaaaggaggatgaagaataactaacctaacctcactgtcttcccttcatctgatagaacttcttccagtcttccccattgtcctaatctaaaatgaagccagaaggcagacaagtcctttaatgtaatcataaagatcagacttccaaggcacaaggcaaggtatagagggatggaatgggaatctggagacaaaatgaaggttctaagtatatcgagggttagaaactggcaaaaaagggaaaggacaaatgtcaccagccaggccaaccgtattaactgtgacaggtaaacttaggctcaatgaagttaagtgacttgtcccactgagtaaatggcagtcctggaattataaccaagatttttatttccaaacttgattgttagtttatttcaataaagctacccatttattggcttttaaatggtttctaaatgtagctgactaaaagttaagttaatgagagccaaaacactatgtaaatcctcctggaacatctctttataatagaaatgataactatacaaacataaaggcagcaatttctagagtattcatcacttattttcccaaagtgttaatcaaaatatataaaaacaatgctgtaaattgctcttagatccccctctgtcaacttgtgaaaggatatttaatccatcatagccatcaaataatgtacctactattgaagcaatataaggaactcagtaattaaaggcctgggatttggagttcgacagacctgggtttgaaatcctacttaactgctaatttaccatgtggtttttgacaagttacctaacttctctaagctctattttcacgtctatgagttaggaataattatagcaactatttcatacagctgtgataaattatttcagatagtgttttcagtgcataaaatgccctcaatcaagtttaactgtcagtggtattcttaatagtagctcaattatatctaatcactttgtacatctaaatgaaagatgacatctccctagggaaactccttcccaaataccactcttatgaggactcaaagatccatattgagattctccaataaatacatgaccatatgtgtacttatagtttatctgtaagtcaagtctctatcactccatctgtctatactagcaatgaaaataagacaacctatctccatgatgtgtcaagaaagcaggacaattgtattaaacttttgtagtatgtaggatgggccacccaagacataatcactttgtcccagaaagtagtttttctgcatgtggtattttgttttgtactttcatgttttattttttaattgataagtaaaaattgtatatattttgcacatgatattttttatgtttcctgcagtagtgatgagcttcgttcacagcaactaaatattggagcaaaatgtttgaatctgtgattctctatagtcactgtcattcaaaaggaaattccagttagtgattcaaataggcgatctctaatatttagtactttactgagctcatatctaatcccttttagttgtaaagtacaactatcagaattttttttactatttgaggaaaaaaattagtttctattcacccagaagggctgattactctcatcaaatactctggcttatgaataatgtatgtatgtaggtaggtattatatgtatgtatatactaagtttgtatgtgtatgtgtggtaaaacccagactcccacagctcaagttctttcattcctaccccctaaaggaaagccttgctaccagtttggtttttgtccttcttgttttttctctatgattttataggcataaaatatatttatattggcattaatataaacatagacatgtttagctatagatatgtaagaatatttgttttatttacaaaaataggatcatattataattttcatttcccatttaacaataagatgtagacagcaagatctacatacatagatccagatcagcacatatagctctatttcactctaagggcatggtacatggtattccactgaatagctgtatcattcttctattaagggacatttaagttcttatagtttttgggtttttttgttttattttgttttgctattacaaacaatattccagtagcttcctttgtacataagtatttttacttatctgttttgctataatttttgtctaaatagaatcttataggtaaaacttctgagttattgcatagtatattttaaatgttaataaatacttctcaattgccttctaaaagtttgttccaatttacatgccctccctgacaacagtatgtgagaatattctgatactttactggattagaaaatatttccattacctcagagattacacttgtgaggatataatctctgttcatggagtaaacagtgtatgtgtgtgtgcttgtgtgtgtgcattcgtgtgcgtgcgtgtgtgtgtaggtttggtcatattttaaatgtgttgggagtatggtctatctctaactcaaatggtgtcaaccccatagtgacaagcattctgtggcgtcatgcattccatggacagctcagcaactgtttcccttgatgttgaaaacagcattctgccagagtctgtgctgacagacaacattagtcatccagtcttttccacagggctgaattgtttgttgaaaaaagccattaggagtaataaagcaatgtgagactaagataatttttcttgagtttgctaatgctaaacaaacacataccctgtcaaggcagccagtaagcagtatgaggcctgctgcttacctgtgctcacaggtggcagcaaaatcaattagctgcttctacccatggcaagtcagtgatattgatccactttataaagctacatgacattaaattgtttttttttgtaaaaaggcatctttcattctgtatttttcacagaacttctcacaactaactcagctctctatgcctcttcgtactaaaagaaacttgataaatagcctaattttctctaaggttcccaaaagacttttatcaaaactatctcacatctcaccatacctgagatccatatgcaaataatgtgctgatcttggagaaattatataagaccaaaaagaccagatgtcaccctcatctttaaaatgaggcaaaatatgcatgatatcatttagtatctttatatcagcatctttaaaaattttcaaaaagttgtacacaactgaaatatgcagaagttattggtagaataaattatggcacaggctaagagtggaatattttgcagtcattattagtaaaaagtgatattttggaagagtatcttatgaaatggagacttattcatggtaggctctttagtttacaaaagaagtgtgttgaaatgcaatatgtatagtaggatttaatcctgtacaacaaaatgtatttaaataacgagaaataccactgtatatcaacagattgttgctgggtagtagtattgtgagaggtttatattttcttccttaagtttttccacatattctaaaataagtagtaccaaatgtgctttatataacacataaggaagaacgttttaaccatcaaatgacgagacgttggtataggttatcaaagaaagttataaagcttccattatagggaaggagtgttgaagaagataatatatttaagcacatgttcttaactatttgcagataacttgaacctgattatttagataaactttggcatcagatctcggtacaaattcaagctctgcttcttacaagctaaattattctgaaattattctggagcagttgtatcaccagtttgagccacagttttcttgtatctattaaatgagtataataaaagcattcctgtagagcttctgtgggaataaacataatgtaagtaaaattagtatgtaacacatacctggtacatactaagtatggcagagctgggatctctgttcaccaaatccatttccctatcctcctaggcagacatctagtctatatttctcagcctcaaattacagtgaaggatgataattttatgaagtcgtggctattgtaatgtaggtagatataatgtatgccaattccaggtctggcctataaagacctcttgcgaaatccttcattctttccgtagctgctaagtggaagtcactgccactaggtgaaggtggaagagctcccaataacctgggttttaaaattactagatcaaggattctctaattccttcacctattgaactttacaagagcaacaaattctattgtgtgaagccattggaactcttaaatttatttgttatagcagttagtgttattttaactaatagagtgctcaataaatagtaactgtaaccactactaatatctcccctaattttaagatttccctacttacaactgctttaaaatacaaaggagtggggtgggcgtaggggccaaaatttaaaagatagttggtaataaagctgggacgggatttatggtgactggcatgccacctgattctaaaaataggactgtatttcagaagaaggaaaaggttatatagaaatatgatctagtgaagcaactgcttcagagaaggtgcatgacatcatagccatatccaccctaaggtctgcacaaacctcctatacaaagagaaagctgatatatttccaagaatatcttctaggtgctgttatccagtttgagtacgtgatctttttcttttatgcacggtgcagagtcaaacggttgcaaaattgaagtatgcattgcctttgcctctagaatgagtcatgaactcaaaggtctggctagttgtggtcatgaaagattccctagactcattcaccagagcaagatgcctttcagtgttgaggtaagttaattcctgcacatgtgtagtttgtaaagccctttgggatgcaaagctctctgcaattgtcagatgttctttagattattagacaggaagtcaggataaaagcgcttccaaatgctacaaatctctaaggatgtaagcagtgctgtataataaaaattgcagtaagccatgcaaaccctctgctacaggcagtatcacaaaagttcagtttttgtttgtccttcctgtgaagtattactcttatttaagcatagaatctatgtcctaagttggtatacaatgtttagatgctgatagctttaactatttttaaaaccttgatgaaaatatctctactgcttccagacacttgaagtgaacatttcaaatccccataagaatgatgtatgtaattacattactgtataataaatgcagttatgagatgaaatggaataggtttcaggagaagagtccaagaatttcagtacataatgatacattctcagttctgcagttcaaaatgagatacaatatggcacagacttccaatgatgatccacattagaggaaaaaaagccccaagcaatagactgatgggatgagtagtaacaaaaatatctgaatgctacactgtgattatcaaattctgtacttaatataagcactaccatccccaaacagggtcaaaagtttaaagggaacattgcagaaaatgaggcaccagagaaagttataactaactaggtcaaaagtgttcagagtgtcaaaactcagaacgtctataaaagggcaggaaaatgtcacaagcctacaagaagcaagcgatgactccataaaatctgattattattataaaagacaggattgttggaagtaagcaagaaaattattcccagtatttaaaatgtaaaaataaagataacatacctgtcacagaagtttctccaaaattaaatgctaaataaattaaagcaattaccaggccagtagctgtgaaaattgtaataaagaaggatccccttcctcaatactttttctccattttttctgctacctgccaggcctctaacttcctgttgtgaaattgctgcttattgtcatttgaaaacctaattgtgatttgtttaaaatgtgctttttataatttagaatgaaagctacttaattatctttgtatttctttactccttgatttaatgggtcattgctttagatttattaactaaatttcacatctttgttatttataaaagacctactttatagaaaaatcattgttttaaaagcatgtaagaagtcctctcttgctattatctacacatacagctcgtcaaatagacatatctgatcattttgaaggggacttaaaggaaaaaaataaaaatatagaagaccatttgggctaggaagctttatctggtgccagtgatcaggcaaaggaactactggggttcatgagtagtccaaataaatagcatacttcttcagcaccttaatttcctgtaaaagctattttataaaatatagcttagtttaaaaattaaacagcttcttagtgtttaacttcaaaattactttgcccttcccacccaatcttatcagaagaggactgggagaagtgtccccacgtgggagcagatgagaatgcatccactttgcaggaaggccaactgcctagggaaaagcagaagctgaataaaccttgctcaatttattggtttcaaatttaccaattaaatatgtccagcagaggaatgagttagaggaaaagaaaagtcaggaatgatatgactagtaaaactttctacatagaaaaaaaagtcagagctgggaataggcattcccagcttatagtttcaaaaataattaagcagtctttttgaagagtagccttgccaactcaaatctagaaacatcaatctccaaccatctttgctgctgccgcctgatgatgcagcactgaaaaccaaaactcagcatcttgatgtattttaacttatcagccttcaaagaacagccaagtacaatttttgaaaagacaaaaatcagtcagctgataactggcctggatggtgttccattcaggattctggtagtgacagaattcattcagatggtttaaataaacatactttaatgagggtattacttataagggtgtgggcaggattaagggaacaaacaacaaatactggggcactccaactctaataatggtaggacattagtagcactcttaggtcagaggaaaatagtttcaattacaaggggttggaaggtgaaagtaaagtgaagtagaggcatttcttcccttctccctccctgcctcagcttcaccctacctccattttccagtctcttgttgacccccattgactgaagcctatagaaactggagagtaagtgatctgaaaggacagttacttggggtcagcctcccaaggcacagagtgtgacagagatgagtgaagaatgaatctgaaggtcaaatggagaacaactagcagagacaaattttactcaagaagaaaaatataatcctagagattttatttgtggtcaatataaattctgcaaactaatttttagagtgatattgttgaaaggtcctaattccagctctaactctcagacaagctttgccccaactgatgcaaacagatggatgtctattcatccacctcataaatgtcaccaaagggaaatgctatgatttcccatagtaaaacaattgtagccattttatttcaactaatttggtagatgtttgccttttttcactccaagtagattatatggtatgcttttttatgtgtattctaagtaatttcaccactacatactctgtgtattcattttctatttctgcataatagattctcacaaaattagcaacttaaaacagcattaacttattatttcacagtttctatagatcaaaaatccagtaggatatgatcaggtgcttggttcaggataccacaggctgaaatcaatgtgttgaccaggctgagttcttattatttggagaccgtgaggaaaactcttctaccaatctcattcttcttattggcagttttgttccttgtgtgtgtaggattaagatctttgtttccttattggctatcaatcagggccactttcagctcctagaggtcacccacattccttgccacatggccccttccttcttcaagccatcaacagcgcaccaaatatttttcatgcttcaaacctctgacttcctcagtctgactcctaagcccagatttaaagggctcatatgctgaagtcaagctcatttgaatcatttttatatcataaggtcaactaaattgagaccttaattacttatgcaaaatcccttttgccatgtaatgtaacataataaagaaaattctgtcttatcacaggtttcacgtacacttattcacaggtttcacgtacactcaaggggaggaaattacacagttcacaaacaccagagggaaaaaattgggggagctatcttagaactctgcataccacactatgggatgtcagtaaatcttattaatataatctagtaattttctcccttaattctaaatttccctgtctttcaagtattcaggaaaacaaagctcattgtatcatcatcatttttaaaatgaaccattttgttcttgcaaacttcataaaccatatctcataacttttgaacctctgattaaataattccaactcctttaatgttttttcatgtttactttttcaaacacattcatatttcaatttatattctcttaatcttcttcattttttcatatccctcttacattggtgcgtcaatttttgttcttaaagtcatttacagtggaacagttctttaatatatttgcaagtcttcttgaacagctgattcttattctaataattattgctttagtcctttaaaaaggaagccatggccattagaaaactaaatttaatcattaaaaagaaatctttcattatccaggtactcaaaatattgttgaaatatagtagttgtaacagagggagtaagtagacaggggatagtgctagaaactgagaagttggaactcagttagctttcatggtgtcactcagttaccaagtgatgctggagagtgtctgagacttttgtttatcacagttacttcatccgtacaagtgattttcttgatttcctattcttgctaacacttcttaattgtccttgagataacagaaaacaaaatctatgaataggtgtattgaactcagtattttttaactaaaattaaataataagttgaaaattacctaaggtaacaattgaattatagtaaaaactaatctgaaagtagaagtttcttgtttgtctccatggatgattgataggtttatactattggctccctaggatctgtaaactagggttcaaatggtaagaaaaaataaaatttgctccagaaagtatcgaataatccaactgccaatgattacattgttctggataattgcatttgacagtccataacacaccaccccgctgtgagggaagacatgtcaagaaccgatgcactgttcttgctgttattctgcaagatttacattcatgccttgaggtgctccaaagagaaaacattcatacaaaatatttttaatgttttctaatctatttgttacaggattagcttttgttatgaaacatagggtgtcacaattaaaatcagctctaggctgggcacagtaactcacacctgtactttcagcactttgggaggctgagggggaggatcgatcacataaggccaggagttcaagacaagcctggacaacatagtgagaccctatctctacaaaaaatttttaaaaattagccagacatgatgatgtgctactgtagtcctagctacttgggaggctgaggtaggaggattgtttgagcctaggaggtcaagattgcagtgagatatgattgcaccactgcactccagcctgggtgacagagtgagatcctgtctgaaaacaaaaccaaaaataaaaaccaatcttagttgtgttttccaggctgtgttaaactattgaatgacttgagcaaaacaaaacaaaacaaaacaaaacaaaacaaaacaaaacaaaaaaggcctcttattcaaaatgcaatataaaaaatgttcagcaactcttacttgggagatttttatataaggagtatgtttgttagtaaataaatacaacataaaattgaatggaagtgtgctgagttgtttttctatagaaggcaaaagacacacaaatagatgatatgagagagagtcattaaaccgagtcatttgttcaagtccaagccagatcagtagcaaccaaaagctattactaagtgatgacatgttttgacctatgagaaataagcctgtccagttcctaagctacatggattggcactatattttggaataaatgagcacaggtacttaccatcctcctcacctctagggattgaccttttccaatggggttttggcccattgacataacaatggggaaaattgcaatgcagataacctttgtgtgacattctataggcagttgccccataagtcaaatttcagttgacccaggattatctaaaaaggttgatcaaattagtacacttaagaatgaataatgtatggtcctgtttcccaaatgaattggagaaaactttacagagagacaaaagggaaagacaaaaaaatgctaatcaatgttctagcagccacctgtgagtgactaagaatcgttaattaaaattccattcaactataaaaaatgcaattactgtaactccaattgttaactttcattagaggcaagaacaatcagaaacacacatatacagatacaaaggaaaaataacttgcttctgatctgtaaaatcgtgcatgcatgtgcacatgcacacacaaacacactgaccagatgggtttaaaatttattctgtggtaaactactattgacagattctaactctagtttgtctcattaggtcaccctaaagaaatagaaccagaagattgcagaattgcggccttcgattctcctctctaagtagactgagtacacttgaagacaacaatatgggcattcattagatggaatttggaagacaaagctgaggttaaaaattacatttcttttgactaaacttaggcaggacatttagtctagcgttcaccacaggtctcattggtccctactacctgtaccagactttccacaggcacactatatgcgtggccattaaggtttttagtttgcattcccaggaataaattgatttctcactttgataacatgctgtgctacttctggcttttacattaaaacccttagaggatgataagtatggttacagaacacattgtctgagtttcagatctggcttattcacttaataaatgctatagtttggatattcatccaccccccgatatctcgcattgaaatttaatcctcattgatggaaatgaggcctaattggagctgtttgggtcatgtgggtggattcctcatgaatggcttgacatcgtcctcaaagtaatgagcgagttcttgctctgttagttcccatgagagctggttgttaagaagagcctggcacctccactctctttctcttgcttcctatctcaccgtgtgatctctgcacagttgaccccactttgtcttctgccatgagtagaagcagcctgagtccctcaacagaagccaagcagatgctggcaccatgcttcttgtacagcctacacaacatgagccaaataaagctattttctttataaattacccagcctcaggtaatccttgaaagcaatactaaatggactaaaacagtaactatgtgactactttataccagagactcaaaatttctgagcctcagtttctatgactataaaatagggatggagataatattaatatctaattcacagggttattgtgagtattcaagtgtggttaaaatactgtctggaacgtagtaagtactatgaaagtgtttgttattactttaagaaggtggtagggtacttttgaactactcggaggctaaatagtggtgacaaaggaggacagaggaagccaaaagagaaaaagtcttaatctgattaattatatgtgggtcaaaaataaataccagcaccaatgaatatgaggtaagacaagtgttttgctcaattacgatattaaatcttattgcaaattttttgagccttctataagactttaattgggaccaattcccccactgaaggcagctttttattcatttcattgtcagtataaatgactttcactcatctgaatgcaatcatgagatctacctgacagtttcatctcctgaagaaattgttttttattacatgtgcttttatcatgtaaattttcttgcattgaaaatcaagacatgccccaaaacaatctaattttgggttttacttttaatggaggctttaatgtcaataatttgtggaggaatacagagtaatttagaagcctatttcagagtgattgagaaaatattcattgatgccagcaatattccagtattctttgtttgagacatccatggaaatggtttgagtagcttattctagtaatttccaaagctggtgaaaagaattcaccatgaatcacaatagcagtgtttttaaacagatagagccatagaaaataaggtatcaaatttctatatctgatgtatggtctcctctagtttgggaaaggaagatactatatcatcagtaaacaagaacagtgaggggaataataaacctcaaagctctgtggcctaagacagacaataaaggttttattttttgctcatgcttcgtgtacaacacaggtcagaagaaggctctgctttttggagtcattcaggaacccaccccgacagagactctgtttcatcagtgtaacagagggaaggaaatgtgaagattacgtactggctattaaagtgtttgccttgaaaagataccggttggttctgctcacatttcattagctacaaacagtcacatggccatgcttaacttcaaggggactgaaaagtgcaatcctaccatgtgctgagaatgataaggtctggaatagttatgaacaaccttgattaccaccacagatgttcatctaatttacaggaaaattagaagtctgtgtaagattgctgcacttttagaaaaattaggtctgattgtttttatttgaataccctttcgtagcctgggttcccagaaagtaaagtctgaggcaatagttctatgctactaatagtattggaatatacaacttcaggacagcaagggcaaggggaaaaggggaaaaggtagggtaataagaagagtaaatattagagcatgcattaatatatggcattggtaggcatcaagcctgtatcagtctgttttcgtgctgctgataaagacatatctgagaccaggaaatttacaaaagaaagtggtttatggacttacttacagttccacatggctggggagtcctcacaatcatggcagaaggtgaaaggcatgtctcacatggtggcagacatgagaagagaacttgtgcagggaaactcccctttttaaaaccatcagatcttgtgagacatattcactctcacaagaacagcatgggaaagacctgctcctgtgattgagttacctcccatggtgttcctcccacaacacatggaaattaaacatgagatttggttgaggacacaaccaaaccatatcatttcgcccctgctcccctgccaaatctcatgccttcatatttcaaaacaatcatgtcttcccaacagtccgccaaattcttatttcagcattaactcaaaagttcacagtccaaagtttcctctgacacaaggcaattcccttctgcctatgagcctgcaaaatcaaaagcaagttagttacttcctaaatacaacgtggtacaggcattgggtaaatacagccattccaaattggagaaattggtcaaaacaaaggggttacaggccccacgcaagtccaaaatccagtgcggcagtcaaatcttaaagctccaaaatgatctcttttgactccatgtctcacatccaggtcacactgatgcaagaggtgggttcccatggttttgggcagctccgcccctgtggcattgttgggtacaacctccctcctggctgctttcatgggttgacattgtctgcgacatttccaggtgcacagtgcaagctgttggcggatctatcattctagcgtctggaggatggtggcctcttctcacagctccactaggtagtgccccagtagggactcagtgtggggtctccaaccccacatttcccttctgcattgccctagcagaggttatccatgactcatccccacccaagtaagaaacttttaaaattatctgatactcaataaatgttggttaattaagcaacattttaaatgtataatgtttataagacagtcattttctaaagggaaactaaacctgtcattttggtaggagaaatttaaaaataaaatatcaatcagtaagactgaatcatttcaaaacctctaacttctcacaatcagtgggaaaaaaaatcaaaaattccaaaagaagagttttacaatgtggagaagtaaaaaggacatgaagtggtaataatgatatgctaacataggtatatattaggcctgatggcaaaggggtgagaactacctcacaggttttcaccccaatttcaagctttgctaattcataaaaagccatttttagaaaatgatatcattgaaaatcttctcattgacttttctcagcttaaacgtttaaaattttatctagctgtaaatcaatcatccctttatttaaagagctatgaacatttttcttaatatataaaggaaaaaactgtctttaaatctagcaaatactttcactggttaaataaaaaaaaaatcttgttttctttcttctgacagctggtacacaaagaaaaggagaataataagttttaattatacctttcaaaacccaacagatttgaaagctattcaggaattacatgagagaattctcagcattaacttgtgggtggttaagagatgttagctctcattcttgagggtgagatggccaaacttgtgagttgaaccacaaaactaaaattcccaaatttgcaagcctttataatgattattttcttcaggagtgccctgtgtctgtttttctcttttttttccccttacttaagaatggttcaatcaagtcatcaacactttaaatcatcacacagctcttcttctccaattacatcaaccaacatcagatgtgaaaatagagcacacatcaagcaaaaagatgggattataatatcttccactttagccagggagtcaagcagagcgaagaatgagagcatgcacaagagagacggtgtaaatagtcttttatgattcattccttgactctgaggaaaaaaagaatattgcatttgttaattctaaagtttagaaatgaatctggaagcagatgttggcaagatggccaaaaaggacattcgatctcttgtctccccacaaaaccatcagtgtaaacaaccacacatatgcaaaaataacttccgaagagctaaggaaaccaggtgagagattacagcatctgggaacagcaaagaaataagaaaaacatattcaagataataggaacaacagttttcattatcattataacctcttccccaaccccaggcagcacatcatggctagagacaccctcctcttgaaagaaggaagtgagcattggactttgcctcagattctaacacaagactcaccacagtaaaacccagtgccaggacctcatggccccagactctagtccagtatccatgagctgaacttctaggcctgccccactaccaggccaaccttagcagcccccggcttcagaccagccccagcactcagccagcccctgtgatttcagagtttatatctatcccagcatcatggaaggcccccacagccctagatatcaggctggcacctgtgaatttagcctccgggtcagttcctttgtatacaggctctaggcccacccagaaccaggctagcccctgcagccacaggctccagaccagcccagagtcaggttggaatacacagctttgagcttcagacccaccccagcaccacgtaagcacccctgacctcagacatcaggccaacacctgcagacagaggctctaggcttgcctagagccaagccagtccctgcaacaccactcttcaggccatctcctgtgtccccatgcttcagccgacccaaggtgcaagctcattccaataaattgcagtgctaggccagccttcaaaaaccaagctccaaaaccacccctgtggactcaggttccagtttggccccagcatcccaaggatccaggtcagcccttgcagatctaacctccaggccaccacagtcataccaagtctctagggtagtccccataggtccgggttctagcacgctccctgtgggctgaggttctaggccagcaaccacacacagcctccaggccagatctcacataacaaggtcccaggccagtctccacagcttcaggatccaggccagtcctcatgattctgggaactggatcaccaccaatgatgccaggatccagacaagcccccacaaacccaggccccatgacttcccaagcaccaggcaggccccagaccctcagctagtcctggtggtcccaggctccagtgaatccaggatccaggctcattccaagtcgacctttgtgccaagccagcctccacagattgactccaggccaccactgcaaaactaggctccagaccaccccatggacccagggcccaggcctgctgccatggactcaagctcgaggcttgccccagcaaaagaccagcccctgtagactcaggcttcaggccagctccctcagaatcaggcagaagtctcaaccacatgctgatccaggttacagacaagccccctatgggcccaggaccaaggcctatccctgtaaactccaacttcagacccatctcactgaacccaggtttcaggcatgccctcatggacccaggctccaggatcacccaccatggactcaatcaactggaccaacccagagaattcaggctccaggtccaatcctgtggattcaggcacaataactgcccgcctgctgactcgggtatcagcccagacagtccaagtacttcaacagtcagcccatccacagaccctaccatacagccttcccagaatctctggatgcactgattggtgaatgactttcccagatgatgtccatctgtaaagactgaaaacgttccaaattttttaaatgttcagataccagtgcaggaccacagggatcagaaaaagtcagggaaactatattaccaaatgaacaaaataaagtgccaatagccaaccctaatgaaatgaagatgtataaactgcctgaaaacaagatcaaaataattgttttaaggaagctcagtgaacttcaagaaaatacagaggaacaattcaacaaaacaggaaaacaataaatgatcaaaattacaattcaacagagagattgaaattattttaaaaatcaaacaaattctgaagccagaaataaaaagaacaaaatgaaaagtgtgatagagtgtcaacagcagaactgttcaagcaaaagaaaaaatctgtgaacctgaacacaggttatttgaagatacataatcagaggagaaaaaaaggataaaaacaaatgaggaaagcttatgagacttacaacatcaagagcaaatgttcagattataggactaaaataaaaagaagagagagacaacgggccagaaaatgtatttaaagaagtaatagtagaaaactttccaaatctgtagaaagatgtaaatatccaggtacgagaaggtcaagtttccaattatattcaaaccaaacaagaaaacaccaagaaaaaaacagaatcaaactatcgaatatcaaagacaaagaaaggattctagaaacagcacaagaaacatatgtatgaggaaattccaataaagctagcaatgttgttttcattattttttttatttttttttttaatagtacaaagttggggctctttattcagacgatagagtaaggaacagcaaagtgggagggctacaccatcaccatgacaacagaaagcctcataaacgtaaagtccctcgacttctgttgggcagactcttcctagctcaggagaaacatgttttaactggctgagaacaaggccaggcagcctggccacagtgtggaagggcagccagaggcgcggcctctggtcagtcctggaagtgcttggtgagggcttctagcagctcctgcttcttcagccagtactccaggcaggcctctttcatcattggcacagtgaactttcccaatgtgcccttgctgatgtgggtcttcagctcctcttctgaatactccgcttgggccttttgcttctggaaccttcattattgcattttctcttggtaattttcccttcaggattataatctggtgagtagacaagttccttaaactcattcaccatggagcccagtcttttattcatttcttcaaccttgggtaatataaggtccactgcttgttcctccatcaaatacaagatcaagggctccaggttcccgaagtgctgctgcagcacggggttctcaaagctgtcacttctgtatgtgaagcagagcttctgaatgatagccttcatgttgtccacctgctctggagttgccatgactttttcagtaaagggcaccttccttttatcatcagcaaagggtaaaaagaccagctggaaacctggagtagtcacctgaattttctggtcatccaactcctcttcctgtgacaccaaagccaccaaataaggggggatgttcctgcggggtgtgtatctgcacaatgctatgaccaccttctccagacacttaatgagcagagcactgaacagggttgaactcccattcaccggcgactcctcagggtacgtgaacaaggagggcctcgggtaatggtgctccttcagcattaccaagggcttgaaaaccatgagcatcaaagctggttcatcaaaccattttagctcttctgtttcctctttctccagtataatctgatgactcccatagatctgagaccgcttggtatcgctaggcagaagcaaactgccggtattaatattaaatttccgggacttggttttcactggttcatttgttttccgatagagttttattgaaggaggcttgagagccttctggacgagactgtaaatgcccacagagatcactatgtctttgttgagcttcagctttaacctgctgagtgcccatttcctggtctccttggcacgaaccttctgcaacaggtcttctagattgctggattcctcaaagtgaactggattcctcaaaggatgaggtcctcatcctttgccatgctgatgatatctctgtagaacaaggatatgtcaaagcccccaggtttcttcaggggcatcaagtcaaggaagatgcctatatctcgtagatcaccggctttggtcctggcctggcaggccttaacactgtcattgccatgagggttgtcttcattggtgagcagcatgattttctatgactcatcttgaactggatatcactaaacagtttggcacagacccacagaacttcactgaatgagtagtcagatccatggcccatcaggtcttcgaaacatttttgtccctgctgccccttaaactggtcaagctttagaatttgttttgcacctggattttccaactcctgtaagacgtaaatatttttaaaattcactgaatttttgtctttctcagtatcataaagatctcgatcactgcttatgatcttactcatgtacacactttggatacactggatgctcatgtcaaaaggagtcaactcaccttcgctctgagattcaaacatagccctggaggcatcaaccaaaaaaaattaaactatcacttcctgaatatttctagtattcacttgcttcaaggtcctcttcttcttctgcttcttcatcaccctcggttttataataagactcacaccctgatgtgttggctactgctcactttggcacagggaggtaacccacaatggatttcatagcagaaaccttgcagaacaagagagagtgggatgatatattcaaaatgatgaagaaaaaaccctgccaacaagaatgctttctctggaaaagctgttcttcagtaataaaggagaaataaatactttcccaaacaaaagctgaaggatatcatcaccaccagacctgtttttcaacaaatgctaaagagaattcttcaagcttaattttaagaaaatgctaaatagcaacactaaaacgtgaaagtgtaaaactcactggtaaaagtcagcacaaggtcaaattcagaacagtctaatactgtaaaggtggtgtataaattatttaaaaatttagtatgaagattaaaataaaatttataaataaaagacaagaaatcaaagcataccactagagaaaatcacctaatcacaaacaaagacagcaagagaggaagaaaggaacaaaggatctacaaaacaaccagaaaacaattaacaagagaggtggctaagatggccgactaaaagcagctagtgtgtgtggctctcacagagaagagtggaaggggtgagtaaatatagcaccttcaacggaatcatccaggtacatgcatggggattaatcaaataaacaactttacccatggagaatagagaaaagcaccacaggatgatggcccacctgggagtggcagggagccaaaggaacctccgctcccagggaagtggtgagtgaatgtgtgtccccaagaatgcatgcttctcccacggatctttgcaaccctcagatcaagagatctctttgtgaacccactccaccagggcctttagtctgccacccagagctacgtggagttttggcagagcagccgctcaggcatgcacagagatctggaagttttagatgctcttgctttccaggcttcccagcaaaagtaactgcaactctggaaaagggcaaagtgggaggttagactcccatacatatccctaggaaagaggctgaatccagaaggtcaagcagcaatggtctatgggcaccacttccaaggcacctcaccagataagacccactcgcctggaattccagtcagctacagatggcagtattgtgcctccatgggatggagctcccagggtgagtggtaggcccggatctttgctgtttggatgacttagctgttatggccttcgggctttggtgagtccaagctgaccagagatggaaagaatcctccagcacagcacaactgctctactgaaatgtggccagactgcttctttaagtgtgtccctgattccattcctcatcactgggtggagcctcccaaccggggcctttagccacccccctcagtgttctccagtcagcagagatttgaaaactctctgggacagagcactcagagggagagtcagagagctccctgtgagctgtttggatgacttagttgttctagctttcaggctttggagagcccaagccaactgagggtggaagcagtaccccagaatagcacagctgccctacagaaatgtggccagactgctttttaagcaggtctctgatcccatttctcctcaccgagtggactctcccaacaggggtcttcagcgacccccaccggtggtctttggctgacagaggttttagacctccttgggatggagctaccagagagagggtcgggccaccatcatttctgttttggtgacttagctgttccagcctttgagctttggagtgtctcaggagccgaagtggaccccaagcacagcacagctgctctacaaaaatgtggccagactaattttttaagcagctcccaaactctgttcctcctgaccgggtgagacctcccaactggggtcctctgccacctcttacaggtgcgttcaggccagcaacacctgtgccttcctgggacagagcacccacagggagcagcaggctgccattttgccattttgcagtcttcactggtgatacctccaggtactggaaaatcccaggagactagggaatggagtggacccccagtatatcaccatagctctacggaaaagtggccagactcttacatgggggtcctctcatacctcctcactgggcaggtcctccaggcctgggcctctagccaccccccaccagagatatgaagctaatagcaacttggcaactccctggacagagcctccaggggcaactgacagcctctctgccactgtctctgcagtggaactgtccttactaccctcagactaatgaagaagcaaagaccctaagtatcttatccacatctccaacaagctgcaattgccccaaggacaggaggctagtccatctcccatgagtcccaaacatcccctactgctcatcaccaggcagaaaacccctggctttgggcccacagtacagactctccatcctgggctgattgctctgagcaattgctgacccacatctctctcaggtggagtccccaggagaggagcaaagtggtaaaggcagcaagccagctgatgcagagccgagagggtttggtgcaggagcatctgtagtagagcatggctatccctctaggttcaacttgcttccataacagactttagctctgagggaactgtcagacatgatgtccgcagggtggtcatgcacatcagatggagctggcccaacctgagcactctttggtctgctggcctctcccaaggccccagcctggccatgtctgcttacagggcagtcttgtgtgcctgggggtccacctcatagcttctgtaccagtggttcatgcctgactggtggagagctccagtgaggcagcccctatggccacacaccagtctgcatagtacctctgcaaactgcagcttccccaagcccacagcaaccccccacatcactttgctggcacgtgtctgcatgaacaagatttattttatttgccccaccagcacgcaggagtgcagtatgcccccctaacccccaacaaccagcattgcagacggagccttgttggacacagagccagcaaaacctacccctgacagcaccctgcccttgcactaatgctgcgcagagaacagggaatcctcccacatcctgaatcatcactcctgcttgcagggcacagagaaggcaccaagacctttgctggacagcaccctacttcaagccaacaccacctccattgcaacagtgcacacagtcaccagcaggaaaccccctcctgccccattttctgccaactgccttgactctgccactgtgattaatgcccgcagggaggcagacacccctgcatctgctggcactctactgctgctgccacatctcagtcccctctgtgcagtagactccaaaacttgaggagccagagaaaaaagtcagggcccaatacaagtcccccagagttagagcacaaagtccaggtgttgggagctgaatgtcggccccctaaaatcttccagaaatgaagtaagttggctgaatccaccttataccacaatcaaactctcaaggtcatcaaatagaataaaaggaaaaaaaaattccaaagttcagcaatcacaaagattgagggtagataagcccacaaagatgaaaaagaatcagcataagaacactgaaaactcaaaaagccagagtaccttctttcctccaaatgacctcatcatctctccaggaagggttcggactgggcttatgctgagatggctgaaaggacaaaagtggaagtcagaatacgaattggaacaaagttcactgagttactggagtacattgtaacccgatgcaaggaagctaaaaatcatgagaaaacattgcagaagctgatagacaaaagagccagtatagagaacgacataactgacctgatagagctaaaaaacacgctacagtaatttcataatgcaatcacaagtattaatagcagaatacataaagtggaggaaagaatctcagagcttgaatactggccttctgaaacaagacatccagatgagaatagagaaaaaaagaatgaaaaggaatgaacacaacctcagagaaatatgaaattaggtaaagagactgaatctatgactaattggtatacctgaaagagatggagagaatggaaccaatctgcaaaacatatttcaggatatcacccatacgaaattccccaacctagctagagtggtcaacatacaaattcagaaaatgcagagaaccccagtaatatattccactagaagatcatccccaagacacaaaaccatcagatttgccaacgtcaaaatgaaagaaaaaattttaaaggcagctagagagaaaggtctgatcacctaaaaatggaagcccatcagactaacaatagatctctcagctaaaaccttacaagccagaagattggcaccaatattcaacattcttaagggaaagaaattccaacacagaattttatatttggccaaactaagtgtcataagcaaaggagaagtaaaaccctttccagacaagcaaattctgagagaatttattaccaccagacctgccttacaagagctcctgaaggaagtaccaaatatggtaaggaccattaccagccactacaaaaacacttaagtacacagaacagtgacattataaagcaacgacattaaccagtctgcaaaataaccagctaacatcatgatgataagatcatatccatgcatatcaatactaactttaaatgtaaatgggctaaatgccccaattaaaagacacagtgtggcgagctcaataaagaaccacaacccgtcggtatgctgtcttcgaaagattcacctcacatgcaatgactcaaacaggctcaaaataaaggaacagagaaaaatctaccaagcaaataaaaaacagaaaaaagaaggggttgcaatcctagtttctcacgaaacagactttaaaccaacaaagatttaaaaagagaaaaaaggtactacgtaattttaaagggttcaattcaacaagaagatgtaactattctaaatatatatgcacccaacgcaggagcactcagattcataaagcaagttcttagagacctttaaagagacagactccaatgctataggagaaattttaactcttcactgacaatattagacagatcatggagacagaaaattaacaaagatattcaggacctgaactcagcactggatcaaatggacctgacagatatctaaagaactctccacccaaaaacaacagaacatactttcatctcatcgccaaatggaacatactctaaaattgatgaaattatcagaagtaaaacactcttcagcaaatgcataagtactgaagtcataacaaacagtctcatggaccacagcacaatcaaattagaaatcaagactaagcattttttcatatgtttgttggccatttgtatttcttcttttgagaactgtctattcatatccttagcccaattttgatggattgttttattcttgctgatttgtttgagttcattgtagattctggatattagtcctttgtcagatgtatagattgtgaagattttctcccactctgtgggttgtctgtttactctgctgattgttccttttgccatgcaaacactctttagttcaattaagtcccagctatttatctttgtttttagtgcatttgcttttgagtccttggtcatgaaatccttgcctaagccagtatctagaagggtttttccaatgttatcttctagcatttttatagtttcaggtcttagatttaagtctttaatccatcttgagttgatttttgtataaggtgagagatgaggatccagtttcattcttctacatatggttagccaattatcccagcaccgtttgttgaaaaggggattgcttccccactttattttttttgtttgctttgtcgaagatcagttggctgtaggtatttgggtttatttctgttttctctatactgttccattggtctatgtgcctatttttataccagtaccatgctgttttggtgactatggccttatagcttactttgaaatcaggtagtgtgatgcctccagatttgttctttttacttagtcttgctttggctgtgcatgctcttttttggttccatatgaactttagaattgttttttctaattctgtgaataatgatgatggtattttgatggggattgtgttgcatttgtagattgccaacaagtatatgaaaaaacgctcagcaccactaatgatcggggaaatacaaatcaaaaccacaatgcgatatcatttactcctgcaagaatggccataatcaaaaaaattaaaaaacagtagatgttggtgtgcatgtggtgatcagggaacacttctacactgcttgtaggaatgtaaactagtacaaacgactatgaaaaacagtgtggagattccttaaacaactgaaattagaactactatttgatccagcaatcccactactgagtatctacccagagaaaaagaagtcattatatgaaaaagatacttgcacacacatgtttatagcagcacaattcccaattgcaaaatagtggaaccaacccaaatggccatcaatcaatgagtggataaagaaactgttatatatatacgtatatatacacacacacacacacacacacacacacatatatatacgtagatatatacattatatacatatatacatatatatacatatatattatatatatatatacgatggaatgctactcagccataaaaaggaatgaattaatggcatttgcagtgacctggatgagattggagactattattacaagtgaagtaactcaggaattgagaaccaaacattttatgttctcactgatatgtggaagctaagctatgagaatgcagatgcgtaagaatgataaaatggactttggggacttggggggaaggataggggggtggggggaggagaggaataaaagactacaaatagggtacactgtatactattcgggtgatgggtacaccaaaatctcacaaatcacgactaaagaacttactcatgcaaccaaacaccacatgtaccccaataacctatggaaaaaataaataataataatgaagaataaatttgaaaaaagaaatcaagactaagaaattcactcaaaatgatactattacatggaaattgaataatctgttcatgaatgacttctgggtaaatgatgaatttaaggcagaaatcaagaaattatttgaaactattgagaacagataaagaaagaagacacagctaaagcagtattgagagaaatttcagcactaaatggtcacatcaaaaagaaagaaagatctcaagttaacaagctaacatcgcaactaaaagaactagagaaccaagggcaaacaaattccaaggctaccagaagacaagaaataaccaaaatctgagctgaactgaaggaaatagagacatgaaagatcattcaaaagataaatgaatcgaagagctgttttttttcttttttggaaaaaaactaataaaatagacagctaactagactcataaagaagaaaagagagaggggattcaaataaacataatcagaaacgaaaagggggatattaccactgaccccacagaaatataagcaaccatcagggaatattatgaacacctctatgcacaaaaactagaaaatctacaagaaatgaagaaattactggacacatacacactcccaaggctgaaccaggaataaattaaatcccggaacagatcaataatgagctctgaaattgaggcagtcataaatagcctaccaaacaaaaaaagcgcacgaccacgcagattaacagcttaattctaacagatgtacaaagaatagcttgtaccattcctactgaaactattctaaaaaattgaaaaggatggattcctccttaatttattctatgaggccagcatcatcctgataccaaaacctgacagagataaaacaaaaaaagaaaacttcaggccaatatccttgacgaacattgatgcaaaaatcctcaacaaaacactggcaaactgaacccagcagtatatcaaaaagtttatgcaggccgggtgaggtggctcacacctgtaatcctggcactttgagaggccaaggtgagcaggtcacctgaggtcaggagttcgagaccagcctgcccaacatggcgaaaccccgtctctactaaaaatacaaaaaatacgtggtggcgggcacctgtaattccagttactctggaggctgaggcaggagaatcccttgaatccaggaggtgaaggttgcagtgagccaagattgtgccactgcactccagcctgggcgacaagagtgaaactccatctgggaaaaaaaaggggggtttatgcaataagatcaagtaggctttatccctgggatgcaagtttggttcaaaatatgcaaatcaagaaatgggattcatcacttaaacagaactaaatataaaacccacaaaattttctcaataggtgcagaaaaggcttttgataaaattcaacactcctttgtgttaaaaactatcaataaactaggtattgaatgaacatacctcaaaataataagagacatatgtgacaaatccacagccaatatcatgccaaataggcaaaagctggaagcattcccctttcaaacctgcacaagaaaatgatgctctctcaccactcctattcaatatagtattgaaagttattgccagggcagccaagtaagagaaagaaataaaaggcatccaaataccaagaaaggaagtcaaactatccctgtctgcagatgacataattctctatatagaaaacctcatagcctcagcccaaaagcttcttaagcttataaacaacctcagtgaagtctcaggatacaaaatcaatgtgcaaatatctctagtattcctatacaccaacaacagttaacccaacagccaaatcaggaatgtactccaatttacaatagccataaaaataataaaatacctaggaatacaacttacaaggggcatgaagtacctcttcaaggagaactacaaactactgctcaaggaaataagacaggacacaaacaaatggaaaaacattccatgctcatggataggaagaatcaatatcatgaaaatggcaataatgcccaaagcaatttacagatttgatgctattcctattaaactaccattgacattcttcccagaaatagagaaaactattttaacattcacatggaaccaaaaaagagctcgaatagccaaggcagtcctaagcaaacagaacaatgctggagacatcacactaccagacttcaaaccatgctacaaggctacagtaaatgaaacaacatggtacaggtacaaaaacagacacatagagcaatggaatagaatagggaacccagaaataagaccacacacctacaattatctgatctttgacaaacctgacaaaaacaacaatggggaaacaattccctattcaataaatagtgctggaataactcctaatgtcatatgcagaagattaaaactggaccccttccttacaccatatataaaaattaactcaagatagattaaggacttaaatgtaaaaccccaaactataaaaaccctggaagacaacccaggcagtaccatttaggacataggcatgggcaaagatttcatgacaccaaaagcaattgcaacaaaagcaaaaattgacaaatgggatctcattaaactaaagagcttgtgcacagcaaaataaactatcaacagagtaaacaaacaatctacaggatgggagaaaaattttgcaaactatgcatctgacaatggtctaatatccagaatctataggaagcttaaacaaatttacgagaaaaaagcaactccattgaaaagtgggcaaattatgggaagagacacatttcaaaagaggacatacattcagccaacaatcacatgaaggaaagctcaatatcactgatcattacagaaatgcaaaacaaaactacaatgagatatcatctcacaccactcagaatagctattagtaaaaagtcaaaaaataacagatactggcaagattgtggagaaaaaggaatgcttatatcctgttggtggaagtgtaaattaattcaagcattgtggaagacagtgtggtgattcctcaaacacctaaagacagaaataccattagacccagcaatcccattactgggtatatacctaaaggaatataaattattctattataaagacacatgcctgcatatgttcattacaatcccattcacaatagtaaaaacatggaatcaacataaatgcccatcaatgatagaccttttaaagaaactgtggtacatatacaccttggaatactatgcagcaataaaaataataagatcatgttctttgcaaggacatggatggagccggaggtcattatccatagcaaactaacacaggtacagaaaaccaaatactgcatgttctcccttacaaatggaagctaaattatgagaatacattgacacatagaggggaacaacacccacaagggcctattggagggtgaagggtgagaggaaggagaggatcagaaaaaataactaatgggtaccatgcttaataccttggtgatgaagtaatctgtacaacaaacccccatgagacaagtttacctatgtaacaaacctgctcatgcaaccctcaacttaaaataaaagtaaaaaaatgcagtataatcaaaagaataccctaaactctgtattacttattttttattttgtaataaggcaaaattgctatcatatttgacattctacctaccccagaaaatcctggtatttaatgaaaagtaaaaattaataactaaataaattccatttttggttcaaaaaataccaagcaagtttatgcattaacaaggctggatttctttataacctaagcaatttctcaaggtagacacgagagataaaacatttatgaagactagtaataaccaccattttctattttattcagacatacaggaatgtatgttctggcttaattacctatgggctctgtgtccttaggcaagttactttaattctctgaaccccagttttctaaaaaatagtgtatattatacttctctggtatgttgaaaagataaaatgagataaagatataaagcaacgggtgactggcacataaaactaccagtttcatttctacttccccttattcttttagctctacctaatatttcttcataaacatgtattgtaagacacatacacataacaaaacacattactatccttcttatttgaagatggtagagttgtcagaagcttggattttcaaatcaaacagatctactgtctaactctagcttctccacttagtaactctgagtcagttccttaacttttcgaacctgcagtttcctcatctataaatagaaatgataacagaacctgcctcttaaagttgttgttaaatgggacaagcaagtaaaagacactgactgttccaatagctggaagtacacaataaattattagctgttttgtacctattgctgttattcataatataattattattacaattcattagtattattccagatcaatgtttcctaacttcgggctgaggataaatgaacaacaattttttcaaattttattttagatttaggaggtacatgtgcatgtttgttacctgggtatattgcatgatgctgaagtttagggtatgaatgatcacgtcactcaggtattgagcgtagtacccaaaagttagtttttcaatccttgcccccattcctccttctgccctctagcactccccagtatctattgttgccatctttatgtccctgaataccagatgtttagctcttactcataagtgagaacatgcagtacttgcttttctgtttctatgttaatttgtttatgataatgacctctagccccaaccatgttgctacaaaggacataataatgtcactcatttttatggctatgcagtaatccatggtatatatgtaccacattttctctatctagcccaccattgatcagcaccgaggttgattctatgtcttttctattgtgaatagatgaagagaagagtacatatttctttttggtagaactatttgttttcttttggatgcataccctataataggattgctgggtctaatggtagttctgtcttgcgttcttggagaaattgccaaactgctttccgcagtggatgaattaatttacattcccaccaatagtgtataaacagtcccttttattcacagcctggttagcatctgttgctttttgacattttaataattgccattctaactggtatgagacagtatcttattgtggttttgatttacgtttctttaatgagcagtgacatggagcatatttttcaagtttcttggccgcttgtttatcttattttcagaagtgtctgttcctgtcttttgctcattttttaatggggttatttgtttttgcttgttgaattaaattctttaaagattctggctattaggcatttgttggatgcatagtttgcaaatattttctccaattctgtaggtcatctgtttactcttttgatagtttcttttgctgtgcaaaagtcctttatttaattaggtgccacttgccaatttttgcatttgttgcaattgcttttgaggacttagtaataaattagtttccaaggccaaaatccagaatgatgtttcctaggtttctttccagggttcttatagtttcaggtttacatttaatatttaatccatcttgatttcatttttgtatatggtgaaaggtaggggtccagcttcatccttctgcatatggctagcccactatcccaacaccatttattaaataaggagtcctttccccattgcttatttttgttcactttgttgagtatcagatggattaaacaacattttatgtgtttctttttatcagtttttttagagacttcctactcccccactcattgctagggtacaaaatagggaacataacttgatagcaaaagaaatattgttttggatgatggaattgtgtgaaaatgtgagtaactaatgaagaacaatctctccattaattggagaagtccttccttctaagcctgaatcacatgaggcagaccacatagaagactctttcgtagtcccttctccctttcagaaaaacatatgccaactctgattaatctaagaacaaaatggagtgctaggtttggagactgcctatccaggaataccaccaaaaatcatggtgcacaactgattccatgaagataccactgctgctatcactgagcacagataccacagcttgctactgatatcaacaatttggggatgggcacggtggctcatgcctgtactccccctacactttgggaggccgaggcaggcagatcacttgaggccaggagttcgagaccagcctgggcaacatgacaaaaccccatctctactaaaaatacaaaaattagccagatgtggtggtgcacgcctgtaatcccagctactctgtaggctgaggaaggagaactgcttgaaccttgggggcagaggttgcagtgagccaagttcacagcactgcacttcagcctgggtgacaaagtgagactctgtgaaaaaaaaaaaattggtaactagacactatcaatttaacaattgcctcaggaattagtttagatgatggggagctaaaaacaataattgctgttcccatactggagtcccatctggtcattttgaatgtttaggcctaattcttatgtcagttttgtctcatatcacttttcctttgacaatattgcccatcaccacccaatctccatgggctgggaatgtaactgaaaaatcccttcacttcttgattcacatcttactcttttttgtctctctactttctctactgtttttccatgtctaaatcactgaggcaaatgtaaataaatgcatttttcttgggaaagtgactgcaatgagcttgcccattaaacaaccctattatttttctctctctttaatgaagatggataaatattatactgtagcttaacaactttattagctatgtgaattatagccctttcactagaagtcaaggtaattatgtttaaaaaaaaaaaaaaaggagcaatgggtttaagggaactttggtaggaactagaggcaacacccaatattggcataagtaatccatggtacaaaatcacaaagcaccaaccaaagcaacacatttcacaggtggagggagtaggatgtgctaggctgctctgaactggagtgtgaaatagatattagtctcctggtgctgctgaatatgcacaagggaaaatgcaacttagagacaacactaagcaagccttttaatttgtcgtttagtacttcagcagtaggaaatacagtataactgctgggttgtagtgagtccatgctcctattactgacagagcttggccttcataactaaaaatatttaaaaccctccagaaaaccccagaatttcatgtactcctggtgcatcattctggactagaaagtcctcaactgtgcactggcttttcaagcgtatatattgacattcttattaagcgatgagttagagagtaagagggatgatttgattatgttcaaaagtagaattaacatccctcagcaaatcccagtacagcctcatgccacataatgacatttcagttaataatgggccacatatatgtaggtgatcccataagattataatggggttgaaaaattcctattacctactgacattgtagccattgtagcatggtactgcaaggtaatgctcatgttatacaactcatgtttgtggtaatgctggtaaaaacaaacctactgtgctgccagtcatataaaagtatagcacatacaattatgtacagtacatagtacttaatgatgataaacaactatgttactggtttatgagtttgctattctatactttttaccattatattagagtgtacctgttctacttataaaagaaaattaactgtaaaacagcttcaggcaggaccttcaggaagtattccagaagaagacattgttatcataggacatgaaaactccatgccctgaagatcttccagtgggataaggtgtggaggtgaaagacagtgatattgatgatcctgaccgtatgtaggccagggctaatgtatgtgtctttgtgtcttagtttttaacaaaaaaaaaaaaagttgaaaaagtgaaaagaaattaagaattaaaaatagaaaaatgcttaaaactaaggatataaagaaaatatttttgtacagctgtgcaatgtgtttgcattttaagctaagtgttgttacaaaagccaacaaattttaaaaaattaaaaatatgtaaaacaaaaacattacagtgagctaagtttaatttattattgaagaaagactgttataaatttagtgtagcataggtatacaacatttataaagtccacagcagtgtaatgtcctaggccttcatattcattcagcactcacacactgactcacctggaacaatttccagtcctgcaagcttcattcatgataagtgtcctataaaggtgtatcattctttattttttatactgtatttttactgtaacttttctaggtttagatatgtttagatatgcaaatattgaccattgtgttacaattgcctacagtactcagtacggaaatatgccataaatgtttgtagcataggaacaataggctatataccatatagcctaggagtttagtgggctataccatccagaattgtgtaagtacattctgtgaggttctcacaatgatgaaatggcctaacaatgcatttctcagtccctgtagttaagcgactgtactttaaggagctgctgaacaaaagggacacctggctgcatgttgagggctttttaattatgtgaaaggaaatgaagaggttgtgacctgctgttgggggaagaaggatataaaattttatttaggaggcacataatttgaagtcatgccatttgatttgattattaatttctgccattttggcctttactgagggaaacaaagtggcattttctactatttcttgttggttggttctttcatataatctctttcgctaagagtcctctagaaagtaataaagattgtagcacctaaaatgtttctactcatttgttacatagaaataaaataataaaccattttatgcaacaagctacaagagaaaaaaaaatgcatcattgagcaagatcatcagaatatcacaaagaaagcttggctttcccaggtggtagtcatttgtttctcttttaaaattaatagccaaacagtttagaaacttcgtcttccctacattcacagggtaacattggatattgtactgcagtgttaaaaagagggtttaccagatagtccaagacactagcgaaaggggagataagttttgatcagttataagagaaatagaggctttttttgttaaccgcaacctcttttacccctcatattcctctaaatattaattatcttttctgcatcttttcatttccattgctaaaatcttggtctacatttttattccaacaattctccatctccaatttctcctcattgaaattcattgttgtctaagaaatactactaaagttcaggacttattatgacattattatactcagaaatattcagtagttcttcattactaatttaacaaagttcacattccttagtcaaacctttgcatgatttcattttgactatctgtctattccctctcccagaggatgctacttttaattaattcaaactaaagtaattatttattccaataataatacattttattgtatagaaatttaggaggaagttctaaatctactctcatcgaagcctttcctaatgtaatcactactctttcttcactctaatagcattccatttgtaccatttatagcagttagcacattctgacttgaattagagttacttatttactgaaaagtgtgatttaaacatggctggtgataaataaatatttattagattaataaatgagtgaatgtactttcaaaggcctacctttagactaggtcaatggaagagacagtctatttctttaattgaaagagattctcttgtggtcagcagggtcactgaacaatgacaggttactttcccaggatcagacatcaagttgaaatattattaacttgtagcaatactgaatatgtgaaagaacttcaacattaaattgatgaaaataatagacatactaatcatatttgaagatacaggtatcactcatagtttctctattaatatagattaatagcatagcaaaatcaatattacaagggcttacagctgaagtagttctcatgatgcaaactacacaagatattcaaagttttttaaaatttaatatatgcataaatatccctagagttgacaacgttacagatacagagctgtcagttattctttcattttctggaaaatttcactttgaaaatctaaaactgagctataggagggcctttttaaagaatgtagctataatttttatttttgcttttaatctgttgttattcgcaaatagcttttcttttgcaactaatagtccttgtgggatatattccaacagggggaagaaagatcaaaagacatttgtgctaaaagaattgtaaacttgttttcagtgttcagtgcgtcttctccctaaaagtacaaattaccagacagtggtaacaaataactctgtgattctcaatccagttgaccaatagagatcacataacttctatttttttaactagtgcttactgtcatgcagaggttgaaatatgtgctcctcttcagagcaaagcaacattttctccttcagagaaaagttattttaatataatacatttatgatggcttcaaagtcataacctctgggattcaactattggccatgtattatgagttatttcttgcagtacacccaagcactcttcttcaaatttccatttttctgtcatcataacatttgctgaacactcatagaatgcataatgccatatgaagaaccaaaggggtagaaatgaaggcaaattaattctaccctaacctatttacttgataacatatctaagagaatacagtacctttgataaggatattaaaataggactttaatgcaatcccttctagttagcctattctcttgacccagaccgaatccctgccctcaaagatctctcttgctccccacaaaactgtgtctattaaagaaagacatattcttaaagaaataatatacacacttttccttaggtgagtgatcttactcacttccatatacaatgagtgccatgcattgtgccaaataatttttatggattctttcatttaatagttacaactctatgagacatttagtatttttcatcatattatacagataaggaaactgaatcacaaacagcttaaatttcccagggtcacacagctggtaaatggtctagaaatggattaagtccaagtttgttcagagcttgcactctcagccattatgtggcatcacctcccttcctaggagaaagctgtggttcgaagaaaatcagtctgagacactcattggctaaagtgctgcagagacctttgctaacagaatactagagagagattctgaaaactaaaccaatcaccaatcatggggtaaattctgagactaatggaaaatttgatagcataagcactaagttgaggatcctacctcaactcttcaagggctatactcttccttcaatttacatagtcatgtggttttcaggataaacatgcgcaagcaaaatataccccaaaggcaaccttgacatgcagtcaatttaagaaaaaaagaacaatttaacatttatctgaaacttttcttcttcaatactttccacaaaccattatctttggcacccatttcaacataattagataaacaattacgacaaaacaaaagcaataagagtagaaatggctcatggcttttattccagtacttcagaacatattacaagtatctattaatgctcaggtaatatgtatcagaaattgcaatgtaccaagaatgagaaattgcagtacgtcacgtactttgtaaaatctaaactgagatggagatttgatgtgattgcacatctggtgtttttctctagtgtatatgtttgggtgggcaggattgggcaaaaatgttatcattgatttgttctggaaagggaatattatgcttaagtgttggttagtatgtgtgtttatacatacctacagacaaatctatacatctctctaaagttctggtctctatctacagtatatcatgataaaaatgtttagctccaagtaaatgactgcaatgcaaaaaaataactacaaacatatactggcagtaaccgaatttgtgaaatcctctaacattattggatacagcctactacaataattatcccaaacttctgttacgcttaacagcttttatgagaacattaaaggaatgcaacaatgttgtgtttgcaggcatcatttcatgttccaaaggctaatctaaatcttgttttttaaagatttgtaaatattgcccatcgcaaagtgacttagagactatgagcactatgaaagcaattatgaaacaatacatttaattcatattaatacagagtttgacttgctgtttgtgaagactgaatgagataatgcattcgaataggcttgacacagtgcctaccacatgatgggaactcaaaaaattatgtttcctttcttacttcaagctatgagatgcagcctaggctattatcacccttctgaaagttaacgtggatgaaggacacatttctgttacttttctgggatagacagctcttaataagttactttatgtcactcctggcatatggtagataggtcctataatctcctgggtagtcttgatttgaggaaggggagggagtaactagctctgattttcagccacatttattcttcatcttagaaaccaaaagaaagtatacatagaccaatgaatctatgaaggcctggatttaaggtgaatgtcaggagggtaaatgaataacacaatggacttatgtatttgtgaaacaaaccaaatctctttcacgtgtgacaagtcactgcacagttaagcctttttggccttgttcaccataggtaaactggtcgttgttataggctatagtaaaacttactttagaggcaaattttatatcaatttctatttttggtactttatgaatgttccacagattatttacagtgttttaagctatttcttgaatataatatctggcttgtttttcttgcttttgggtccctgactagtattgacttttaacctcatctcaaactctattattttatttttcttatgttccaatactgtcaacatctctttgttctggctctagactctgttatgcctcttcacttctggtttatattcctatttctgggatacactaatgcctgaaggccagtgtgacatgaacttacctggataagatacaatacagattccaacacagtgtggatgagaaaagctgaagaattgggtctgatctatgaagtcggagtcttcctgattaaaaggaaagattgcaactcttggtataaaggactaatatccattgcttccatatcttctttgagtttctttattgatagatgtatcatgtctatcttacccaggctgaaaaaaaatgagaataatattagctataagtagtggagacactttaaaaagtagcaattcataatttcataaagaggaaaatagaagactcttgttttgcagcctataagatcttttctaatcttataatgtaagataagtaatgtcactgagccataaaatctcagtaggacagtttcatatcctatacacatgctgtgcatcttttctgcttgcagagttccatttcaagcaaactggaggtgctgacttaaaagcctgagcctgtgtgtttaatctacattgttgggattgtcactccagtggctggggtatgccctttttaaggaatttcctttaacctgaaaaaagattaattgacacaaatacaattttttctccaaagagagattgtttttcttcttaatcatgtgtttttgtatttgtttgtttgtttgtttttgacacagagtcacattctgtcacccaggctggagtacagtggtgcaaactcggtttactgcaacctctgtctcccaggctcaagcaattctcccaacccagacctgaaagtagctgggactaaaggtgcatgccaccacacccagccattttttgtattttttgtagagatggggtttcactatgttcacttactttttttcttcctcctcttagcaagcattaattaattgagggcctatgatgtgccaggcactgtgttaggtattaaaagtacagagaagagttaaaaataaatttgaagtctttgtggatagacacactggcataagtacttgaaaaacaaatacaactaagatggaggggtgcatcaggaaatggatgctgatcactatagcaaatataaagggaataaatgtaaagaaattgccagtttgtgcttagaattgaggtgaatcttgccccttggagaaagctctatgtcacgagtcctgaaagaataagaatgttgtatgggatataaaatccagttgaaatatactcatgagacagcaaattatgcaccaagagcattttgcaattaaaatcataaaatcctaaagttgaatttacctgtaatgattatataactctactaagtgatgaatagaattgtcttttctgattcagccaaggtttatccagagcctttttatgggaggctctttagttacaaatcttaaggataaaaaactcccacataaatgactcaaccaaagaattgttaaatattgagactcaatttgaacataatttagtcattcatttcaacaaacagtattatgctggagaagaagattataggaggcatttggtaggcactttgggagattcaaggagcttatattctattaggagagataagtcatatattacttagattgaaccacataactgctccttatgtgagtcaaaatggttgaatgttaatgatttcataaagttcaacttaatactaaaaggcaaatcacaaaggaaaaaacataactaatgtaaaagagatgcaaaaatactatcctaattgatcagataaaggagtaaatattgtcacctcgaaggcagaggtggcaaagtagtattttggatagcttttatagaatatgggtacaaattttatacacagaaacaaaaatgggtagaacagcaggaacaaatgtatagagttagtaaagtgcatcaagtttatagtaagcaacctgtagttcaactggaatgaggggcatagagatgaaggtaagccatgagatataacattagaatgagcaatggaagcaaaaccataaatagtcttgcacacaaaatgatgagtttttaattcagttcagtagataattaggagcctttgagggatttgttgtggcagggttgtaccaaatcagagctggatctcagaagcttaattgtcagtgatgcacacgatgtattaatagtgaatggaatgaaaagcaaagggaagtgtcaaatatcagagtaaaaatgattaagaagctggaaattgtagaagattcagccttctgatgaggaaccaagcatatgacagctgcttatccacagacattctgacaaattggtaagtatagttcgcctctgaaattgccagcattttcttttctgtctttttttttttttttttttttgagacggagttttgctcttgttgcccaggctggagtgcaatggcatgatctcggctcaccgcaacctccacctcccgggttcaagcaattctcctgcctcagccttcttagtagctggaattacaggaatgcaccaccatgtccggctaattttgtattttttttttagtagagacggcgtttctccatgttggtcaggctggtctcaaactcccgacctcaggttatcagcccgcctcggccttccaaagtgctggaattacaggcatgagccaccgtgcccggactcttttttgtcttcttttctcctatgtctgggcacttacttttctcctgtgcttgccaatttcttccattaaaattggttctcatgtaaaaattattctaataattcatttacaaaggggtataaatgagcactatagcttagtttgatactttttctgctcctcctccatccgtggctcatagctcaaaacaccaatctagttgatttggttacacagctgacagtggcaatttcctcggtagtagaagaaataggggattacactatatggctgttatttatccattgatgtcattaaagtattaactgcaatgtcattggatccatgaggagacttaccaggaaaaagagaataatacacagacagggttagagaattatcttagtagagaccctagacttcactttggtcaactatccattcaaacaatgattggattctaaaacattcctaacaggtggtcagcccgcctcagcttgaatatgctttgggatgaagaacactttaccatcataggcagccaatttcatctcaattataattattattactgatctttcttgtaagtctaaatttgcccttcgactcattggtccaaagactattctctagggtgacagaagaagtttactccctcttccaaagaatatcccactaaatatttgaaaagaggtatcatgcagccaccaaatcttctcttcctacaataaagatccaacttatttaaccctaaatagtataatttcaagttttcttattctggttactttcattttgaacatctcccagctaaccaatccaagactcctgagttttatctaaaaatcaaagggcacaaaggtcaattgctctcaaatcatttataaacatgtattctggggctgtaataaaaaggcttgctctacttttaacaagaatatacttttatagttgctttatccataatagcaaaaaactggaaacaacccaaatgtccatcagtaagacaatttaaaaaatggtatattcatacaaggaatactattcaccagtaaaaagtagcaaactcttcatatatgcaacaatatcaggttaatctcaaaagcattatgttaagcaataggatttggacacaaaagagtatttaatgtttgcttatattcatattaagttcaggaacaagcaaaaccatagatggtgacagaaattaaaatagcagttgcttaggtgaaaataattaattggaaagaacaagagggagctttctcaggtgatgaatatattttatattttgaacagagtcagtaattacttggatgtacacatttttcaaaagtgatgcattttattacatgtaagttttacttcattaaagcaatattaaaatgcattaacttgtacacacatttgtctgttttaatatttaggttatcctcaaaacacttaaaagaaaatttgagatttcttgttttaaaaattttcatagtgacttttatttttctattttttaacaatttcaatttttattttagattcaggagtacaggtgcaggtgtgccacgtgagtacattgtgtgatgatgagatttggcctatcaatgattccatcaccgaggtagtgagtataatacccaagagttagtttttcaattgttttcgccttcccttccttctccctctaatagttcctagtacctattgttgctgtctttatgttcatgagttcttaatgtttaactgtcacttatgagtgagcatatgagttttttggttttctgtttctgtgttaatttgcttaggataatgtcctccagctccacccatgttgctgcaaaggacatgatttcattcctttgtattgctgtgtagtattccatggtgtatatgtgtcacattttctttatccgatacaccactgattagcacttaggttaattatatgtctttgctattgtgaatagtgctgcagtgaacatacgagtgcaagtgtctttttagtagaatgatttgttttcttttggataaataaccagtaatgagactgctgtgtcaaattgtaggtctgtattacattctttgagatatctccaaactattacacagctttacacagtgtttgaactaatttacattcccacaaacagtgtataagcattcccttttctctgcagcctggccagcatctgttgttttttgactttttaataatagccattctgactggggtgagatggtatcttattatgcttttgatttacatttctctgatgattagtgatgtggagcattttatttcacacatttgatggcctcttatctgtcttcttttgagaagtgaaagatctctacaagaagaactataaagctctgctgaaagaaataatatatgacccaaacaaaaatgcaaaacattccgtgcttatgaattggaagaatcaatgttaaattaaattaaaagggccctactgcccaaagcaatctacagtttcagcactatttctaccaaactaccaatgtcactttttaaagaactagaaaaagctattctaaaattcatatggaaccaggaaagtgccttaagagtcaaagccatcctaaacaaaaagaacaaagccagaggcatcacattacctgacttcaaactatactataaggctacagtaaccaaaacagcgtgatattggtacaaaaatgaaaatgtagaccaatggaacaggacagaaaactcagaaataaagcctcatgcctacagccaactgatctttgacaaagctgacacaaataagcaatgaggaaagaactccctataaataaatggtactgagataactgactagccatatgcagaagaaagaaactggacccctacttttcaccatatacaaaaattaactcaagatggaataaagatttaaatataagacctcaaactataagaatcctagaaaaaaaacctaagaaacatcattctgaacatcagtattgggaaataatttataataagtcctcaaaagcaattgcaatgaaaacaaaaattgacaaacaggacttaattaaattaaagagattctgcacagtaaaggaaactatcaacagcaaacaaaacctagagaattggagaaaatattcacaaactatgcaactaataaagatctaatattcagggcctataaggaacttaaacaattcaacaatcaaaaataaaaaaccttattaaaaagtgggccaaagacttgctctattttttatgtttggccactgagaacttttagatccccactcctctgtcttgcctccccaacaacctagataagaagactcactcagcctctgcatgacaggaggaattttagatagcacaacctctatctgagcattaggagtctcccacaccagcttcacaccttaataacaaaagaattcagaaggcacctccaattcactacctttgcttgcattctcattgcacctctgagttagcccttccacttcagcttgttgtgactactaaatgtattttattgaaattcatagttgagtgtgttgttccatttgcctcaacatataaatattcctgggtgggtgtgtgatcatgcccacttctgggtagactaatgaaaactgaagagttcagattttcatttttgaaaactccagcatatcttgccacattctaattttagtgaagacagcttccattagatgcagacaattcatgcacccccttacagctctaatatgtcttgctgctagttttctcatcctcattatgtatgtactatgcattttcttcatctggcctggtgacttgtagtatccaaccatttttgtattacatctatccttttccttttgccttcgttcagctgatagctatgagtatcctatactcaggttcatatatttcaatatgtattccaatccagcttttccttattcatattccttacattcctttgaattttctatcactctaccaaaaataagccccaatatacctttcacagattctgtagatgctcctcagagacaagattcaggaggcatagtctggaaagagaaaccggctcctaaataatgaattttttttttctcaaaatgtgaaaatttgtctttcctaacatttagtcattcctgtttctgcattgcaatgctattttggtctgggtcttgtgaatgggtgttcagactgtcattttaatttagcaccatcattgctatagagcagctgtccagaattcatatttctaaaggatttttttaaaaacaactatttctaaatagatagaagttctgcatgctacgatgacaacaaaaatctctgtgtgcttgtacaagttttctcctttggatttctgtattttcaaatgtttataatacttttcaggttcaaaatagttttatgcaatggtttgctttacatacacctacacacaaatacatatccatgcacataagattcttctcaccattatctaccttcagcatggaccagacataaaaacattgaaaacaacatcctgtagcatcacttaggctgtagggctgccagatgcggtggcacatgcctgtaatgccaggacattgggacaccaaggtgagaggatcacttgagcctcatacatatggaggtcaagataagcctgggcaacatagtgagacaccatctctacaaaaaaataattttaaaaatcagctgggtgatatagtttgaatatttgtccctgcccaaatctcatgttgaaatgtaatccccagagttggagatggagcctagcaagaggtattttgatcatgggggtggatatctcatgaatggcttgggccatcctcttgatgataagtgagctcttgctctgagtttatacaagaactggtcatttaaaagtgtgtggcacctccctctccactttcttgcttctgttctggccatgtgatatgcttgcttcccacatgccttccaccataattgtaagcttcctgacgcctccccagattccaagccaatgccagcacgatgtttcctataaagcctgcagaaccttaagccaatttatcctcttttctttataaattacccagtcacaggtattccttttaatatggtttggctgtgtccccacccaaatctcaacttgaattgtacctccgaaaattaccacatgttggatgagggacccaaggggacataattgcatcatgggggctggcctttcctgtgctattcttgtgatagtgaattaagtctcacaagatctcatgggtttatcaggggcttctgcttttgctttttcctcatttttctcttgccactgccatgtaagaagtgcctttcgccccccgccatgattctgagtgtcacgcacgtctgtgtgaagagaccaccaaacaggctttgtgtgagcaataaagctttttaatcacctgggtgcaggcgggctgagtctgaaaagagagtcagtgaagggagataggggtggggccattttataggatttgggtaggtattggaaaactacagtcaaaggaggttattctctggcaggcaggggcgagggtcacaaggtgctcagtggggaagcttctgagccaggagaaggaatttcacaaggtaatgtcatcagttaaggcaggaaccagccattttcccttcttttgtgattcttcagttacttcaggccatctggatgtatacatgcaggcttgggctcagaggcctgacactgaggcctccccagccatgtggaactataagtccagttaaacctctttttcttcccagtcttgtgtatgtctttatcgcagtgtgaaaatggactaatacacctttacagcagtgcaagaacagcctaatatagaaaattggtactgaggagtagggaattgcagtaaaggtacctgatgatgtgaaggcaactttggaactgggtaatgagcagaggttggtggactcagaagaacacaggaagatgaagttaagttcagaacttcttagagactggttcaatggtagtgaccaaaatgctgatagtgatatcaacagtgaagtccaggctgccaagctctcagatggaaatgagtaacttattgggaattggagcaaagctcacatgtgttatagctgcattctgttcatgccctagggatctgtggaagtttgaactccatagtaataatttagggtatctggcagaaaaaatttctaagcagcaaagtgttcaagatatggcttgcctgcttttaagaatctatgctcagatgcaagagcaaaggaatgacttaaactttgaacttatatttaaaagggaagcagagtataaaagtttggagaatttgcagtccggccatgtggcagaataagagaaaaacttttttgaagaggaattaaagcaagctccccagcaaccacttgccagatatatttgtgtaactaaaagggagccaagtactaatatccaagacaatgggaaagacctcaaggcattttagagactgttgagacagcccctcccattacaggaccagaggcctaggagggaaataaggtttcatgggccaggcccagggcctaactgtcctgtgcagccttgggacactgcttaccacatcccagctgctctggctccagcctcagatcaaagggcctcagatactgctcatggtccctgaatttataagtccatgaattaaaaatattctgtgggaaatgagggttgcagatcccaatccatggcctctactttgcatctgattgaatacatgaaatctcaaaaaatgtaatctgtttcctcagggagttctctgactagatttgtgatcatcttcaagtcctatgtggttaacagtcaccaagatatattatttgtggaccctacaaggttaatccatggatcaactgacaaaattgggagaagagagcccatctatttcctagatagcaaatgtgtggatgctttgaaccatactcactttgaggtagccacaattcaattatcttctaaagcctaaaactctgtgtctttcataagtactatcttaccgtatgatgaacagaaaacaccaacattttaaatcacaaatatttattaatgccttccatgtgtgtaaaatatggtaaaaggcaatgcaatccatataataagttttgccttagaagtcacacttcaagaatgtgttccataataacctgcgaatcttttaagctttttctattatccttgttgatgtcagatagatgtactagatcaagtaacgttaaaggcttcagaggtgactgctaaaaattttcttctaatccaaaagggaatccctgtctaaaaatgagtttggaaagcctcacttataataaaaacaagtttatagaagtgacactgagatcatcccacatcgctaagtagatttattggaggggagagaacttgtgctgctttctaattccccaaaacatgctctggctgatgtacttaaaattagaattgattcaaatattgctgtgatcacataatgtcaaaaggcataaaaatattactaaggccctccttccctgttctctgtcagcccaaacaaattcccagcctccatatcaatttatgctgcatccattatctcttacattagaagataccaaacagaaaaaaaggaaaaacatatctattagactcagcccagctggactgaacttccaacatctttccttatattttgtttaaaaatgacatttgagaatgcagaaaatcatttcaggcagttcaatcctttctttatttgtccatttatttatttgttcaattatgcatgtactgtccatcaaaactttgttgaatgtcttctatttgtctgactctatgctaagtactaaaaatacaaagaaaatttttttaaaaatgtaagcactgctcaggcaacttcagacctcctgtacttagtatttaatatgtgtatctgcctgtacccaatcaggttattggcaatgcatattttaatgagacttatactcaacatagtataaactctgaaagataccaggtttttaatacagccaattcctctttgctgatgttgacaaactaagattgacttttaatgtacatttcaatatacgatacgtagaaaagccattggggaaatatatagtcttaactgcttagctgaaagttaccatcatgtctataagaaatcattatagtcagacatttctatctcatacatggttaaatgtctaggaataattttacacaaatctatagtttttctcagaaggaatttatatgtatagttgttagtttcattataattattactattatcaaggactctcaggagggaatctaaaagttttggctgccacacattaagcacagccacttcctttagccctcatatcagctgagttcacaatgttaatgtggtaaagtttctgtggtagtaggacagttattctaccggaatatttcatggtgccagtctaagaatggcagctgaaggactcagtaggttagttgggtattttttccccgtcactctcaggccctaagggcttgactgaatgattgcatcattctaagtaatgaagtccctggagaacctgtagaaggcagcatttgaagatttaaggtttcactgctcaagatgtgactggattgctgacacagaaaactgattttaggccactgaccttctggcttggtgagtacaggaataaaaacgtggaaggctaacaagatctacgtgtgttctgggtgcagtcaactcctagtaaccaacattttaattttgacttttaactccactgcatccaaataaatgatgtgtaagtgattacataaagttatagcatattttctcctcactattcacttggcaatgctatagttatatcttcactatggacagcaacatgatatctgtttacttacattcctagaaggatatcggtagcttattatttacacatgataccggcatgttacctgaaatccatgggcagaattacaattttactagaataatttcggatggcataaaaatttttctctgtgttctctaaaactgaaccatggttgtataacctttgttttatttctaggacccaaacagttcctgtggtacttctctttcttccttctcactagtgacagttgtagtatctcataggaccgtttttccaaaagacaaatgttaacacatcatttccccatttctctccctacagcctaggtttctcattgccctctggataaagtcaaattttttaacatggcatgcaaggcccaaaacattacaattcctatctttggaagtgtattttaggcctctctgtatcttgctttctccactcaggccatagtgatctttgtatggtttttggaatatatcatgctttttccagccacatgaactgtgaacattctgttctctttacttggaacttccacaacattctcctgattaactcttgctcacttttcatgagtgacatcatttcatgatgaaaatcttcctgagccctcagataggtagtcttcctttttatatggtttctttagacccagtacttacaagtatagacccagtacttataataactttgtgcccttgaactcactttataaaatatttaaaacaatttgctcaatgtctactttataagactaaaagcttcataatatcagggaatatacatttttggtaaacaagtgaatctccaacgcctagcacaatgtctgatatcattttaattggtctatttcatataaataccataggactccaaaaatgaactacatatttatttaaatccaagtcaatgtcagccctgccccatgccaccacacagcagcaactacatatatcacgtcacatatctatgtgtacgaaatatctaaggaaaacttatataaaataatattctatgtagctgttttataaatttaagacttttagtctcagaaaagtgagaagaaataaaatgtaatgagactctgtgtactgtagtggttaagagtgtagattcaagaaccacacaatctgagtttgaatcatagttctgtcatttacttgctgcataaactaaggaagggtacttaatattgttacacctccctttggctgtaaagcactcaataatagtacctatcttatacattgcctatgatgatcaaataaggtctattatttggcaagaggcagatgctctctaagttgcttttatcacatttttagtatcacccaatttggcattttgtcgttattattttatggttgttttgtaggttttatttctgtttttatgttttggagtgggttggagtagtcctcatggaccaataaatcagctaatgatgtatacacaaataagtcattctgaaagttgtcaaaaacaaggttgtgggaattccagaaaaacggagaactaattgtaacgtgttatttcacatggaaacataaataatctgaaatatctcaagaaattaatgacaagatttaagaagataaaaaattaagagattttacaaactgcagtacagcattaatggctaaattgatctccaacttaaagacttgaggcttaacatatatacattcaaaacaaaatgacagatacaaattaaataacataaatggaatgataatcagagacatttcaggaaaagttttatgtttgcatagcaataaggtaattatgcctagttacaccatcaaaacattattaacacaaatggaagaaaaccaaatgataaagagaaatacaagagccttggtcacagtctagacatagtttcaattaactatgttattaatgggaatgagctaaaagtaaccaataccttactctcaaccacctgaaacagaccattggagatctcacacacacacacacacacacacacacacagagagaaagaaatttgactcacctttattatttcacctaactctggggcagaagtactaaactgaccagaaatgcaggtggttattttccagttgtatggaaagtatattttaagctaatcagagctagagttcacttgtgccatgccccagttagtttctactttcattcagaacccgcatatacaggaatgttgtttggggaagtacaggagaaatggattaacgtaagtgcatactggaatgtgattacaaggagaatattgtaaacaaggaagaagattggaagaacactgggagactttgtattgtggatgaagatttgcaaacactgttcaatttaaaatgacatcttattctcaagtttagtaaaaaaaaaatgagagctgtaactagatattatccaaatttatttgaatatgatccaaataaataaataaattgcaaattgatctatggcctgagtgaactgaatttcttgtctagctgtgaaatgagaaagatgccagcccctaaatagacagtaaaggaaattagagaaaccacatttatcgtatcttctaataaacatcatgcttagattcacatctactgaaccaagcttgaatttttaaaaactgatatggcgcttctgaaaagatctggaagcaagagagaaaggaaactttaccataataactcagaagaaaacatagatctcgaaatattatttttgtgataagaagtgcatgaatgttttagaatatatatgcttattatcctcagtggtagacaataaaatagagtttcttagagagatttaagaagagaatagatcaacattaaagtagaaaggcaaagaaatttgactaaaatagtaaaataatacagggaagtgcaaattataataggaattttaaaattcgtattataggtagcaaatagatgcaatatgaacagaatagacacaggataaaatcaaatcagtaacatgaagaacattcctcatacaagaagcgagaagacattgacacaataccttgagcagtaattctaaatatcttggggattgtggtcatgtttcggaagttaataaaataactttggctattcaggctcttttttggttgcatatgaatttcaaaatagttttctgtagttctgtgaagaatgccaatagtagtttgttgggaatagcattgaatctataaattcctttgggcactatggccgttctaacaatgttgattcttcctatccatgagcatgaaatgtttttccatttgtttgtattatctctgatttctttgagcagtggtttgtagatctcattgtagagatctttcaccttcattattagccatcttcctaggtatttttttcttttttctggcaattatgatgggagtttgttcatgatttggtccttggcttgagtattgttggtatgtaggaatgttaacaatttttgaacattgattttgtatcctgagattttgctgaagttgtttatcagcttaagaagtttgtggctaatacatatgtgtatatatatattgtatattcatgtcatccagaaaaaaacaaagcttgacttcctctcttatttaaatgtccttcctctcttatttaaatgtcttttttttttctcttgcctgattgccctggccagaactttcaatattatgttgaataggagtggtaacagagggcattcttgtcttgtgttggttttcaggaaaaatgcttccagcttttccccattcggtatgatgttggctgtgggtttgtcacgtatggctcttattattttgaggtatgttccttcagtacccagtttattgagagtttttaacatggagggatgttgaattttttgaaagctttttctgcatctattcagatgataataatgtgtttttttctttatttctgtttctatgatgaatcatatttcctgatttgcatatgttgaaccaaccttgcatcttggggactaggccctcttgattgtggtgggtaagctttttgacgtgctgctggatttagtttgccagtattatgttgaggatttttgcatcgatcttcatcaaggtattagcctgaagtgttgttgttgttgttgttgttgttgttgttgttgtttgttgtatctctgccaggttttggtatcaggctgatgctggcttcatagaatgagttagggaggaatcctcctcctcgattttttggaattgtttcagtaggaatggtaccagctgttctttatacagctggtagaattcagttgtgaatccatctggtcctgggatttttttggttgataggctatttattactgcctcaatttcacaactcgttattggtgtgttcagaaattcaatttcttcctggttcaatcttgggagggtgtatgtgtccaggaatttatccgtttcttttcctaatctttaaaaatttgtactgatattattctcattggaagatgtggcactgaacagataaaaataaaaaacaacagttatgaatcaccaacgccatctctcccctgtacctggcagcagtggcagcacggtgcagagagcatatccgggtgctgggggagggagagcacagcaattgtgatgcaatgaattcagcactgtcctgttagagcagaaaaatcaactggaccaaattcagctgatgctcacccatggagtaaacacttaaaccagccctcgcctgaggggaattactgatcccagtcatctgaacttgggtgcctgccaaccttgccaccaagggctatggcactatgtgcctaaaagtaaaatataaaggcagtctaaaccataaggactgcaagtcttaggtgattcctagtactcaagtaggtgcagagatagtggaatatgggagcacatgacataatgagacaccagctagggtattcaagggagcactggcatcacccctctcctaagcccaggctgcacaaatcacagctccaaaagacaccccttccttctgctccaggaggagagagggaagaatggggaagaatgtggttcacctctaggatcccagcccagccacagcaagatagggcactggtcaactgtgaggtccccattccaagccctagctcccagatgaaatttctagaaacatcctgggccagaagaaaaactgatgccttttaagaacgaacccagtcctggcagcattcatcacctgctaactgaagagagctttgtccctgaataaacagcagtgatatataggtattacaccgaggcccttaggtgaatctctgagactcgctggattcaggtgagacttgggatatttccaactgtggtagctacaaggcaaaactccttcagactgaggaaagcagagagaaaagcaaaagggactttgtcttgtatcttaggtaccagcacagccacagggtgataaagaaccaagtgggatctttgggtccctgattctaaaacttgactcttggatggtgatatggtttggctgtggacccaccaaaatctcatcttgacttgtagttcccataatccccacatgttgtgggagagacctagagggaggtaattgaatcatgggggcagttacccccatgctgctgttcttgtgatagtgagtgagttcttatgtgatctgatggttttattaggggcttttccctctgtgcttggcacttcgtcctgccataatatgaaggacataattgctcccccttctgccatgattgtaagtttccaaggcctcccccagacatgcagaactgtgagtcaattaaacttctttcctttataaatcacctagtcttgaacagttctttataacagcatgagaatggactaatacagtaaattggtactggctagtggggtgctgctgtacagatatgcaaaaatttggaagccactttgaaactgagtaacaggaaaagtttggaacagtttggagggctaagaagacaggaagatgtggaacagtttagaacttcctagagacttcttgaatggctttgaccaaaatgctgatggtaatatggacaatgaattccaggttgaggtggtatcagatggagatgagaaacttgttggaactggaataaaggtgactctggctatgttttagcaaggagactagcagcattttcccctgccctagagatctgtggaactttgaacttgagagagatgatttagggtatctggcagaataaatttctaggaagcaaagaattcaagaggtgacttgggtgctgctaaaagcattcagttttatgtattcacaaagatatggtttggaattggaacttatgtttaaaagggaagcagagcattcaagtttggaaaatttgcagcctgatgatgtgatagaaaagaaaaatccattttctggggaaaaatttaagccttctgcagaaatttgcatatgtaatgaggagctgaatgttaatcaccaagacaatggtgaaaatgtcattagggcatgtcagagaccttctcagcagctccacccattacaggccaggaggtctactaaggaaaaatggtttcctgggctggattcacagacccctgctgcatgcagccttgggacatggtgccctgcatcccagctgcttcagctctaaccatgtctaaaaggggccaatatacagctcagactgttacttcagagggtgcaagccccaagccttggaagattccatgtggtgttgagcctgtgggtgcaccgaagtcaggagttgaggtttgggaacttccgcatagatttcagaggatgtatggaaacccctggatgtccaggcagatgtttgctgcaggggcagagccttctgctagggcagtgcagaaggaaaatgtgggactgaagcccccacacagagtccccagtggggcactgcctaatggtgcgagaacagtgccaccatcctccaggccccagaatggtaaattcactgacaatttgcatgatgtacctggaaaagccacaaacactcaacaccaccctgttaaagcagctaggagggggactgtaccctgcaaagctacagaggctatgggaggccacctcttacatcagtgtgacatggatgtgagacatggagtcaaaggatattattttggaactttaacgtttaatgactgccctacttgattttggattttcatggggcctgtaacccctttattttggccaacttctaccatttggaacaggtgtatttacccaatgcctgtacccccattgtatctaacaagtaactaccttgcttttgattttacaggctcacaggcagaaaggacttgttttgtctcagatgagactttggacttggacttttgggttaatgatggaatgagttagttaagactttgggggactgttgggaatgcatgattgtgttttgaaactgaaaagggtatgagatttgggagcaggcaggggaaaagtgatagggtttggctgtgtgtatccacccaaatctaatgctgaatggtattttccaatgctagttggggggagctggtgggaggtgattggattatggcagtagatttctccatgctgttctcatgatagtgagtaagttatcacaagatctgatgttttacaagtgtgtagcacttctccctctctctcctgctaccatgtaaagaagatgctaaatgtcctgaggcctcccagtcatgcttcctgttaagcctgcagaactgtgagtcaattagacctcttttcttcacaaattgctagaatgagtcaggactttaggggactgttggaagggcatgattgtgtttcgaattgtgaggacataagatttgggtgtggccaggagcagaataatgtgggttagctgtgtccctacccaaatctcatcttgagtggtagttcccataatccccatgtgtcatgtgaaggtgccaataggaggtaattgaatcatggggaaggttacctcatgctgctgttctcatgatagtgaatgaggtctcatgagatctgatggttttataaaaggcttttccctctttgcctggcaattctccttcctggatcatgtgaagaaaggtgtgtttgcttcccctctgccatgattgtaagtttcctttggcctccctgccatgtggaactgtgagtctattaaacctctttcctttataaattacccagtcccaatcagttgtttatagcaatggggaataaactaatacagacggcgttttggaactgccccaggccagagacaagtccactgccttgaagggcgagtcccaggccaagcagaattcatgacaagctgactgaagagaccttgagccttacgtgaacatcagtggtattctggcagtacaacttgtggcctgaggtggtggtggctatgggatgagttgtctctacctttggaaaggggaaagaatagaaggaagtgctgcattgtgtggtttgagtgccagttaagccgcaacacaatagaacaccaggtaaacttctaagatttttttactctagtccctgacacctggacagcacttttggacccccccaccaaggacttggagaaccttgccaccatgaagggtagaacacaggcctggctggctctgccatgaactgattgtagagcagcagggcctttaatgaacataggcagtacccagagagtggttacagcaggccttggggtagacccagttctgcggtggcttctggtctgactcagtgcagtcctagttgtgtgggacacagaagtgctcgtgtcacactacccccagcttttggtgactgaggacatagagagacactgtacatttgggagaaagtaaagaatgagaacaagagtctttccctggtaatccagataattctcccgggtcatattcaggaccatcatggtggtacctttatgagtctgtaaaaatcacaatgttaccatttttgaggtgctccctaaaatacataaactttagatcacaacatccaagtccttttaaatatctgaaaagccttcacaaggaagatggtgacaaataagcccatggagtgaagactacaataaatactgaattcttcaatgcctagacactgaagaacatatactagcattaacactatccaggaaaacattacctcattaaatgaaccaaataagacacaaggaactaattctggagaaacagagatacgtgacctttcagacagagaattcaaaatagctgtgttgaggaaactcaaagaaattcaatataacaaatagaaggaattcagaattctatcagataaatttaacacagagattaaaataattaaatagaatcaagcaagaattctggatctgaaaactgcaattggctaatggaagaatggatcagagttctctaacagcagaactgatcaagaagaagaaagagtgagcttgaaggcaagctatttgaaaatacacagtcagaaaagaaaaaagcataacatacaatgaagcatgcctagaggatcaaaaaataacctaaaaatagcaaatctaagagttattggacttaaagggaacatagagaaaaaactagggtagaaagtttattcaaagggaaaatggcagagaactccaaaacttcaaaaaagacatcaatatacaagtgcaagaaggttatagaacaccaagcagatttaacccaaagattactgcttcaaggtatttaataatcaaactcccaaaggtcaaggaaaaagaaagaatcctaaaagcagcaagagaaaagaaacaaataacatgcaatggatctccaatatgtctggcagcagacttttcagtggaaaccttacagtcaagaagtgagtggcatgagatatttaaagtgctgaaggaaaaaaagtaaccccagaatagtatatgtagtgaaaatatccttcaaacatgaaggagaaatacagactttcctagacacaccaaagctgaataatttcatcaataccagatctggcctacaaaaaatactagaaatactgaagggagtatttcaagcagatagagaaggacattattgagcaataaataatcacacgaagatacaaaacttactggtaatagtaagtacacagaaaaacacagaatgtgtttcaataataataatatataataataacactgtaactgtggtgtataaactactcttatcctaagtaaaaagactaaataatgaaccaataaaaaataatcacctcaacaagttttcaagatttagtcagtatgataagatagaaagaacaaacagttaacaattggggtggaatgaagttaaagcatacattttttaaaatttctttttatttgttttatggtgcaaagtgctaatgttttattagattaaattaatcttataagatagtatttgcaaacctcatggtaacctctaaccaaaaaacatacaacgaatacagaaaaataaaaagtaagaaactaaatgatgtcaccagagaaaatcaccttcactaaacaaagacaagaaagaaaaaaaggaagagaagatcacaaaaaaaacccagaaaacaaataaaaatggcaaatgaaagtccttatttatcaataataacattgaatgtaaatggactaaactctccaatcaaaagacatagagaagctgaatgaatgaagaaagagccatggatttgttgcctttaagaaacacacttcacctataaagacacacatggactgaaaataaagagatgaaaatagatattgcattgcaattgaattcagaaaaaaaaagcaagattcactgtgcttagacaaaatagatttcaaagcaaaaactataagacgctacaaagaaggtcactgtataatgataaaggggtcaattcagaaagatatcacaattttaaatatatatgcacccaacaatggagcacccagatatataaaggaaatattattagagctaaagtaagagataggccctggtacaataatagctggagacttcaacatcccactttcagcattggaaatatcttccagacagaaaatcaacaaagaaaaatcaaacttaatctgtaccacagaccaaatggatctaataaatatttatagaacattttatccaacagctgtagaattcacattcttttgctcaggacttggattattctcaaggatagaccatatgttaggtcacaaaaagaatcttcaaacattcaaataaattaaaataacagcaagcatcttctctgaccacaatggaataagaataaaaattaatatgaagaagaattttggaaactttaaaaatgcatgcaaattaaacaatatcctccagaataatcagtgggtcaatgaaaaaattaagaaggaaattgcaaagtttcttgaaaaaaatgataatggaaacacaacatatctaaacctatgggatacagcaaaagcagtaatcagagtgaagtttatagccataagtgtctaaattacaaaaaggaaaaacttcaaataatctaatgacgcatctttaaaaactacaatggtaagatcaaaccaagcccaaaataagtagaagaaataatgaagatcagagaagaaataaataaaattgaaataaaaaatacaaaagatcaataaaacaaaaagttgagtgttttttttttttttgaaaagttcaacaaaactgacaaaccgttagccagactaaggaataaggagaggatccaaataaataacatctgaaatgaaaaggagtcaatacaactgaaagtgcagaaattcaaaggatcatttgtggttactaagaacaattatgtgctaataaattgcaaaatctagaagaaatcgactaattctgagatacataaaacctaccaagattgattcaggaagaaatgcataacctgaacagatcaatgagaagtaacaggatcaaagccataataaaatgtcttcaaataaagaaaaactaaagatccaatggattcattgccgaattttaccaaacatttaaagaagaactaacaccagttatactcaaaatagttcaaaaaattgaagaggagagaatactttcaaacttattctacaaggccagtattactctgataccaaaaccagacaaggacacatataaagaaaactactggccaacatttctgatgaatattcatgaaaacattctcaacaaaatactagcaagccaaattcaacaatacattagaaagataattcatgaccaggtggcatttatccctgggatgcaagtatggtacaacattcacaaagcaatcaatgtgatacatcatatcaacagaattaagggtaaaaaccacatcatcttataaattgatgctgaaaatacatttgataaatttcaacatgtctttatgataaaaatcctcaaaaaatgggcttagagggaacataccttaacacaataaaactgatatacaacagacacacagctcctatcatactgaatggggaaaaactgagtttcctctaaaatatagaacacaacaaggctacccactgtcaccaatgttcgacatagtactggaagtcctagatagagcaatcagacaagagaaatacaaaaagttcatccaaattggaaagaaagaattcaaattgtctctgttagctgatgatatgatcttatattcagaaacatcaaagattccacaagaaaatgatagaagtaatcaacaaatttagtaaagtttcaggatacaaaatcaaaatacaaaaatcagtagcatttctataagtcaacagtgaataatctgaaaaataaatttaaaaagtaatcccatttacaataaccacaaatgtaatcaaatgctttagaatttaccaaagaagaaaagatatctataatgaaaattataaacaatgatggaagaaactgaagaggacaccaaaagatggaaaaacatttcatgttcatggattggaagaatctatattattaaaatgtccatactacacaaagcaattcacagattaaatgcaattcttattaatacgtcaaatgacattcttcacagaaattaaaaaaaaaactatcctaaaatttatatggaataacaagagatccagaataggcaaagctatcctaagcaaaaaaagaacaatacgggataaatcatactacatgacttcaaattatactacagagctatagtaaccaatgcagcatgatactggcataaaaacagacacatagatcaatagaacagaatagagaacccagaaacaaatccgtacaactacagtgaatttatttttaccaaagttgccaagaccacacactgggaaaaagacagtctcttcaataaatggtgctgcaaaacccggatatccataggcaaaaaaataaaattaggtctctatgtgttgccatatacaaaaatcaaatcaaaatggacgaaacacttaaatctaagacatcacactataaaattactacaagaaaacattgaagaaactgtcaaggacattggagtgggcaaagatttcttgagtaataactcataaccataggcaaccaaagcaaatatggacaaatgggatcacatcgagctaaaaagcttctgcacagcaaatgaaacaatcaataagtgaagagataacagacagaatgagagaaaattcttacaaaccacctctctgacaaggaattaataaccagaatatataaggagctcaaccaactctgtaggaaaaaaatctaataatttgatcaaaaatgggcaaaatatttgaatagaattttctcaaaagaagacatacgaatggcaaataggcatattaaaacattctcaacatcattggtcagaggaatacaaatcaaaactacaatgagatttaactttacccccactaaaatggctcatatctaaaagataataacaaatgctggaaagaatgtggagaaaagggaacccttgtacactgtttgtgagaatgtaaattaatacaaccactatggagtttggaggtaactcaaaaaactaaaaactgagctaccatatgatccagtaatcccactgctgggtatataccccagagaaaataaatttgtatattgaagaggtatctccactcctacatttgctgtagcactgtttacaataactaagatttggaagcaacctaagtgcccatcaacagaagaatagataaagaaaatatggtacatatacacaatggagtactattcagctataaaaaagatgaaatccatccatttacaacaacatggatgaaactggagatcataacattaagttaaataagccaggcacagaaagaaaaacatggcatgttctcacttatttgtgggatctaaaaatcaaagcaattgaactcatgaatgtagtgagtagaaggatggtcactggaggctatgaagggtattgggaaacttgggaggaactggggatgattaatggttacaaaaaaatagaaagaataaatatgacctactatttgatagcacaaaagggtggctaaagtcaataaaaacttaattgtacattttaaaatagcttaaagtatgtaattggatttttttgtaactttgtaactcagtggataatttttcaggggatggaaataatgagtaagtatatgtcataaaactggttattccagaacaaatttgtaaattcctagcaacatataacctatcaagactgaatcatgaagaaatagaaaatccaaaaagacctatatatagtacggagattgaatcaataaccaaaaacctcccaataaataaaagccaggacaagatggattcattagtaaaatttattaaacatttaaataattagcactaatcctcaaactttttcaaaaaattctagaggaggtaacacttccaaaattgttttctgaggtattaccctgatactaaagccaggaaatggcaatacaataaaaaagttacaatccaatatgcctgatgaggaaacatgaatgcaaaatttatcaacaaaatactagaacattgaattcatctctacataaaaaaattatataccatgatcatgtgagacttattcctcagatccaaggatggttcaacatataaaattatgttttatatgttgtgatacaccacaacatgtgtggtataccacatcaacaggataaagaataagaatcacaagatcatctaaataggtacagaaaaatcagctgacatgaattaacacccattcatgataaagacactcaaccctctaggaatacaaggaaattacctcaacataataaaagtcatagagaaaagaccacagctaatactatacttagtaaaacactgaaagctttaccactaagacacaaaatgaaatgagtatgtccactcttgccacttctataatgtagcattgaaagttctagcaagaggaattaggccagaaaaagaaataaaagaaatctagatcagataaggagaagtgaaactatctctgttcacagatgacatgattatatatttaaaaccactaaagattccacaaagaaagctcttagaactaataaataaagtttattaggataaaaagtcaacattcaaaaattaattgcattactattcattaacaaccaaaaatccaaaaaggaaactgagaaaaaaatttatttacaatatcatcaaaaatatataaaatacttaggaacaaacttaactaacttagcaaaaaacttatatagttagaaatttgaaaccctgctgaaagaaattaaagacacaaataaatggaaagataccccatgaacatgattggaagatataatattgttaatatgtccatactgcccaaagtgagctacatattcaatgcaatccctatcaaaatccctgtgacaattattacagacatagaaaaaagcaatgctaaaatttatatgaaaccaaaaggacaccaaatagtcaaaactatattgagaagaaagaccaaagctggagaccaaatcacagttcctgatttcaaaacatatataaagctacagtaagaaaaacagtatggtactggcataaagacagacatataggccaataaaacagaatacagaacccacaaataaaactacacatacatggtcaactggtctttaacttcagtgccaaggaaacacaatagggaaaggacagtctctttagcaagtggttctgagaacactgggcatccacatgcaaaagaataaaattgtacccatatttttagtctgtatgcaaaaatcaactcaaaatataggtttaaatgtaagaactgaatctgtaaaactgctaagtgaaaatataggggaaaagctttctgacactggattgacaatgatttgttagatatggcatcataagcacaggaaacaaaaacaaaaatataaataaatgggactacatcaaactaaaaatttctgaacagcaaaggaaacaaaagaatgaaaagccaaattataaaatggaaggcaatattacaaaccatatgtatgataaggagttaatattacaaatacagaaacaacacctatgactttatggcataaaaacaaataacctgatttaaaataggcaaaggacttgaatttgcatttccccaaagaagacatacaaatggatgacagtatatggtatatgaaaagatgctcaacaccattaaatgatcagggaaatgtaaataaaagccacaataagatatcacttcacatctgttagtatgaccatttaaaaaatagaaataaaggaaacagaaatgaaatgttgacgaggatgtggagaaattggagcccttgcacactgttcgtgggaatgtaaaatggtgtagtcactatagaaaacagtatggtgattcctcaaaaaattaaaaatagaataaagagatgatccagtaatcccacttctgggtatatatctaaaagaattgcaatcaagttctctaagagatatttgccctgttacaatttgaaacaaccacaggttttttttgaggtaataatacagttacagagtacattaaagcattaatcacaatagtcaaacagtacaaacttagaagtccattgattagtgaatacacaaagaaaatttgatatatatgtacaatggactattcagccataaaaagaagaaaaccttgttttatgttacaacatggataaaccttgaggacattaggctaaataaaataagtcagtcatgaaaggacaagtaccacatgattccactcatagtgagatatataatgtagtaaaacttatgacagcaaaaagtggaatggtgatttgcagagactgggggaggggaaaatggggagttagtgtgcaatgggtatcaagtttcaatcatgcaagttaaaagagttctagggagcttctgtgaaacactgtgtgaatagttatcaatactttacactgaaaaatttatgaagaaggtatatattacttttatcacaacaaaaatgtctacaaataaagacacagaggcaataaatacaatttaaaggattgaattctatagactacagctaattaaacttcctttcacagattcatgcagtaagttttgaaactgaaactatacaaagtcaataagaaaatttcattgagctcaagaaagtacaaaatggtcaagccatattttctggtcatgttgcaacaaaattataaagtaacaaaaaacactcaaagaaacagaaaactaacactaacagattaagtatctctctccaaaaataactaatgaataaaagaaaaaaatttaaaaatgcaactacaactaatctagaaaatcagaatactatgaagcaaaatgtatatgatagatccaaagtgttattcagtagtatattcatatatttaaatgcattaaatattaaacaaaaaagaataaagataaataaactaacccttcactgaggaagatagaaaaacaaaatcacaaagaagacagaatccctaagggaaaaaataatgtaaataaaactataaacaaataaattagcaaatgaaaagtgtcaaacttattaataaatccaaatccagttctccaaaaagatgagagaagaaaggagtagaggaaggcagagagggagggagagggggagggaaggaaggaagaggaagggaaggggaggggaggggagggaaaggaagggaagggagaagggagtgaaggtagggagtgagggaaggggagagtaaaatagataatctctggtaaattaattaggaaaatattagacaattgcacacagccaaaatcagaaatgagtaaaggagttcatcaactgacacaaagaatattaataacttctaacaaactaattagctaatattaataattttgaatatcttaataaaatgaacatctggtgaaacaattatcaaacctgattcaaagaaaaatagaaaattatctttcattatcaaattattacctcaaaaaaacctgtggttgttttcaaattgttacagggcaattttcatgaataggacatttgtatgtctccatttatctaaatgttttctaaattttattttttctgggtacatactaggtatatatattaatatttatggggtacatgagatgttttgataaaggcttgcaatgtataataagcacatcatgaaggattgggtatccatcccctcaagcatttatcctttgagttatacacaatccaattacatactttattttatttaagttatttaaaaatgtacaagttattattgactatagtcaccctgttgtgctatcaaacactaggtcttatttattttttctaactatttattttataaccattaactttccctctctcccccaggcccccactactcttcccagcctctggtaaccaccattctactctctacatctgtgagttcaattgtattaattttttgatcccaaataaattagaaaatgccatgatgtttgtctcactgtgccaggcttatttcacttaacataatgatctccagttcaatccatattgttacaaatgacgaatatcattcttttggatggctgaatagtactccactatgtatatgtaccctattttctttatgcatgcatctggtgatggacacaggttgcttccaaatcttagctattgtaaatactgctacaacaaatgtaaaagtgcaaatatctctttgatatactgatttcctttcttttgtatatgtacccagcagtgggattgctggatcatatggtagctcaatttttagatttttgagcagcctccaaactgttctccatagtggttgtactaatttgcattcccaccaacaatgtacaagggttcccttttctccatatcctttccggcatttactatctcctgtcttgtggatataagccactttaattggtgtcagataatatctcattgtagttttgatttgcatttctctgaggatcaaagatgttgagcaacttttcatatgcctgtttgccattcttatgtcttcttttcagaaatgtctattcaaatcatttgcccctatttttatcagattattacgttttttcctatagagttgtttgagctccttatatattctggttattaattccttgtcacatgggtaatatgcaaatattttctcccattctgtgggttgtcttttcactttgttgattgtttcttttgctgtgcagaagctttttaacttgatgttattccatttgtccatttttgctttgattgcctctgctactgcagtgtttgtcaagaaatttttatccagacaaatgccttggagattttccccaatgttttcctgtagtagtttcataatttaatgttttagatttaagtgtttaaatcattttgatttgaattttgtatatggtgagagatgggggtctagttttattcacctgcatatggatatacagttttcccagcaccatttattgaagagactctgtttccctactctatgttcctggcacctttgttgaaaattagttgactgtaggtatgtggatttgtttctgggttctctattctgttccgttggcctatataactgtttttaagccataacatgctgtcatggttactatatctctgtagtataatttgaagtcaggcaatgtgattcctcaagtttttttctttttgctcaggatagcgttggctattctgttgaattcggcttttgtgagttcatataaattttaggatttttttttctattactataaaaaatgttattggtattttgataagaattgcaatgaaaatgtatatggctttgggtaaattggaaattttaacaatattgattcttctaatccatgaacatgaaatattgttttattttttggcttcctcttcaatttatgttatcagtgttccatagttttcattatagagttttttttacttatttgtttaattcctaggtatttaattttatgtgtggctattgtaaattggattacattttgatttctttttcgcattgtccactcttggcatatagaaatactactgatttttgggtgttgattttatatcctgcaactttactgaatttgtttatcaattctaagagttttcttgtgaagtctttaggtttttcaaaatgtaaaattttgtcatctgcaaagaaggataatttggcatctttctttccaatttcaatgccctttatatctttctcttgtttgctgttctacgtaggacttccagtgtcatgttgaataacagtggtgacagtgggcatccttgttgtattctagatcttagaggaaacactttcaggtttttcccattcactatgatagcagctgtgtgtctgttgtatgtcaattttattatgttaaggtatgttccctctagtcctatttttaagggttttaatcatgaagacatgttgaattttatcaaatactttttcagcatcaatttataagattacatgatttttatcccagggataaatgccacgtggtgatgatgaatgatctttctaacatattgttgaattcggcttgttagtattttgttgaggatgtttgcatcaatattaatcagagatattggccagtagttttttttttttaatgtgtctgtgtcttgttttggtatcagggtaatactggcctgatagaatgagatgaaaagtattccctcctttatttttcagaatagtttgagtaggattggtattagttcttttagtttggtagaattcagcattgaagccattgggtcctgggcttttctttagtggaagagtttttattatagctttgatgtaattacttgttatttgtctgtttatgttttttatttcttcctgattcaatctttgtaggttgtatgtgtctaggaatttatccatttcttcctgggttttgaatttattggcatatactcgttcatagtagctactgataatcatttgcatttctgcaatatcagttgtaatgtctcctttttcatttctgtttttatgtatttggatcttctctctttgttccttagttattctgggtaaagttttgtcagttttatttaacttctcaaaaaaacaactttttctttcattgacctttgcattgctttttcatttcaattccatttatttctgctctgaatttaattgtttttttctattacttttgggtttagtttgctcttgcttttctacttctttaaaatgcattattagattgcttatttgaagtattttctctatttggtgtaggcaattaaagctataaacttctctctgagtactcttttactgtatcccatagattttgttgttttgtcttttaattattgtttgtttcaggaaatttttcaatttgtttcttaatttcttcattgacccactggtaattcaagagtatattgtttaatttccctgttttgtatagtttccataattcctcttcttgttgacttctggttttattccattgtggtaagataagatgcctgatattatttccacttttgtaatgttttaagtgttgttttgtgatctaaaatatggtctatctttcagaatgattcatgtgctcaggaaaagtatgtgtaatctgcagtcattggacgaaatgttctacaaatatctattagattcatttgctctatagtgcagaataattctgatgttttttgtttattttgtgtctggtagatctgtctaatgctgaaagtgaggaataaatgtctccagctattattgtattgcagcctatctttcccattagctttaatagtatcttctttatatatctgggtgttccagtgttgggcgcatatatgtttacgattgtgatatcctcttgctgagttgacctttttatcattatgcagtgacttttctcgtctcttctacattttgtctttaaatctattttgtttaatataggaatagcgactcctgctcttttttggtttccattggcatggaatacctttttccattcctttattttatctctgtgtgtgtctttataggtagagtgtgtttttttattaacaacagatccatgggtcttgtaattttaatccattcagctactctgtgtctttgattagagagcttagtgcatttacattcaatgttattactgataagtaaggacttactcttgccattttttatttgttttctggttttttgtggtcttctcatcctttctttttttctttcttgtcttcatttaatgaaggtgattgtcccgagtgatgtaatttagtttcttactttttattttttctgtatttattttgtgtttttttgttagaggttaccatgaagcttgcaaatattatcttataacacattattttacctgataacatcttaaccctgtttgcataaataaacaaacaagaaaaggaaaactaataaaaactctattccttaatttctccctgctttttaacattttgtcatttttatttatatcttattgtacacgtcttgaaaagatgtagtgtctttttattggtttatccttcagtatttctacttaggataagagtaatttacacatcatagttgcagtgttacaatattctgtgtttttctgtgtacttactattaccagtgaattttgtaccttctggtgattacatattgttcagtaatatcctttgcttttacacttaagtactgcctgtagcatctcttgtaggataggtctgatgttgatgaaattcctcagcttttgtttgtatgggaaagtcttcatttttcctttatgtttgacaaatattttcactgaatatactattctagcttaaatgttttctcttcagcacattacatttgtcattccactctctcctggcctgaaaggcttctactgaaaagtctcctgccaggtgtattggggatccattgtattttatttgtttctattatcttgctgcttttaggatactttctttatccttgacatttaagagtttgattattaaagatcttgaggtaaacttatttgggttaaatctgcttagtgttctattacaaccatcttgcacttggatattgatatctttctctaggtttgggaatcagacattgttgctttgaataaactttctacttgcatctctttctctacctcctctttaaggccaataactcttagatctgccatttggaggctgttttctatatcctgtagacatgcttcgttgttttttattcttttttcttttgtctcctctgactgttcatgttcaaaacagcctattttcaagctcactagttctttactctgctggatccattctgctattaaaagtctctggtgcattcctcagtatgccaatttcatttttcagctccagaatttttgctagattcttttatattattaaatctctttgataaatttacctgaaataatttttgaattccttctctgtgttatattgaatctcttcacagttcctcaacacagctattttcaattctctgtctgaaaggtcacatatctctgtttcttgaggactggtctctggtgctttatttagttcatttggtgaggtcatgttctcttgggtagcgttaatgctagttgttgttcttcggtgtctggccattgaagagttaagtatttattgtagccttcactttctgggcttatttgtatctgttcttcttcagacggctttccaggtaattgaaaggacttgggtgttatgatctaaactctatctgctttaggcagcaccctaagcccagtgacactgtggttcttgcagactcatagaggtactgccttgctggtctttggcaagatccaggagaattctctggatttctaagcagagatgcttgttcacttctcttactttctcccaaacaaatagaatctctctctctctctctctctctctctctctgttctaagatacgtaaagctgagggtatagtaaaacaagcacccctgtgaccaccaccactataactgtgctgggttagacgtgagggcagcacagcactgggtcttgcataaggcctactgtgaccactctttggttactgtctatgttttctccaggccttggtgctctacaatcagctcatgacaaagccagccaggcctgaattcttcacttcagggtggcaagatctccaggctccatgtggatctaagagtgcagtccaggagtcagggactagagtcaaaaactttaaaattctgccttgtgttctagggtactgtgacttagctagcactcacactgcaggacgcagtccttcccactcttgctccctttccaaaggcagaggagccttacctcctagccactgccaccacaggccatgaagagtactgccagactactgctgatgttcccttgaagcccaaggtcacttaagtcaacctgtggtaagtgttgcctggcctgggactcacacttcaggaaagtgggttccccattggcccagggcaggtccacaaatgccatccaagagtcaaatcctggaattagacaccccaagagcccacttggtggtctacccaacagtggccatgctgacaccaaagatgcaagagaagtcccctttactttttcctctgatttttttaatcaggagttttgccttgtagccaccacagttggtaacgtgctgagtctcatctgaagccagcaagtatcagaggctcacccaaaacacttgacttagtacctgggtattgctgctgtttattgagggcccaagggctcttttgctagcaggtgataaatgcttccagggataggtccttcccttaaagacagcaggttttcttatggtccagggtgtgtctagaaatatcatctggaatctagggcctgaaacggggggctcatctttctgaccagcgccctattctgcagtagctgtgctggtatctaagatacaagacaaagttctccctactctttcattccctctcctcaagccggtgaaaggggtttcttttggagctgcaagctgagcagcacggggttaggagagaggtgatgtcagcagtcccttggctgccccagctggtgtctcaataggtcacgtgccgccccagtccactgtctttggggcccagtttatcactaggattcacctaagagtagcagtccttattgcctggactgcctttcaagtttacttagagacccagagcactttggatctaggtggcaaggtttgcgggaacttaagttttgacctctggatcagcgatttccctctggctagggctgttttaaatattcccttcatgggcaggcaccagctgagtttggtctggtattgctttctgatatatatgacagcactgagttcagagcctcacaattgctatgctcttcctcccctaatacccggagatgctctctgtaccacaccaccactgctagggggtgggtgtgcaggggtaggagcggtggcatcagccattcaagactattttttctatctcttcagtgcctctttcagtgatatgaagttaaagctgggtacaatgtgtactcatctgattcttggttcttatgaaggtgtttttttttttcctctgtacatagttgttccattggtttccttgaagggaaggatgatcagtgaagtcttctattccaccatcttgatccacctctctcccaattttctaaatggtaattattctgattttttctaagtgctttaggccattcttgcatttacataaagaaattcctgagaataggtaatttataaagaaaagatgtttaattggttcatagttctgtaggctgtccaggaagcatggtgccagcatcttcccaccttcttgggtggcttcagagagcttttacttatggcagaaggcaaagcaggagcatgcatatcacatggcaagagcatgagcaagaatgagagcggaggtggagctgccacacacatttaaacaaccagatctcacgagtactcaccatcacaaggatagcaccaaaacaagagggatccacccctatgacccaaacatctcccactaagcctcatcttcaacatcgaggattaaatttcattatgagatttgagggtacaaatatccaaaccatatcattccactgttgggtcctcaaatcttatgcctttctcacatatcagaatgcaattatgcctttctaatagtctcccaaagtcttaactcatttcagcattaactcaaaagtcccaagtccaaagtcttatctggagatgagttccttccacctataagcctgtaaaattaaagcaaattatttactcccaagatacaatggggatacaggcattggaaaaattcccattctaaaagggagaaattggctaaaagaaatgagtaacatgccccaatccaatctataacccagcaggacagtcattaaatcttaaagctctaaaataatatcctttgactatgttatcccacatccagggaactcttgtgtgagtggtgggctccccaggtctctggcagctctgcccctatagctttgcagggtacaaacactgagactgctttcagagttgagtttctgcaccttttctagatggaagatgtaagctgtttatgtatctaccattctggggtctggaagacagtgggacacttcttacagcttgactaggcagtaccccagtggggagtctgtgttgggtctttaaccccacatttctccttcacactgccctagtcgaaactctctgtgaggactccatgcctgcagcaggcttctgcctgggcacccggcatttttatatatcatctgaaatctaggtggagaatgctaagcctccttaactgttgcactttgcacacctacaggattaacatcaagtaggaggccataaaggctcatgccttttgccctctgatacagcagcctgagctgcatctgaggccctttgagctgaggttggagctggagcaacctgaatgcagggagcagtgtccagagtctgtgcagagcaacagggcccagggccttgcccacaaaactattcttttcttctaggcctctgcacctgtggtgggaggggctgccttgaagattgctgaaatgtcttcagggccttttctcactgtcttggacaatagcacttggctccctctaaatcacgctaatatctctagcaagttgttgctccatagcccacttgaattctgcccttgataatgctttttctttctctgccatgtggcgaagttgcaaattttccacacttttgcactctgcttctcttttaattatacattccaactttaattcttttatttgctcccacattggagaataggttgttagaagcagccaggcacaatcttgaacacttttctgattagaatttttttctgccagatatcttcagtcatcaagtttaagtccaaagttctatggaaccctagggcatgaacacaataaagccaagttctttgctaagtcataccaagggtgacctttgctccagttcctaaaaactttcttattttcatctgagaccttgtcagccaggacttcactgtgcatatcactattagccttttggtcacaaccatttaaccagtatctgagaagttccaaactttccctcatgtttatgtcttcttctgagccctccaaacttttcaaacctctgcctgttacacagttccaaagtcatttccacattttcagaaatcttcacagcaatactccattcccagtaccaattttctgtgtcagacaatttttgcattgctataaaggaatacctgagactgggtaatttataaagaaaggaaatttatgatttatagccggttgtatggaaagcataaggctgttatctgctcaccttcttgggaagcctcagggagcatttattcatggcataaggcaaagtaggagcaggaacatcacatggtgagagcaggagcaagtgggtgggggtcccacatgcttttaaacaaccaggtctcatgataactcactcaatataataagaacagcaccaagccatgagggatccaaccccatgacccaaacacctcccaccgggttccacttccaacactgagggttacattttaatgtgtgggaggtcaagtatccaaaccatatcactcaaattctacatttcagttggttaggggaggtttatagggcactactggcactcagtgattacaaaattttatgacattatggttttcaaatcccatgactctgaaatcctaaggtaaaatgaccttctgtattcaacattacattagctctgattttaacatgctctgatagtatggtgatcagattttaactctttctgtgatccatgacattggctagaacagtgctttgaggaaataaactgctggatgaataaaaagatatacttttttgaatatggaataaactatagtcaaataaaaagagtaaaaagaggcaaataaatgactgggaacaatatttgctgcaaaaaagatatgcaaaaagtatttcacttacattttttatcttagaatatgattttaagaacaaatttaaatataaaaatactatcacctcagcttataaaagagtgaaagacatgaacagataattcacaaagttagaaacacaatttcttatctctagtgtcctaaatttctataatgcggttacattactacataatgtgattttaaatattaaaataaagaaaaaacaactggaagaacacatattaagtcactgattcgatgtatggtttaagcttcaaggctttttttgttgtttttgaggatcatgtatacatttgtagaataccgagtctaccacaattggctgtttttaattatttccccattaactcattattcccttgccaaattatgtcacttgacatttttttacaagtatttacttataacgacacttcatttttaaatatttaagtctttttataacataaatatatacaataacatgttctaaaaatgaactgtgcataaagaataaggaaataggcagttcaaataacaggaatgtctactcttgagggtacaacagaaaaataaataatcaggattaccactgctatactgaatcccaagtttacttttaagctcagaaatcaaagtgaaaattgagctgttgatcattatcagaaagaaaggacagttcatggaatagcctttcaaagacattcttcattgtgttttctcagtgggacaaaataagtgatgtggcagacaatgctgtcaaaagtattgctacagaaaatgcactaagtgaataaacagagcttttatttacatcgggttggagaaatgttggggagaggggttactgttttattttatctgaagaaaagctgaaataataacataaaacagagtgcactgtaggcaactctgtgcagagttgcaataatatggtcaacatatggggaatttctgatggtcttcctgaattgatttgaacttagaccctattgaatactgagaaaactagatcgatttaatttcctttacagaaatattacttctctcccgcagccttccacttgatctccagcacttcattatttaaatatcttagtttgtgactgggacacatgctggtttcatcaagtcattgtgagccccttgttatcctccctctacaactctcaacctactaatcagcttgataagctactgatcatcctagtactcaggatgactctaactgcaggtgtttcactgatgacagctcttctttccccatttcttactcaccagctctattaggacagatgcctactaaaaatgttctaaaaatcaaagaaattagccatgttaaacagtatttgcattccttcttattagtctacagcagttctccagaactttttagttcaaagtgttattctcattcatgtgcttaaagaaactctagatcatggagaaagcccatgcagagcccagctcatcattggtctactggggatagtatataaactgtaagctatgaaactccgtcttgctgaggaacttgaatgatgcaggatgtgatctaaaggtgcacttcaacatgacaaaaatacattttaaaatgccattggcatattctatcaactacaacaatgcacatatttagagttcaagatgtatgatgtacgtctcaggttttcaatttcaagtcttggaccccctttctagttcttatggaatagtgtggttagtctctccaattatcagctaaactgacctaccatcttataaaagccagtagcaattcacagcactttctatttgcttaaacaaaacaaaacaaacttaccaaaagatttattgactgtgcaagactatgtcagtaatctatttgaacatgtctgtcaaacctgtcactggagcttgctatttaatatctaactgtgtccctctatctaattttctgtcactaatctattttttaaagcaaaaacggcagttcttcaaaattagataaatgagtgcattgctttctgaatgcatggcaaaagatatgctttctttttatccttcacagcacctggcatagaacatggcatgtagcgaattctcaaaaataatgccatactatattttatattgtcatagagtttcaaaatgcatcaaatcattttctaagtttatcattgctgttgctatttttagtaacaatatattacagttaattgctattttattcagagggtagagggggtgatgtgattaattgcccaaattcaaatgactatcatggctggatcattagatagcctggatgaatatgactgtctgacttctaatgcagtgttctctttagaataaaacttcttcagcattttaaaaacctacaattcatgcattcatgtatacaataaatatttattgggcaccttccatgcatgagatggtgaagatgatacaaagacagatgtgaatgtgatgtttgaatattatttatattgcaagcagagtatatatgatatcatataactttggaggacagaagggtgataatggctttataccagttctctgactaaattgcctttaccgaccatggaatgaaccggcaaaattctcatgagggttgctttgcagtcattactctgtcctgagaacctcagaaaagatcttagtctttattacaatccaagatccaaatcccgctctttcatttcatctccacttctcaactgctagaacaacaacaaagccatgaatatttgattgagtgtttcttaacagcttgagtactttgttataaagtttctcaagactcagtggtttcacaaagggtagatatattttcttaactaaaagtgaatatagccaacagagggcagctattatcatgcatccatacatatccagcttatgtaataatatttataaaagcccattttaaaacacaattattctcaccttttgaggggaaaaaaaacacataaagtttaccatcttatccattttaagtatacagttcagtggtgttaagtatattcacattgctataaaacagatctctagaactttttcattttgcagatctgaaactctatattaatcaaacaactgtcctttttcttctccccaaagggagaggcaaccacctttttactttctgtttctatgaatctgactactttaggtacctcatataagtagaatcatacagtatttttctttgtgtgactaccttatttaaccgaccataatgttctgaaggttcatctatattatagtatctgtccatctgtcagggtttcttttcttgttgaggctgaatgatattccattgtatgtacataccacagtttgtttatccattcatccacggatggacacatgggttgcttatatatcactgctcttgtgaatagtgctgctatgaacatgggtacacaaatttctcttttatcctgctttcaattcttttgatatatactcataagtaggattgctgtatcaaaggatagttccattttttattgttttaggaacctccataaggttttccatagcagttgcaccattttacctttccatcaacagtgcataaagattacaattactcaacatcctcatcactatttgttattttctggaagtttttaatagtagccatcttgatggatgtgaggtgatatcacattggttttgatctgcatttcctccagtgatgttgagcatcttttaatatgcttattggtcatttgcatatcatccttggagatatatttatacaagtcttttacacatttcaaaaataaagatatttaaaattttttgctattgagttgtaagagctctttatattgtggatattaactttttaccagatttatgatttgcaaatattttctcccattttgtaggttgctttttcaatctgttgattgtttcctttcttgtgcagaaggtttttagtttgaggtagtcctacttgtctatttttgcttttgttgcttgtgcttttggtatcatatcagagaaatcattatcaaatccaatgttatgaaactgtcttctatgttttcttttaggagttttgtaatttcagttcttacatttaagtgtttaatccatttccagttaatttttgtatgtgtaaaataagagtccaactgcattcttttgcttgtggatatccagtgttttcaacaccacttgttgaagagactgtcatttctccattgagtggtcttggtatcctcatggaaaatcatttgtttgttgtctgtttgattcccattgccttggcctgggtgtcattctgcttgtgacacactgttttgttactatagctttgttatatgttttgaaattgcaaagtgtgagtcctttaactttgttcatctttttcaaaattgttttggttccttggggctcccttgagattcctcctgaatgtccatgggaattcttttctcttaccaagaaaattaattaattttaaattattttttctttcaagtaatctatttcattttattttttctagggaattttagaaagtaagtcttgttccttgcttcactgactatccatttatatgatatgttgtatatgaaacactccagattctctactgtgcagaatgtttgcttgcgaagaagagcaaatagaggagcatagataatgcttcatcaatgaggcctataaaaattgagatttttacaaattgctgatctcccaaaatttaggacagggctggacatgttgtaaattttcaaaatatatattgaaagaataaacgaaggctgaagacaatatgatgtgaaagatgccagttcacctagaagttaccagatgcaccctcctctatgtgtttatttataaattgttatcagcataatccatgtacatatttttgtctttgaatatttataaagggcttataatacaaagcaacataccctactccacctctctccatcctgtattcccactcccagaggaaacaactgtctattcttttagctgtgtcttctggcatgtattactctacttcttttttgtttggtttatacatatttatcatttaactctcacagtgggacccataccaaaattaaagactgcttttccaaattatttatttaataattacatcttttcttttagattcaggggatatatgtgcaggttcattacctgggtacattgcatgatgctgaggatgggggtataattgatccagtcacccaggtagtgagcatagtacacaacagttagtttttgaacccttgactcctctccttcctttacactctggcagttctcggtgtctattgttgccaactttatgtctatgagtacttatttttagctccaacttaaaggtgggaacacagggtatttaattttctgttcctgcattaaatggcttaggataatgaccctcagctgcattcatgttgttgcaaaggacaagatttcattcatttttatggctatatggtattccatcgtgtatttacaccacattgcttttattcagttaaccattgatgggcaactaggttgattccatgtttttgctattgtgaatagtgctgcgatgaacatgtgagttcatgtgtctttttagtaaaaccatttgttttcttttagatgtaaacccagtaatgtgattgcctggttgaatcgtagttctgttttaggttctttgagaaattttcaaactgctttccaaagtggttgaactaatatacattcccaacaatagtgtataaccattccattttcttcccagtttggccagcatctgttatttctggaatttttagtaatagccattctgactggtgtgagatggtatctcattgtggttgtgatttgtatttctctgatgatgagtgatatttgttggccacttgtattttttcttttgagaaatgtgtggtcatgtcttttgctcatttttaaatttttttttaaattccttgttcaattgtttacacgacttatagattctggatattagatctttgtcagctacatggattgcaaatattttctaccattgtgtagcttgcctgtttactcttttgatagtttattttgctgtgcagaaagtctttagtttaattaggtcccacttgtcaatttttgcttttgctgcaattgtttttgaggactcagtgataaattgtttcccaagactagtatccagaatggtgtctcctaggttttcctccaggattcttatagtttgaagttgtaattttaaatctttgatccaccttgagttaatttctgtatatggttaaatttcagtcttctgcatatggctagccagcaatcccagaaccatttattgcatagggagtgctttccccattgcttatttgtgttaactttgtggaagatcagatggctgtagtcatgtggatttattactgtgttctgtattctgttccattggtctatgtgtgtattttgtagcagcaccatgctcttttggttactgtagccttatagtatagtctatagtataggtaatgtgaagcctctgatttccttctttttcttagaatagttttggttatttgggctctttttggttccacatgaattttataatagttttttttctagttctgagaaaaatgatgttggtagcttgatagaaatagtgtgaaatttttagcttgctttggtcactatggccattttaataatattgattctttcaatccatgaaaatggaacatttttcatttgtttgtataatctgtgacttttttcagcagtagtttgtagttctccttgtagaaatctttcacctccttggttagatgtattcctatattttttggcagctgttgttaagtgggaatgtattcttgatttggctttcagcttgaatgttattggtttataaaaaataaactgctgaatattatatgttgattttgtatcctgacactttactgaagatatctaccagttccaggatccttttcatggagtcattagggttttctaggtatagaattatattgtcagcaaagagacgtggcctgatttctcttttttctatttggatgtcttttttttttttttttctcttgcttcattgttctagcaaggacttccagtactatgttgaataagagtcagagtgggcattcttgtcttgtgggttcttgcgggggatgcttccaggttttgcccatttattatgacgttgacagtgggtttgtcatagatggctcttattattttgaggtatggtccttaaatgcttagtttcttgagagttgttatcatcaaggaattttacacttcatcaaaacctttttcttcaactattgagatgatcatattgtttttgtttttaattctgtttatgtactgaatcatattcattgatttgcatatgttgaaccaatcttgcatcccaggaataaagcctacttgatcaagtgaattaactattttatatgctgctggattcagtttgttagtgttttgttaaggatgtttttatctacattcaaaaggaatattggcctgtagttttgttttgttttgttttaattttgtttttctcaggttttgatatcagggtgatgctggcttcatagaatgagtaagggaggaatccatcttcccttattttttggaatagtttcagtagtattggtactagttcttcttcatatatcttgtagaatttggctgtgaatcatttgttccttggctttttcttggttggtaggattttttatggctcattcaattttggaactcaaaattattctggtcagggtgtccatttcttcctgattctatcatggaagattgtatatttccaaaaattaattcatttcctttagatttttcagtttgtatgcatagaggtgttcaccacagactcttaaggatcttttgtatgtctgtgggagcagtggtaatgacatctttgtcatatgtgcttgtgcttatttggatctctcttttttcctttgttaatctaggtagtggtctattggtcttgtttatcctttcaaacaaacaacttttagttttgttaactctttgtatggatttacatgtctcaatttcatacaggcctgctctgattttagttatttattttcttctgctagctttggggctagtttactcttatttttctagtttctctaggtgtgttgtttgattgttaatttttgagattttctaactttttgagataggtgaatagtgctataaactttcctcttaacactgcttttgctgcattcctgaggtttgggtaggttttgtctctgtttttatttatttcaaagaattttctgacttcttccttaatgttattgtttacctaaaagtcattcaggagaaagttgtttaacttccatgtaattgtgtggtttttgagagatcttgttagtattggctttaattttattccactgtgttccacgagcatcattggaatttttttttttaatttattgagacttactttctggctgataatgtggtcaatcttagagtatattctgtgtgcagatgagaagaatgtgtattatttggttgttgtgtggagtattctgtagatatctattaacttcaattggtcaatgtcaaatttaaatccattatttctttgttagttttctgccttgatgccttaaagtctaatgctgtcagtggggtgttgaagtctcccattattattacgtggttacctaagtctttctgtagatctcaaagtaccgttttatgaatctgagtgctccaatgttgggtgcacatatatttagaatagttaagtcttcttgttgaattgaaccctttatcattatgcaatgcccttctttgtctttttttactgttgttgttttgaagtctattttatctgatataagaatagccactcttgatgtttttgtgttccatttgcataataatcttttatcccaccctttcctttgaggccatgggtgtcattactgctgagataggtctcttgaaggcagcagatggaagggtcttttttttttaatccaacttgccactctatgctttttaagtgggatgtttagacaatttacattcaaggatgttgatatgtgagattttgattttatcataaaattgttagcaggttgctttgcagtttccattgtgtggttgctttatagggtctgtgagctatgtacttaagtgtgttgttgtggtagcaggtatcattttttttcatttccatgtttagaacttccttaagggtctcttgtaatgttggttcagtgacaacaaattcccttagtgcttacttgtttggaaaagactttatttctcctttccttataaagcttagtttggcaggacatgagattcttgattggaatttcttttctttaagaattctgaaaagaagctaccaatctctcctggcttgtaaggcctctgccgagaagtatgcttgtagcctgctggggttcattgcatatgtgatcttaccttattctctagttgactttaagattttgtctttagcattgacttgaacagtatgttagtctgttctcatgctgctaataaagacatccctaaggctgggcaatttataaagaaaaagaagtttaatggactcacagttccacattgctgcagaggcctcacaattatggcagaaggtaaagaaggagtaaaggcatgtcttaaatggtggcaggcaagagatagtatgcaggaggactaccctttataaaaccatcagatttcattagatttattcactatcatgagaacgacacgggaaaaacctgccccgatgattcaattaccttccaccgggtccctcacaaaacacatggggattatgagagctataattcaagatgaaatgtgggtggggatacatccaaaccatatcaaacagtctgctgactatatacaaactgttgtgttggtgatgttcattttgtaaaatatcttgcaatggttctctggattcattgtatcaggatatctacctctctagtgagataggaaaattttcttgaattattccctcaaatatgattttcatgttgttttatttttccccatctccttcagaaataccaatagttcataagtttaattctttacataatcccttatttctcaaacactttatttttaaaattctcttttctttatttttgtctgactagattaatttgaaaaaccagtcttcaagctctggaactatttttctgcttggtctagtccattgataaagatttcaattgtattttgaaattctttaagtgagtttttttttattccagaatctctgattgatttctttttaagatgtttacctcttctttcactttccagattgctttagaagtgtccttgttttgattttcaacattgtcttggatctcaatgaaattccttgcaatttacactttgaattctttttttaaaattttttatttcaagcgatttttgagtacatgtggtttttagttacatggttctttagtggtgatagctgacattttagtgcacctgtcgcccaagcagtgtacacggtacccaatatgcagttgtttttttttttttttttgactgacagagtctcgctctgtcacccaggctggagtgcagtagtgtgatcttggctcactgcaacctttgcctcctgggttcaagcgattcttctgcctcagcctcctgagtagctgggattacaggcatgcgccaccacgcccggctaatttttttttttttttgtatttttagtaaagatggggtttcactatgttggtcaggctggtctcgaactcctgacctcatgacctgcctgcatcggccttccaaagtgctggaattacaggcatgagacactgcgcccggcactcaatatgtagtcttttatccctcacccctcccaacattttccccccaagcccctggagtgcattatattagtcttatgcttttgtgtactcatagcttagctcccacttgtaagtgagaagatatgctatttggttgtccattcccaagttacttcacttagaataatgtcctccagctctgttgtgggaagtcagggacgccgaatggagggactggctgaagccatggcagaagaacataaattgtgaagatttcatggacatttattagttccccaaattaatacttctatactttcttatgcctgtctttactgcaatctctgaacataaattgtgaagatttcatggacacttatcacttccccaatcaatacccttgtgatttcctatgcctgtctttaatctcttaatcccatcatcttcgtaaactgaggaggatgtatgtcacctcaggaccctgtgatgattgcgttaactgcataaattgtttgtagagcatattgtgtttgaacaatatgaaatctgggcaccttgaaaaaagaataggataacagcaatgttcagggaacaagagagataaccttaaactctgaccgctggtaagccgggcggaacagagccatatttctcttctttcaaaagcaaatgggagaaatatcgctgaattctttttctcagcaaggaacatccctgagaaagagaatgcattcctgaggttaggcctctaaaatggctgcttcaggggcagccatcttttacgatcgaagctgtagggatgaaataagccccagtctcctgtagcgctcccaggtttattaggacgaggacattctcgcctaataaattttggtcagactggttgtctgctctcaaaccctgtctcctgataagatgttatcaatgacaatgcgtgcccgaaacttcattagcaattttaattttgccccggtcctatggtcctgtgatctcgccctgcctccatttgccttgtgatattctactaccttgtgaagcacatgatctctgtgacccacaccctattcgtacactccctccccttttgaaaatcactaataaaaacttgctggttttacagctcaggggggcaccacagaacctgccgacacgtgatgtctaccccggacacccagctttaaaatttctctcttttgtactctttccctttatttctcagaccagcctacacttagggaaaatagaagagaacgtatgtgaaatatcgggggtgaatttcccccgatacagctccatctaagttgctgcaaaaaaaattattttgttcctttttattgctgagtagtattttatggtgtatacataccatattttctttatccgtttgttggttgatgggtccttaggttggttgcatatctttgcaattgtgaattgtgctggaataaacatgccacatgcatgagtctttttcatataatgacttttcctttgggtagatatccagtagtgggattactgaattgaatggtagttctacttttggttctttaaggaatcttcatattgttttccatagtggttgtactaatttacattccctccagcagtgtaaaagtgttctcttttcaccatgccaatgtcagcctttatttttttttactttttaattatggccattcttgcaggaatatggtggtatctcattgtgattttaatttgcatttccctcatgattactgatgttgagcattttttcatatgtttattggctgtttgtatatcttcttttcagaaatgtctattcatgtagtttacccactctttgatgagcttttttttctgatttgtttgagttccttgtagattctggatatgaatcctctgtcagatgcatagtttgctaacattttctcccactctgtgtgctgtctgtttactctactgattaattcttttgccatgcagaagcttttttagtttaattaggttccatttatttatatatttatttatttgcatttacttttggggtcttaatcatgaattccttgcctaagctaatgttcaggagagtttttccagtgctatcttctagaatttttatggtttcaggtcttagatttaagtctttgaggcatcttgagttgatttttttataaagtgagagatggggatctagttttattcttctaaatgtgacttgccagttttcccagcaccattggtttctatattagttagggacctttgctgtagagctggtgttatcctttgctcatgtcactacattcagattctttatggtgccagaattcttgtgctagttcttcctcatctagagaccctagcatttgtgggttgtgtatttattttcattcatgtctaaatttttatttttatttttctttctctatttttttctttcccttcccatttgcgctcctccctgggggctgtgactctagagaattctgggtagggtctcttgggttttcttctgtagccccatgcacttctggagatgggttttatactgggctgtgcaattcaacctacaagccagtagatggtgcttatgggtaagagccagttttgaccaatgtggctgcatatatacttgatcactgtttaccaggagaagttctctgttgcctcagagaatgaactgattcatgatgtggacagtagtctgagctccctcctcagccctggagaggtgggggggtaagatggacagggcaggaaaagactgggcaggtccaactacaaattccaagatggcaggaacaagcactggtgccaagggacaatccaatgaccagccaccaagtacccagatgtgtgcctaatcatggaggtgggaaacctccttggccccaagttctctgcacaggaatagggggcagcctaaactcctaatccaggagagtgagtgcttcagaagcttggagatctgcctgggcatggagcagaaaggggccccctgcacccagatctcttcacaggaggggtggggtgactcaggctactgaaccagacaagcaggtgttctgaatgcttggatatctgcctgggttgaaacagatagggccctcctgcacccaaatggctgggcaggaaaggtggggcagctcagggggtcaatccagctgagcagacactttgaatgcctggagaactgcctgggcatggagtggagagggccccactgcaccactgtctatgtgcaggaagagtgggacagctcaggctgctgaaaaaggtgagtgtgcgctctgaatgcctgaaggcctgcctagacataaagcagaaagggacacctctgcacagtatctctgcacaggaagggtggggtgactcaggctactgtccatgcaagcaggtgctccaagtgcctggagatctgcctacatatagagtagagagagccccactgcaccatgatctatgcacaagaagtgttgggtggctcaggatgatccagatgagagagtgctctgaatacctagagatctacctgggcatggagtagagagggcttgtggtaccacaatccatgtccataatgggtgaagccgctcaggctgctgttccaggcaatcaggcattctgagtgcctgaatttttgtttgggggtagggcagatagggccttgtagcatcatgatctcagggaagcaggctaggcacctggcaatgacacacacaggccagttccaggtcaccaagctggccctggctgcaagtctcatcatccaggagaaactgtagctgtagcagctctcctcccactacgggtctgcaataggagatagtacaattccggtgcctactgctgaggcactttccatagttctggttgtagaggcccctaactcattcaaaagtagagactccaatgtctggcctgagactaaaatgcttgcacagtcatgctgccaggtcaccaaagaatgggtgattttgtatgtgcctgggttaaaactgggatcctgctttccatcccaggttggggaaaatgcctgcagttattactggcgtctttccttcagaacatctccaagcctctcctcaaacaagctccagggtttaggaggaacactgtgctctccctcagcctgggtttctcagatctccaggggaaaggtgagtcacagagggaggctctctgcctctgttgtgtactgggacttcactcattttaccagccaggtactgtcacagggctgtttgcccatgttctcctccccaggatctgagttgtccttcatgatgctggtggactcccattttccctcctgaattaaaggtcacataattgatctttatacactatcttgctatttttagctgagccatgctaaaagtgtctaatctgcaatcttctttgagaaaaacaaaattatacttctaaataccatgatgaaactgttatttctaggctttttgttttaaaaaattatacgtcaactttattcaatggaagacaaagatttacattcttcacactctctaatcacgtgtgaacacatatgcatgtatgaacctatgcacacacatacacactcacatacactcttctccttccctgttcttttaatagatttcttggttaaaaaaataattaaaaaaaacctttcattgtttatattactataaacaagtatatagtaatagaattttgcatttccttttctgttatctctagatttaatacttgcatttatttatttgcaagttttcctacatacttttatctaacttatctccaaactctccaccagagatgtaattctttcaattcttttagctcattatataacctatacatttaattacttttcttgaaggcagtttttcaagaatctttcatcctctgcttcactttgggcgggaggttcagtaagtctattgcataaccgtcttttatatctcccttaaacataattctaggaatacccattcttattttctgtgttggattttttatatcttatgttttactctttttagataattctctgttttggaggaggatcacaatctctagcagattcctgagaagagtatacgggagccaaaaatttgataccttgcatatctgagcacgcttttcttctattctaacatttgataaataggttgggtataaaattcaagttacttttttttaatccctcaaaattttgaaggcattggcctgttattatatcataacttgaaatgtttctatacacaagtctcaaagttactttctaaagcttctgttaaatttttaatttctgttgtcacattttgtgtatttcaagaactcctttgaatcatcttaatttttccttcttatagccttctgttcttttttcctatacttgtaaggatagcaataatgctttttaaatgagtatttttcccatgctctacattgtctctcttttttttataaatttctgttacctattgtattgttttgttctgtgtttcttgctataggttttcctcaaatatctagtgactatggctctacactcatatttaagagtgagtgcataaaatacttatcagaaactttgtgcatagatgatgctttaatgaattaataaatggttggcttcatgtatgacaataggattgagatatttcttttgggaattcccaagagttagcaactgtatatctcttctcttaggttattgagtttctccacagcataatcttctaattcctgtcctggactgcataagcctgtctgccagaattcttgggtcttaatggcgaaaaagacttgtgtcctcatcatttttaccaaattgctctgtaatccgtgtgtttgcattctgctgtactgggaattctcaagtcctgagtctctccagttcatcttgagagcaagccttcattcttcttacagtttagaagaggcaatccttcaaatatgtggagtacggagggcacctgggatctatagccaatcctcctcccacattaaatgttgttattccaattcttgagcatttctgtggttctgtggtcacacattggctttctcctgaattgctttcatgctaccccatcacttcctggcttaagtttcagccttctccggtttgctaaatcatatgactaccagattcaaaaattttgctgttaccaccttcttttctgttctcatttcctaagtggtttatgtcctgtatggtctttcgtcccagccattttagtgaggtgtgagaaggaagcagaggtaagtagttgactacgatccagaaatatttacaccagagactccagggttttttttttaagtaattttctgcagatttcagtattttatagaaaataattttcatcatgatacaaaaaacaaatattttcaaatttggtagaagttggcccatatattgtttacagaaatagtttgctcttctttgaacttaatctctaatttcatttagcccaggaaaattacctactttatcataaagtatcagtttctatatctattaatgattcaatgaggacagcacacctagtttcaactatcgagcctgtcaaaataattagaatatgtttttggtacttaaaaatgctacagatcttatttcaaaaaaataaataaagtttacatgacaatttctttgaaccgtatcttgaatgtaaatgttaatttgatagttattcatgtaaaactaccaactaaaagtgtacgaaaggggtagtatattattctgtaactgaaaatagggatgggaccaaaagtatgctaggtcctttccaataaaatgtttttccttacatcttaaatgaattgagatatacaatacacctagaacattgtacgaattcaaaaactattggtacccccatgcgtttcttttttcattatttacatttgcttactgccaacattgcattacacattgtacatatagtgaataaaaaatattttattttacttattcttaccatctgttgtgttcaaaatcacttgagctttattaattcatcacaagtgatttaaatatgtaaaccagtttatcttctgaaatatcttaagataaaaattgagtagcaacctattacgtcatttgttcaaacatatctctcaaacagtttttgcaaaaaatctgtctgtcagggtcaacattgatttaaagagaaatgtgcaacttacctttcatcttcatgctgtattcaagtaagaggagggctatattagctaaggtatccaacagagcaaaatattgtataaaattcacatcaccacatttcccactatgcattgtcatagtccatttatggtaaattgaacaaaattattcaatatttaaaactgactaccatcactttttaaaatagtaaaataatttggaaatgatgcgttaatagagaactccatttggtttcatgctgtaaatataaaatattcacatacactcaatacatatactaaaagcacatacagccaaaatacataacaaacatagtaagccttctaatgctacaagatagtccttgaacgttattaaactctatagttgaaacaaataaatggccattctaagttatgatggtgatatctgatttgcattactctatcttcccatttgaattcctgtgaaaacacagagcatggtgtagaatttaaacagccctaagaattacttttagtagatgagcaggactaagaggcaaaagctcttagtatcttaagatgttaaacatctgtaaaagtggcatggccaaataagcatagacaagaaaagacggtttactctcattctatattgccacattagtgactcaaagatgggaatatagactagaaactgtgttggccactctctaccattctattagcttttaaagttagtgatgttacccctagaaggcccccttaagtacttcttgctaagttccttaaggaaactatagttttttgtaatgcaatcgtccagtggatgaaagggaataatcagtaactaaaattcttttcaaaaagtttctaatatatgagtcaagaatatatgaatatttttaaaagtaccccataactgaaaataagaactcaaggataggtttgttttagtcattcatagtaattaaacttataaagacatatttatatacttattaattacaagaaataaagtgatacataaatgaataataaaataatgaaataattatgtaataatggtaatttaaatgtataatcataaattatattggcatacattggcaagtgctgagagaatgtagtaaaaatgctaaatatttcaacttacataagaataaatcaaatgtaatgttcaccaattttataattataaaaatattgttacaaatataattgtaaaattttgtaaaacagaaaaaagtaaaagtaagaagtattaaattggccattttcttaagataataccaatatttttttaagaggatgaaatatcaaaagtattctgatacattgtttgtggaacataaattggtataggctcactggaaagaaatttaacaacatgattaaataggcataacaatcactgtgttgattaactcattaattctacatcccagaaaatttactatgagttcaaaagtcagagcaatcacctaggatatatgtgcaataatgttcaatacagcattatttataataagatataaatgatcaaataaaaacaatttaaatgtgaaacaaaaaagaaccagatgtaaaaactatactatgtgtttgtactataatatattgtttacattaaaattatttttcaaaaaatatctaatgccaaggaaatttttatgatatgattttaaattaaaaatagattacatatgatgtgacctcaatttattgaaagaaaaaaatgtatatagaaaaaataatgaacaaaatgggaaagagatacattaaagtattattaaatcttactaatatgtggtggttttacaggtggttttcattttctcccttataacattttgtacattgcaaattatctgtaagtgaatatctattacctttaaaatcagaagaaataagctaagtggccacaaacactgatcttttattaaagatatattacatgtattccaatgtttccttgaagctagtccaactgaaataatctaaaatccacaaatgagtattttcacatattattgcattacaaatggtgacaaccattcatctttattaattttgtcacacttaaaaaatagaatctctaggtgtctttctactgctcttatcttattctggcccatcttctgtttgttataagtcaagtggcaggtgctctctcatcaacaaagcattgcttctgagattgtagggggagggagaccaataaataagggtcattaaattttcttcgtaggttgtagtagcatattttcttgaaataaaacagactagactagacaagagtagaataaaatataaagttgagtataaaagagcagaatggaatagaatagaacaggatatatcagtaagggaattattgttgccaaaatcttttattttagctatatatgtgctgatgtactgagtcttgagttcagatttatgtttgcacatgggtcatgattttttaaacatggagaaatgagttctgtaggatgaatatggttaactgtaatttattgtatattttcaaaaagctagaagataggattttgaatatccacaacataaagaaatgataaatgtttcaggtgatacatatgctaattatcccaattgatcattacacattgtatacatgtatcaaaatatcactctgtatcccacaaatgtgtataattattaggtgtaaactaaatttaaaaggaaaaagtatatgtgaaaaaaaatgcttgaaagccactataccaaacagtaatttaaaagcagaaaagatattttgctaaacctaactaaagtgttcttgctacttctgccataaaataaaaaagatgtggccattaaatatttgcttgagtatcaagaaatatggtatttcatttcttccctgtagctcacatttctataggaaaacaaacatgactgaggattccagaactggaccttcaaaaaaatgtgtgctgcacaccacattttattgatcccttatttaaaactcccccaccagccaatgccttcatctgcaaaccaactacagtaacaggcttggattcagcaaaataggaaatttacaaatgtacactgactttgaaaacatatacatggcaaattgagaattcagcccaccagaagtaaactataaatgcaaacattcccaacagcaactttcaaataaataggctgcaaattggaaacatgaacacagcaaacttatggacctcagattgcaaatcacagcagcaattccctgaaaataaggcagtcctcttttcttttgtatagcatgttacgtatcttttattttcagaatcctggagaactgaataatgtttatagaaccttgggggagacagttttcatagatctggaatttaaaaaaaaaaaaagctatatttgtgacgtttttgtgaataggtttacatttagttacctacctcctctaggcagttctccttatactcttctgtgccccttgaggtcattcacatgagtgtggaagagaaaataaaaattagaaagaaaaaaaagctgaccgggcgtggtggctcactcctctaatcccagcactttgggaggccaaggcaggcagatcacctgaggtcaggagtttgagaccagtctgaccaacatggagaaaccccatctctactaaaaatacaaaaaaatagccaggtgtggtggtgcatgcctgtaatcccagctacttgggaggctgaggcaggagaagcgcttgaacccgggaggtggagattgcggtgagccaagatagcaccactgcactccagcctgggcaacaagagccaaactctgtctcaaagaaaaaaaaaaaaaaagagaaagaagagaaagaaaagctaactggcctattctgtggctgtggcagatggaggctttgaccagaaaagcctcaagctttggaaccagactctgaaactttgggtatattccctaaccttgctgagtattagcttttatgtttttaaagtaggaaatgataccaacagtatacctacctggcagacttgacatgaagattaaataaaatagtgtattaagtatcctcagtatatattagttattattatttttattagtgttctaaattgtctaactagaccacagaagaacatggaagaaactataccatggtcacaggcttctgcctcatccaacattctcactatttcaatcttccaaataaaaaggacaactttactgaaactgcaaaatgtttcattgtgtcattcccaactttcatcttttccggtttgtttccaaatgattttataattcaaattttctctttacttgttgcattcttttcttattttgttatgtaatgtctataatatcatctatgttctgcaattatgtctccattcctttgcacttctcattgtctcagtaagacttttctttctttgtttggctttcctttaagataataagaatgtgactatgaactcatcttacatccctgttaaagagataaaagtgctaaaagtgacagaggggaaaaaagcatcccatgaagaaataattgcacatagaaagagcctgtttcaattatctattgctgtgtaactaaccactccaaaatttaggggattaaacagcaagctagaacctcactgattctgtaagtcaggaattctggcaaggcccagttggacaaattttctgttttttattggcctcaatcaaaattattcatgtactcagatggcagaaagactggcctaaaggatccaagatggcaccactcacatgcctggtaccttggcagaaatagctataaagcgaaactcaacaggcactttcaacccaagtgcctacacatgacatctgcatgtggcttaggctacataacacgggatcttacagtagtcagatctcctacattacagcttgggactcttaagtgcaagtgttccagcaaacaaagcaaaagcctcattaccttttatgacctatcctcagaagtcaggcagcaccacttccactacactctattggttgtttagagctgcagaaaattcagccataattgataatactcaaataaaagaagaagaaaaaatctcacatgtggttgattgaaacaaaacaatagagtgtgacaaaagtaaatcacatttaatgaaataatttctacatttaattaaccatattctaaactacagaatctctatacaggcagtgtgatgtaatgtaaagctttgtaattaaaggcagaatataatttcatgttctgtctgcacatcaggcaagtcataacttctgggaccctcctcccaggcccacggagccttgctcattgttagcacagcagtctgagatcaaactgcaaggcggcagtgaggctgggggaggggcgctcaccattgctgaggcttgagtaggtaaacaaagtgaccaggaagctggaactgggtggagcccaccacagctgaaggagacttgtatgcctttgtagactccacctctgggggcagggcatagccgaacaaaaggcagcagaaacctctgcagacttaaatgtccctgtctgacagctttgaagagagtagtggttctcccagcatgcagcttgagatctgagaatggacagactgtctcctcaagtgggtacctgaccctcgagtagcctaactgggaggcactccccagcaggggcagactgacacctcacatggccgggtacccctctgagaggaaacttccagaggaacaatcaggcagcaacaatcgctgttcagcaatattcgctgttctgcagcctctgctgctgatacccaggcaaacagggtctggagtggacctccagcaaactccaacagacctgcagctgagggtcctgactgttagaagcaaaactaacaaatagaaaggacatccacaccaaaaccccatctgtatgtcaccatcatcaaagaccaaaggtagataaaaccacaaagatggggaaaaaacagagcagaaaaactgaaaattttaaaaatcagagcgcctctcctcctccaaaggaacgcagctcctcaccagcaatgtaacaaagctggacagagaatgactttgatgagctgagagaaaaaggcttcagacgatcaaacttctctgagctaaaagaggaagttcaaacccattgcaaagaagttaaaaaccttgaaaaaagattagacgaatggctaactagaataaccaatgtagagaagtccttaaaggacctgatggagctgaaaaccatggcacgagaactacgtgatgaatgcacgaggttcagtagccgattcaatcaaatggaagaaagagtatcagtgattgaagatcaaatgaatgaaatgaagcaagaagagaagtttagagaaaaataaaaataaaaagaaatgaacaaagcctcgaagaaatatgggactatgtgaaaagaccaaatctacctctgattggtgtacctgaaagtgacggggagaatgcaaccaagctggaaaacactctgcaggatattatccaggagaacttccccaacctagcaaggcaggccaacattcaaattcaggaaatacagagaatgccacaaagatactcctcaagaagagcaactccaagacacacaattgtcagattcaccaaagttgaaatgaaggaaaaatattaagggcagccagagagaaaggtcgggttacccacaaatggaagcccatcagactaacagctgatctctcggcagaaactctacaagccagaagagagtgggggccaatattcaacattcttaaagaaaagaattttcaaaccagaatttcatatccagccaaattaagcttcaaaagtgaaggagaaataaaatactttacagacaagcaaatgctgagagattttgtcaccaccaggcctgccctacaagagctcctgaaggaagcactaaacatggaaaggaacaaccggtaccagccactgcaaaaacatgccaaattgtaaagaccatagaggctaggaagaaactgcatcaacgaatgagcaaaatcaccagctaacatcataatgacatgataaaattcacacataacaatattaaccttaaatgtaaatgggctaaatgctccaattaaaagacacagactggcaaattggattaagagtcaagacccatcagtgtgctgtattcaggaaacccatctcatgtgcagagacacacataggctcaaaataaagggatggaggaagatctaccaagcaaatggaaaataaaaaaaggcaggggttgcaatcctagtctccgataaaacacactttaaaccaacaaagatcaaaagagacaaagaaggccattacataatggtaaagggatcaattcaacaagaagagctaactatcctaaatatatatgcacccatcacaggagcacccagattcataaagcaagtccttagagacctacaaagagacttagactcccacacaataataatgggagactttaacagcctactgtcaacattagacagatcaacgagacagaaagttaacaaggatacccaggaattgaactcagttctgcaccaagtggacctaatagacatctacagaactctccaccccaaatcaacagaatatacattcttttcagcaccacaccacacatattccaaaattgaccacatagttggaagcaaagctctcctcagcaaatgtaaaagaacagaaattataacaaactgtctctcagaccacagtgcaatcaaactagaactcaggattaagaaactcactcaaaaccactcaactacatggaaattgaacaacctgctcctgaaggactactgggtacataacgaaatgtaggcagaaataaagatgttctttgaaaccagtgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaattaatgaatccaggagctggttttttgaaaggatcaacaaaattgatagaccgctagcaagactaataaagaagaaaagagagaacaatcaaatagatgcaataaaaaatgataaaggggatatcaccaccgatcccacagaaatacaaactaccatcagagaatactataaacacctctacacaaataaactagaaaatctagaagaaatggataaattcctcgacatatacaccctcccaagactaaaccaggaagaagttgaatctctgaatagaccaataacaggctctgacattgaggcaataattaatagcttaccaaccaaaaaaagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaacaaaaaaagagaattttagaccaatatccctgatgaacatcgatgcaaaaatcctcagtaaaatactggcaaaccgaattcagcagcacatcaaaaagcttatccaccatgatcaagtgggcttcatccctgggatgcaaggctggttcaacatacgcaaatcaataaatgtaatccagcatataaacagaaccaatgacaaaatccacacgattatctcaatagatgcagaaaaggcctttgacaaaattcaacaacccttcatgccaaaaattctcaataaattaggtattgatgggacgtatctcaaaataataagagctatttatgacaaacccacagccaatatcataatgaatgggaaaaaaccggaagcattccctttgaaaactgccacaagacagggatgccctctctcaccactcctattcaacatactgttggaagttctggccagggcaatcagtcaggagaaagaaataaagggtattcaattaggaaaagaggaagtcaaattgtccctgtttgcagatgacatgattgtatatgtagaaaaccccactgtctcagcccaaaatctccttaagctgataagcaacttcagcaaagtctcaggatacaaaatcaatgtgccaaaatcacaagcattcttatacaccaataacagacaaacagggacccaaatcatgagggaactcccattcacaattgcttcaaagataatacaatacctaagaatccaacttacaagtaatgtgaaggacctcttcaaggggaactacaaaccactgctcaatgaaataaaagaggacacaaacaaatggaagaacattccatgctcatggataggaagaatcaatatcgtgaaaatggccatactgcccaaggtaatttatagattcaatgccatccccatcaagctaccaaggactttcttcacagaattggaaaaaactactttaaagttcatatggaaccaaaaaagagcccgcattgccaagtcaatcctaagccaaaagaacaaagctggaggcatcacgctacctgacttcaaactatactacaaggctacagtaaccaaaatagcatggtactggtaccaaaacagagatatacaccaatggaacagaacagagccctcagaaataataccacacatctacaactatctgatctttgacaaacctgacaaaaacaagcaatggggaaaggattccctattgaataaatggtgctgggaaaactggctagccatatgtagaaagctgaaactggatcccttccttacaccttatacaaaaattaattcaagatggattaaagacttaaatgttagacctaaaaccataaaaactctagaagaaaatctaggcaataccattcatgacataggcatgagcaaggacttcatgtctaaaacaccaaaagcaatggcaacaaaagccaaaattgacaaatgggatctaattaaactaaagagcttctgcacagcaaaagaaactaccatcagagtgaacaggcagcctacagaatgggagaaaattgttgtaatctactcttctgacaaagggctaatatctagaatctacaaagtactcaagcaaatttacaagaaaaaaaacaaacaaccccatcaaaaagtgggcgaaggatatgaacagacactcctcaaaagaagacatttatgcagccaaaagacacatgaaaaaatgctcatcatcactggccatcagagaaatgcaaatcaaaaccacaatgagataccatctcacaccagttagaatggcgatcattaaaaagtcagaaaacaacaggtgctggagaagatgtggagaaataggaacacttttacactgttggtgagactgtaaactagttcaaccattgtggaagtcagtgtggcgattcctcagggatctagaactagaaataccatttgacccagccatcccattactgggtatatacccaaaggattatagatcatgctgctataaagacacatgcacatgtatgtttattgtggcactattcacaatagcaaagacttggaaccaacccaaatgtccaacaatgatagactggattaagaaaatgtggcacatatacaccgtggaatactatgcagccataaaaaaggatgagttcaggtcctttgtagggacatggatgaagctggaaaccatcattctcagcaaactatcacaaggacaaaaaaactaaacaccgcatgttctcattcataggtgtgaattgaacaatgagaacacttggacacaggaaggcgaacatcacatactggggcctgtggtggggttgggggaggggggagggatagcattaggagaaatacctaatgtaaatgactacttaatgggtgcagcacaccaacattgcacatgtatacatatgtaacaaacctgcacgttgtacacatgtaccctagaacttaaagtataataaaaaatatatctattatatataaaaagaaaaaaaataaaacctctgggaccctccaatgtttcatccatagttggagattttaggaagtttgcttggctaactctgaaatacataccaacttctttgaaaacagatggctataaatgtatgagataatgcgctcttcataacaactgtgttaaatggatttttaattatcacttctattttacaaaatacaagaaacaggggttaaaaaacattaagtaatttactcaaagttacttaaagcaagcagagccaatattctatcctagatctatgactcctaagacctttgaacactatttgactgtacaatgcctacttcctttaccattgtgatgattctggatgtgatcatttaagaaatggctttgtaaaccataaagtgttctgtgaatgtacagcatcattattagtattgattccaacaactgagagagctataattgcctgtaataagattgattatgcttcacgatataaccaataaactagctaaacctcaaattctaatccccaaatgttcgtacaaaacatgactgaaaacaaatgaaatcatattgatcagctctaaaaataatagaacctgattataacatttgtcctgtggcagctgcttttatccccctatttctcatcatatatcacacagagaaaagaccctttttctcgtgcctgccatcatttatcctttaggaaaaaaagacctctcttctctatctcctcaaacttgaaagataaaacaagatataatgaagaagtgtgaagagcagagaattagtgagtctactcctttttcctccttttgtaagacggtttgatttgattcaatatcagcccagaaagatggaggatatttcttttggtggggttctgtcaacagaaattagacaatctaatttaaggaaaataggaaggaaaaaattcaaacttactgctattttacaatccaaaacccagtatgtagaatgaatatctttgaatcattggtatgtaaggttttcaaaacactgaagctgtccctttatcaggtctagcatttcccctagaagcaaatgataaaatatgaagagtaaaaactgtttcaatatcattataaagtacagatttgtagttctgtacattcaaaatagaaaataaaaaattaaacttaaggatttaatctgatttaggcctaatgaactttgctcaatagtgtgttaccaacatctagccatttcaaaaaatcacatctttaccattttattatttacataattaagtctctcttcatctcacaagtctacagaaaccagtactggtggttacaagttaaagtgtccactcattttctctcataacttatctctgaccttgtcaaatttcctctccaataatatgcgtcatataaatgtatagtacttaatatataaaatgtcaggcatatacatagaactttatagtttccttaacactttcatatgtactgttatatttataattaagcatattttaaatggccgtttttaagtggtcatcattaaaacacagagtatctactctgtacttagaaaaagaagcaaattttagatcacttactttttgacacttatctttagtgactaagacaaatatttatctaatttctatctgcaacaagtttttcaattgctttaatcaccgttctctgatctattatttatacctcggcaagtttttttaatcaatcagcttacttctttttttttgtacaaatagttttatctttaaaaaatcatttcatagatcaaaataccataggaaccaactttttaagtcttagatgtttttcatatatcatttactggtgttaaaaacagatttcttacctctttatttgacttcacattgtctgcatcagctctgctctctcaatcaactctgccaactatagaggtcaggaacaataacatgtaatctttagcttttctgaagttgaatttcctgtgtctaactatatttgatcttttagtagaggctttgaaatggggttagcataataatttgttagtttataaataaaggcatgtggtcaatttttggcatgtcatgagttgtttttgctgagaacaggatgtgagtacactggtgagagtaacttaattgtatttgaatttttccacatcccattgtgcctaatacaccacttgccacataatcagtactcaatacatgcctgctaaattttaattatgtaaataatgaaataatttaagattataatttggatttattttttaaatgttgaactgaattcctgaattagccaatgtttggtgcttagtctggaattaaagacccccagattatttcaaaagctctcccatagagtaataatacacatttggccataataaaccttacttattacatcagtgttaggcatataacgtttaaatctctatcataatttcagatctttggtcaagacctgctacctaagcgaaaacaatttttaatataagagcaggcttagtgacaaactttcattcataccttaaagtgaataccattaaaatggcaaaaactgatttatatgctaagtttccaacacagacaaagttttccaatggctccagagtgcccaattatggaaagaaatgggaaaaaagcataaatacatgaacaacaacaaaaaaagccttactcctgccaaactacaaaaaaagacacatgggaaaacttgatatttaaaaaaaacaacaacaaaaagaatggatgggctataatgcagcacttttaaaaggaaattacagtaaggcactcaagcaactaaatataaaaaatttcaagaaagaaagtcaaaactacttcgagttgtttatttttttattttttggaagcacaaaactcatagggtctataaaacaataacacaatttaaaaaagtaggcaacaatatgatgaatagaacactcccaggtcacacctcaatgttttattattattattattatacttaaagttctgggatacatgtgcagaacgtgcaggtttgttacataggtatacacatgccatggtggttcactgcacccatcaacccatcacctacatttggtatttctcctaacgctacccctcccataacccccccaccccctgataggccctggtgtgtgatgttcccctccctgtgtccatatgttctcattgttcagctcccactgatgagtgagaacatgcagtgtttggttttctgttcttgtgttagtttgctgagaatgatggtttccagcttcaaccatgtcctgcaaaggacatgaactcatcctttttattggctgcataatattccatggtgtatatgtgccacattttctttattcagtctatcattaatgggcatttgggttggttccaagtctttgctattgtgaacagtgctgcagtaaacatacgtgtgcatgtgtctttaaaaacaagctggtacaaaaagaggaaattcactagtcctggaatatctcagagataagatgactgtcaactactccaatatttatgtcacttttcaacagattgatttttgacttggattgtttttatgcaattaaaaatcataattaccttaaaatatttctaccctacatgcaatgtttagcatttaatgaaatgtaatgttgagaggagggaagcagggagagatggtggaatagaacactccagagatcatcccccctgcaaggacaccaatttaacaactagctatacagaaaaaaaaaaaaaagaccttcataagaaccaaaaatcagatgaaacctcatagtacctggttttaaattcctttcattaaaagaggcactgaatagatagaaaaaaatagttttgaattgcaaatgtcaccacttccccacccacctcaggaccactcccccccatcccctgacagtgatggtgtggtgcagagagtgtctctggattctgggggacaaagacaatgacaattgtgaggcactgaactcagtgctgttcagttagagcagaacgcaaaaccagatcaaattcagatgagacccgcctacagagggagcatttaaaccagccttagttaaaggggaattgccgatcccagtggtcacaacttgagttcccacagacctttccacaaagtggtaaactgctctgagtctctaagtgaacttgaaaggcaggctaagccacaaggactacaactcttaggaaagtcctagtgctgaactgtgcccagagacagtggactggggggagggtgatgtgacctgctgagataccgggttgaggcagtcaaaagagtgctggcatcatccctcccctaaccccagtctgctcagctcacagctacaaaagagacccattacttctgcttgagaagataagaaaaaagagaggggaagactttttcttgcatcttggataccagtacagccacagcagaatagggcactgatcagagttatgaggtctctcttccaggccctagctccaagatgacatttctagacacaacctgggccagaagaaaacctgctgcattgaagggagggactcagttctggcatcatgcatcacctgctaactgaagagcccatgggcccagaataaacagcagtgataactaggtactatgtcgagggccttgggtgagcctctgagacctgctggcttcacgtatcagcatggccaaagagaggtagagcaccaagttggctaatgtggtccctgattccaggaattgactttttttttttttttttgagacagagtctcgctctgtcgtccaggctggagtgcagtggcatgatctcggctcactgcaagctctgcctcccgggttcattccattctcctacctcagcctcccgagtagttgggactacaggcacccaccaccacgcccggctaatttttgtatttttagtagagatggggtttcaccatgttagccaggatggtctcaatctcctgacttcatgatctgcctgccttggcctcccaaagtgctgggattacaggtgtgagccaccgctcccagccaggaattgactcttaaatgatgtctctgaactgccctgggccagaggtgagcccactgcctgaagagtgattcccaggccaggtagcattcaccacaagctgacttaagagattgtggtcaaaacacatgaaaaaatgctcaccatcactggccatcagagaaatgcaaatcaaaaccacaatgagatatcatctcacacatctttagaatggcaatcattaaaaagtcaggaaacaacaggtgctggagaggatgtggagaaataggaacacttttacactgttggtgggactggaaactagttcaaccattgtggaagtcaatgtggcgattcctcagggatctagaactagaaataccatttgacccagccatcccattactgggtatatacccaaaggattataaatcatgctgctatacagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagttggaaatcatcattctcagtaaactatcgcaaggacaaaaaaccaaacaccgcatattctcactcataggtgggaattgaacaatgagaacacatggacacaggaaggggaacatcacactctggggaatgttatggggtggggggagggaggagagatagcattgggagatatacctaaggctagatgatgagttagtgggtgcagcacaccagcatgtcacatgtatacatatgtaactaacctgcacattgtgcacatgtaccctaaaacttaatgtgtaataataataattaaaaaaaaaaaaagaaaaaatgctcaatatcactaatcatcagtgaaatgaaataaaaatttaaaccacaaaaaaaaaaaagaaagagattttggtccttaagaatgcatcagcggtggtctggctgtactcctcatagcctgtggtggtgatggctatgaggagaggttcctctgcctttggaaaaaagagagaagagtaagagacagggcatcctgtggtttgagtgccacagctcacccatagtacaaaagaacaccaggtagaattctaggttttttgactctagtctctgactcttgaagggcatctctggacccatccagagcctgggggaacatgccacctgaagacaaggatatacacctggctggcttggccccctgatgattgtagagcccaagggcctagagcaagcacagattgtagccagggagtgattacagcaggccttgggtgagacccagtgctgtgctggctttaggtctcacccagcacaatcatagtggtggtggctacaggggtgcttgcgtcactccaccccaagatttaggaggcatagaacagagagagagaagctatttgtttgagagaaagtaagggaagagaacaagagtctctgcctgttaatccagagaattctcaagaatcttgtccaataccatcaagttggtacctctacatatcttcaaggtttacttcaaagcccacaggtttactgggcttggggtgccccttaaagcagatagagttttgatcacaacacccaagtccttccaaatatctggaaagttttcccaaaaaggatagctacaaacaggtccaggcatgaagtctaaaatgaatacctaaatcttcaatgcccagacactaaagaacatctactagcatcaacacgatccagaaaaacatgaccttatcaaatgaactaaataaggcactagggatcaatcccagagaaacagagatatgtgacattttagacagtgaattcaaaatagctgtgttgagaaactcaaagaaattcaagataacacagagaaggaatttagaattctatcagatacattcaacaaagaggttaaaataattaaaaagaataaagcaaaaattctggagttgaaaaatgcaattgatgtactgaaaaatatatcagcatcttctcagagcagaatggataaagcacaaaaatgaattagtgagcctgaagacaggccatttaaaaatacacagtcggaggagacaaaagaaaaaaaaaaacatgaagcacaactacaggatctagaacatcatctcaaaagggcaaatctaaaaattattttccttaaatatgagggagaaactttattcaaagggataataacagagatttttcacaacctagagaaaaatatcaatatccaagtgcaagaaggttatagaacacaaagcagttttaacccacagaagaataactgaagaaatttattaatcagtctcccaatgataaaggataaagaaaggattttaaaagcaatagaagaaacaagtaaacaaatagcatacaatgaagtgccaaagcatcttgcagcagatttttcagtggaagacttacagaccaggagagagtggaatgacatatttaaagtgctgatgaaaaaaaccttttatcctagaatagtgtatctagtgaaaatatccttcaaacttgaaggagaaataaagactttctcagacaaacaaaagttcaatttcatcaacaccagaactgtcctacaagaaatgctaaagggagtacttaaatcagaaaaaaaaaataatgttaataaacaataaatcatcacctgaaggtaaaaaaaaaattcattgttaatagtaagtatacagaaaaacacataatatcataacatttaaccgtggtgtgtaaactactcttatcctttgtagaaagaataaatgatgagccaatcaaaaataataactacaacttttcaagacgtacacagtacagcatgatataaaaagaaacaatatactaaaggaagggcaagagggcctactagacacagccagctggaacagttcccactaagggactgagacaactggcatgcttttaacagatcttcagagtaaaggtgctaagagtggagagaggaaagatacagaagctggactgaagagagagaaagctggaaacactgcatggggctactatgcactgggacttacttttgaaccacaacagcttcaggagtacgagtgagttgaactgtcaaggaccaaccagctctcaccatgggcccctggaaccctgacaggaggagacccctcaaccatcaccgacatgtgagttggcagaaagagctgcttagagaagtggtaagggcagcaagtcagtggatgtggaacccagaggatttcttgcaggaatgttggtagcagagcatggccaacaacagccatacccctatgcttgacttgatcccatagaagactttagccctaggagaactgtcagacctaatctctgcagggcattcctgcccatcagacatgactggtccgacttgagagccccttggtctgctggcctctcctggggccccagcctggcctgcctgctttcaaggcagtcctgggtgccatgagggcctacaccatattctctgcaccgatagattctgcctgaccagtggagagctccagtgaggtggtctctatggcaacacgctagcccacttgccccctccccatattgcagctttcccagggcgcatggcaactccccacatcacttttctggtgtgtgtctgcactggcaggttttgctttctttgccccactaggatacgggagtgtagtccacatcccaccccccacaaccgccattgcagacaacgtcttggcaggcacagggacagcaagccctgcccctgccagcaccctgtccttgggctaacactgcacagaaaacagcagatcctaccccagattgagtatcactcccgcttgtggggtagacaaggcacccagagctgcactggccagcaccccaccccaaaatcaacaccacatccagcacaaccacatacacagtctcaagtaggggccccacgacccccacagctgcattgcctccaacactgtggtgaacacccacagggaggcaggcaccccagcacctgctagcactctgctgaagctgctgcacctcaccacctctccccagtgttgtgggttgcaaacctaaaggaaccagataacaaagtcagagtaaaatgcaagtcccccagagttagagcacataatccaggagttggaagctgagtcttggcccctgaaaatcttccagaaacaaagccagttagctaaacctaccttataccacaatcaaaacctcgaggtcatcaaatatgataaaagaaaaaaaacattcaaaggttggcaaagtccaaaattgaagatagataagcccacaaaaatgagaaataaacagtgcaagaaccctgaaatctcaaaatgccagagtgcatttttttctccaaatgaccacatcacctttccagcatgggttctgaaacaggctgaaatggctgaaatgaaagaaatagaattcagaatatggataggaattaatatcattgagctacaggagtacgttgaaacccaatgcagagaagctaaaaatcatgataaaacaatttatgaggtgacataaaaatagccagtatagaaaagtgtaaatgtaaatacacccaacactggagcaccaagatacgtgaagcaactattattagaaataaagagatagacaggccccagtacaataatagctggaaacttcaaatcaaatggatcagacacttacatctaagcatcacactatgaaactactgaaagaaaacattggggaaaatctccaggacatttatgggggcaaaaatttcttgacaaacacagcagaagcataggaaataaaagcaaaaatggacaaatggaatcacatcaagttaaaaaaaacttctgcacagcaagacacaatcaacaaagtgaaaagacaacccacaagaatgggagtaaatatttgcatgctactcatgtgacaagggactaataacaagaatatataaggagctcaaacaactctataggaaaaaaggtaataatttgattaaaatatggacaaaagatttgaacaaacatttctccaaagaagaaataagagtagcaaatgggcatatgaaaaggtgctagcatcattgatcctcagagaaatgcaaatccaaattacaatgagatatcttctcacctcagttaaaatggcttacatccacaagacaggcaataacaaatgctggcaaggataaggaaacgcccacacactgttggcgtaaatgtaaattggcacaacgactatggagaacagtctgaaggttgctcaaaaaaactaaaactagagctaccatatgatacagcatttccactgctcggtatataaccaaaagaaaggcaatcaatataccaaaggcactcccatgtttgttgctgcagtgctcacaatagctaagatttggaagccacctaagtggcttgattcatccatcaagagatgaatgaataaataatatatggtatttatacacaataaagtaccattcagccacaaaaatgaatgagatcctgtcatttgcaacaacatggatgaaactggagatcattgtgttaagtgaagttagccagatactgggagacaaatattgtatgttctcacttattttgggaatctaaaaataaaaaaaaaaatacccatagacatagagagtagaaggatgattatcagaggctgggaagggtagtagggggttggcgggaaggtggggatggttaatgggtacaataaatagttgaaaataattaataagacctactatttgataacaaagcagtagtatagtcaataacttaattatattttaagataactaagagaatataattggattgtttgtaacacaaaggataaatggatgagggaatggatacccccatcctccattatttgcttatttcacattgcatgcctgcatcaaaacatctcatgtaccccataaatatatacacctaatatgaaaataaagtattctgaaaaaatcacatgtaatgaaaaatactgtgaaacagaagcatcgtaggaacctattaaacattaaatcttatcaaaagtgagagtccattaataaataaatatgatttgaacagtttttggggatcatcttttcttggaatatttatctttaggaaaagcatagtaaatgagaatttaatcagaaaatctgcaaaaatatgaatacagctaaagtcttttataaaccccacataagccagtgcttctcaaactatctgcagttaaacagcattttttttcaaaatccctaatttgttctagaccaataaatttgtaaagcacaataaaaataaataactagaaaatcgtaagagaaaaaataaagatttgaaaagacgtgcccacatcttttatgttcagattctacagacttaaaattaccctatcaaattgctataaaattttctcaagcttactttaaaattctctacttagcttgttgcagaccaaaaacaaacagcacactgtcaactgtgggcacctcactgtatgcatcacttattatccttaaaacaaaaatgaagagaaatttttagtaaacatatactaaatgaaacagaaagccaaaaaaagtagatcaggtgaaaacaaattttacctacagaaaatattttgtgttataataaaaggaatatttattgacttaagtgtaaagaaaccatttgtttcacatggtgcacaaaacatcccctataagtacactacacaaaatatttccaaaatcttctctaactgctatacactactatgttaaccatatttgcaatcaatcaactatttggattaaatgataaattttaatgctaaatttcatcttttaaaataagatttacatttcattaatacaataaagacttactgatgacccactatatgccagccactatgctaggcactaaagctgtgtgtgtcaaatctgactttaagtaatgttggtggaacactaaacttaattcttatgaactatttttctgccaaagatatggcaggtgaggccatctaccacagtttcattataataaagtatgagttggctaggtgcagtgacttatgcctgtaatcccagcactgtgggaggccaaggtgggcagatctcttgaggtcaagagttcgagaccagcctggccaaaatagggaaatcccccacctctactaaaaatacaaaaattagctgggcatggtggcgcacgcctgtaatcccagctacttgtcagtctgagacaggagaatcgcttgaacctgggaggcagaggttgcagtgaaccgagatcgccccactgcactccagcctgggcgatagagtgtaacttcgtctcagataataatagtaataattaataataataataaaatgtgagttattgcaagccttgggctggtttaaaatttttccttcagagaacacaacatattaagcctataatatctcatttctctctcatcagacttgcaaagaattaaaatagttttaatacacttcttgcaagaatgcagggaaacaagcactcatgtactactggcgactcggcaaactgttagcacttctttagtggcaatctaacaaaaattttcaaaatttgacatgcatatactgtttgactcagcaattttacctctttcaatttatcctctaaatatccttgcacatacgcaaaagatttatatccagaaaaccaactaaatattcatcaataaaggaatggtttattcatcaataaaggaatggtttaataatcacacacacacacacacacacacacagagagagagagagagacagagagagagagaaacaagcatttataatgaaatactaagtaaccagtaaaaagaatgaggtagctagctgtgtactgacataagaaaatcactgacatggttaactgaaaacaaatgatttgcagagaactacaatacagcatgattgtataagtgcatgggaaatttctggaagcatatccaagatattattgggagagttaaaggagttatctgaaatgggaaggaaactctctttttgtcatctgccctttaattctatctgaactttttcactatgcccatgtttttgaataatataaaaaatagaaaaaaagtaaaactcaatatcttgaccaatgttacctaccatttgtaattcataaaaagatatgtacctctcattgaggagtaataaaaataatagttcctttagcaatcaaatctttgtgcttccttttgtttacttgtctgtaaaagtacttatatattcttgaaaattagaaggcttcactagtgtctcatattaaacaccaagttgacaaactcaacatatttttatgttttataaaacaaaccctatataaagatttggaaaatactgatgggggaaaaccttgaaaaaataccttcaaacattttcatgaacttccattctcatgttctaaaattaataatacacatataggaaattaaaaatgtattattgttactatcaattgataccaattgaatgaacgtaatgctgaaattttctagaaatgcatacataccattgtttgcacataactatgcattgactattagcataatagtacccaaatactgcatgcatcctgcatttacttaggaaacctaaactagctcttttagacaacagggaaggaaaaaacacaccacaaatgtttcttctcatttacgtttaggtcccagtaaaatagtctcccattctgaaatttggtactctaaagatatccactgggattactactgggttttggtgtagatttcctactgtcatactgtcttattgtatcaatgacagtatttaaatatcttaatttcctcctctaagaaactgagctgtgctttcaaaagctttgatgaatataactgaccctagatctagcccatagtaattttgttaaaagtttaccttaagaatggactatatttcagagggtcaggcaaaatatatcaagggaaaattgcagaattacaaggaaatatcatcttgtggagtttcatacatacaaataaagttataaaagcacactttgagaggagagaatagcttgataggctgaacttctacgaagattttagtatctttcagtgatagaaaagaagttagaaagcttaaaatatccagtaaggaagacttatttgggtcaatgtcacaacaatatgtgagcttggtttggaaggttggaaaaattttaatctagtaaaaatcatatagaaacatttttctcatcaaaaaacaaaaagatggataaatcagtaaattatttatggtgataaatagcctgagatgtgggagtaaacaatcgaatcaattgtatcttaacacattaacgtgttaagaaacacattaatatcatctaagacattcagtaaaatgtatatgtttatatagatgataaaagtgttaatgacatggtcccttaaatcaagaagatatgatttttattcaggagacaaaataaataaaagtggaacaaaacataacaccagacagaatatgatcaaatattaaactctattgtccagtcaatacatgttataagaaattccaggagaatggcgtgaacccgggaggcggagcttgcagtgagccgagatcccgccactgcactccagcctgggcgacagagcgagactccgtctcaaaaaaaaaaaaaaaagaaaaaaaaaaagaaattcctaaaggtgcaagtttgaaggctggagtattgaggaggtgaaactcaagttgatattattaagatagatattttcttgataagaaaggaaagggagaagaagaatgctcttctccatttcacatcccccgcaacagacacacacacacacacacacacacacacacacacatacatacacaaatggtcttatattttgttttcatattctataaagtttgtattaatagcatagggataaatgagaaaccagacatataaaagatattaatttctgattcccaaagtagcttttaggacctctaagttctttgggtaagaagaaaagtgagagaaatggaagtcggtgtgctaacaaagtttagttggtttgtgacataagacataaaatacaactttacaacctagttcatcaacactgcaggtactggacaaattgtttacaaatatccttgcagttccaatggaagaactgtgggtgtcttcagcacaggattctgtaattacctttaagaccaagagtaactgtgagtggacgaaccagtttggagaaaatgccttcaaaatcttaaacaactacaaattattatttcaaatattttgaagactcacatatatatgcaattatgtatgcatatatttataatacagtactgagtatatgcacaacaataattatatgttcagcaataaatccaagtttatctataacacacacctacatatgcatgttattttcatttttatatttctacacttcagaaatttacccatgagctgaatcagaagtgtcaaagcatagtaataaaagctacttacaagcagcctaattaccatctctagctatgccctgaaacttaaatcagacgtaacaaagacacattatttaatctgattaacactagcatctatccccagagctcttctgttaaaaatctctttctgtcaggcctgtatttaccattgtcaatcagactacattgtttgaatgtcattttatttttatttttttaaaaattgtataccatttaacatgttttatttcaacatactagatcttttaatgcttcttagaattcaaaatgaattatacaaaaatctttgtatttcatgtcatattatataaggaaatcaaatttggaagaataattcatgctgttttaaatttttacattacttatacattttaatagctaatcaactcttaagcatacttttttgttttattattttattttattttttattttattttattttatttttccttaagttgttggagtacaggtggtatctggttacatgagtaagttttttagtggtgatttgtgagattttggtgcgcccatcacctgagtagtatacgctgcaccatatttgttgtcttttatccctcgccactttcccactctttcccccaagtccccaacgtccattgtatcattcttatacctttgcgtcctcatagcttagctcccatatatcagtgaaagcacacgatgtttggatttccattcctgagttacttcacttagaataatagtcttcaatctaattcaggtcattgaaaatgctattaatccattcctttttatggctgagttgtattccatatatatatatatcacagtttctttatccattcattgattgatgggcatttgggttggttccacgattttgccattgtgaagtgtgctgctataaacatgcgtgtgcaagtatctttttcaaataatgacttcttttcctctgggtagataccctgtagttggattgctggatcaaatagtaattctgcttttagttccttaaggaatctccacactattttccatagcagctgtgctagtttacattcccaccagcagtgtaaaagtgtaaaagtgttccctgatcatcgcatccatgccaacatctactgttttttgattttttgattatggccattcttgcaggagtaaggttgtattgcattgtggttctgatttgcatttccctgatcattagtgatgttgagcattttgtcatatgtttgttggccatttgtatatcttcttttgagaattgtctattcatgtccttagcccattttttgatggaattgtttttttcttgttaatttgtttgaatttgttgttgattctggatattattagtccttggtcagatgtatagattgtgaagattttctctcactctgtgggttgtctgtttatgctgctgactgttccttttgccatgcaaaactctttagtttaattaggtcccagctatgtatcttcatttttattgcattcgttttggggttttttggtcatgaaatccttgcctaagccaatgtctagaagggtttttccaatgttatcttctagaatttttagagtttcaggtcttaggtttaagtccttaatccatcttgagttgatttttgtatatggagagagatgaggatccagtttctttctcctacttgtggctagctaattatcccagcaccattttttgagaatggtgtcctttccccacttgatgttttcgtttgctttgtcaaagatcagttggctataagtatttgggttcatttctgggttctctattctgttgcattcatctatgtgcctatgtttatagcagtgccacactgttttggtgactattgccttatagtacagtttgaaatcaggtagtgtgatgtctccagatttgttctttttgcttagtcttgctttagttatacaggttcttttttggttccatatgatttttagaattgtttttttctaattctgtgaagagtgatggtggtattttgatggggattgcattgaatttgtagattgctttcagtagtatggtcattttcacaatattgattctacccatccatgagcatgggatgtgtttccatttgtttgtgtcttttatgatttctttcagcagtattttgtagttttgcttgtagaggtctttcaactccttgcttagatatattcctaagtttttgttttgttttgttttgttttgttttttgcagcaagtgtaaaacgggctgagttcttgatgtgattctctgcttggtcgctgttggtgtatagaagagctactgatgtgtgtacattaatcttgtattcagaaactttgctgaattattttatcagttctaggagttttctgggggagccgttagggttttcaagataaatgatcagcaaacagggacagtttgacttcctctttactgagttggatgcccttcatttttttctcttgtctgattgctctcgctaggacctccagtgctatgttgaaaaggagtggtgagagtgggcatccttgtcttgttcccattctcagagggaatgctttcaacttttccccatgcagtattatgttggctgtgggtttgtcatgggctttagttacattaaggtatgtcccttgtatgccaaatttgcttagagttttaaacataacgtgatgctggattttgttgaatgctttttctgcatctattgagatgatcatgtgatttttgtttttaagtctctttatatggtgtatcacatttattgacttgcatatgttaaaccacccctgcatccctggtatgaaacccacttgatcatggtggattatccttttgatatgttgttggattcggttagctaatattttgttaaggattttagcatttatattcatcaagcgtatcactctgtagttttgttttttggttgtgtcctttcctggttttggtattaggatgatgctggtttcataaaatgaattagggagggttccttctttctctatcttgtggaatagtgtcaaaaggattggtacaaattctgttttgaacgtctggtagaattctgctgtgaatccatctgtcctggaatttttgttggtaattttttaattaccatttcaatctcgctgctagttattggtctgttcagggtatctaatttttcctgatttaagctacgaggattttaattttccaggaatttatccatctcttctaggttttctagtttatgtgtgtaaaggtatacatagtagccttgaatgatcttttgtatttcagtggtgtcagttgtaatatttcctgtttcatttctcagtgaggttatttggattttctcttttcttttattggttaatcttgctaatggtctatcaaatttatttatcttttcaaagaaccagctttttgtttcgtttatcttttgtacttttttgtttgtttcaatttcatttagttctgatctgatcttggttatttcctttctcctcctgggtttgggtttggtttcttcttgtttctctggttccttgaggtgtgaccttggattgtctatttgtgctttctcagactttttgatggaggtgtttggggctatgaacttttcttcttagcactgccttagctgtttcccagaggttttgataggttgtgtcattattgccattcagctcagaaattttttaaattttcttcttgattttgtttttgacccaatgctcattcaggagcaagttatttaatttccatgtatttgcatggttttgaaggttccttttggagttgatttccaattttattccactgtagtctgagagagtgcttgatataattttaattttcataaatttattgagtcaccttttatggcctatcatatggtctatcttggagaaagttccatgcactgttgaattatctcaatagatacggagaaggcttttgataaaattcaacagtcctttatgttaaaaactctcaacaaactaggtattgacggaacatacctcaaaataataagagccatgtgtgacaaacccacagtcaacatcatactgaatgagcagaagctggaaacatccccattgaaaactggcatgagtcaagggtgcgctctctcaccaatcttattcagtgtagtattggatgtgctggccagagtgatcaggcaagagaaagaaataaaggcattaaaatagtaaaagaagaaggaatctatcctgtttgcgatgacataatcctatatctagaaaaccctgtagtctcagcctaaaagattcttaagctgataaacaacttcagcagtcttgggataaaatatcactgtgcaaaaatcactatcattcttatacaacaacaacagtcaagctgagagccaaagcaagaatgcaaccccattcacaactgcgacaaaaagagaaaagtaccaagaaatatagctaaccagaaaggtcaaatatctctacaagcagaactacaaaccactgttcaaagaaatcagagatgacaaaaacaaatggaaaaacagttcatgctcatggagaggaagaatcaatatagagaaaatggccatactgcccaaatcaatttatagattcaatgtttttactattaagctatcattgacattcttcaaataactagaaaaaaactattttaaaattcatatggaacaaaaaatccaaataaccaaggcaattctaagcaaaaagaaaagagctggaggcatcatggtacccaactttaaactatactacaaggctacagtaaccaaaacagcatagtactggtataatatcagactcatagaacaatggatcagaatacagaacccagatataagagggcgcacctacagctatctgatctttgacaaacctgacagaaacaagcaatggggaaatgattccctattcaatatgtggttttgaaataactggctagccatatgcagaagattgaaagcatgccccttccttacaccatatacaaaaattaactcaagatgaattaaaaacttaaatgtaaaaccctgaactataaaaaccctggaagacaaccgtggcaatatcattcaggacagaggcatgggcaaagatttcatgacaaagacaccaaaagcaattgcaacacaagcaaaaattgacaaatgtgatctaatcaagctaaagagcttttgcacacaaaaagaaaatacaaacaaacaacctacagaatgggagaaagtgttcacaaactgtgcatccaacctaggtctagtattaagcatctataaggaacttaaacaaatttacaataaaaagcaaacaaacccactaaaaattaggcaaaggacatgaaaaaatactcctcaaaagaagacatccatgtggccaacaaacatgaagaaaagctccacatcactgatgattagagaaatgcaaatcaaaaccaaaatgagatactctctcacaccagtcagcatggctattactaaaatgtcaaaaaacaacagatgctggtgaggttttggagaaaaatgaacacttttacactgttgttgggtgtgctgaattagtccaacctttgtggaagacagcatggtgattcctcaaatatctattaagacagaaataccatttgacccagcaatcccattactgagtatatacccaaaggaatataaatctctcaattttaaagacacatgcgtgtgtatgttcattgcggcattattcacaatagcaaagacataacatttacctaaatgtccatcaataatagattggataagaaaatgtgctacatttataccacggagtactatgcagccacaaaataaaaggatcatgttctttgcaggaacatgtacagagctgaatgccattactgttagcaaactaatgcaaaaaaaacagaaaaacaaataacacatgttctcacttataagtgggacctaaatgatgagaacacagaacaacccacactggggacaatcagagtatggaggatggaaggaggaagaggatcaggagaaatcactaacaattagtaggcttaataccttggtaacaaagtaatctgtataacaatctcccatgacacaagtttacctatataacaaacatccacacgtacccctgaacttaaaataaaagttaaaaaaattctgtgaaaaaagagaaacagcaaaaagttaaaagcagggaaatgaagttaaggcacagaatttttattagttttcttgttgcttcttttattatgcaaatagtgtgaagttgttaggtaaaataatgagttataagatggcattttcaagcttcatggcaacctcaaaccaaaaaacatacaatggatacagaaaaaataaaaagcaaacaaccaaatcgtatcaccagagaaaatcaccttcactaaggaagacaggaaatacagacagaaggaagaaaagaccacaaaacaaccggaaaacaaattttaaaatggcaagaataagtccttacttatcaaaaataccattaagtgtaaattgactaaaccctccaattaaaagaaatggagtggctgaacagtttttttaaaagcacgacccattgatctattgcctacaagaaacacacctcacatataaaaacacacatagactgaaaataaagggatgtaaaaagatattccatgacaatggaaaccaaaaaagagaatgagtagatatacttatatcagtccaagtatatttcaagataaacactataagaagagacaaagaaagtcactatataatgataaaggggtcaattcagcaagtggatattacaagtgtaaatatccacacccaacactggagcaccaagatatgtgaagcaaatattattagaaatagatagacaggccccagtacaataatagctggaaacttcaacaccccactttcagcattgggcagatcttccagacagaaaatcaacaaccacaaaaaaaaatcagacttaatctgcactataaaacaaatggatccaatatgtttttgcagaacattttatctaagtgccagagaatacacattttttttcccttggcacgtggatcattctcagggatagaccatatgttatgtcacaaaacaagtctcaaaacagtcaaaaaattgaaataatatcaagcaacttctctgaacacaatggaattaaacaagaaatgaataacaaaaggaactttggaaactataaaaatacatggaaattaaatagtatgctcctgaatgatcagtgggtcaatgaaaaaattaagaaggaaattgaaaaacttattgaaacaaatggttttatggcctgtcatatggtctatcttggagaaagttccattcactgttgaatagaatatgtattctgcagttcttggatgaaacgttctgtatgtatctgttaagtccatttgttccacggtatagtttaaatccattgtttctttgttgtctttctgtcttgacaatctgtctagtgctgtcagtgaagtattgaagtcccccactgttactgtgttgctgtctattttatttcttaggtctattaattgttgtataaatttgggagctccagtgttaggtgcgtatttggtcaggattgtagtattttcccattggacaaggccttttaccattatataatgtctctttttgtctcttttaactgctgtcgctttaaaatttgttttgtctgatattggaatagctaccccttcccgctttttgtgtccatttgcctgaaatgccttttcccacccctttaagtttatgtgagtccctatgtgttaggtgagtctcctgaaggcagcagatagttggttagttcttatccattctgctattctgtaccttttaagtggagcatttaggccatttacaagcaatgttagtgttgaaatatgaggtaccattgcattcatcatgctttttgttttctgtgtatttttgttttttgtttttgctttttaacttgtatttttcttttataggtcctgtgagatttatgctttaaataagttctgctttgaagtgtttccaggatttgtttcaagatttagagttccttttagcagttcttgtagtggtggcttgataatggcaaattctctcagcatttgttggtctgaaaatgactgtatctttccttcatatatgatgcttagttttgccgaatacaaaattcttggctaataattgttttgtttgaggaggctgaagacagtgccacaatcctttctagcttgtagggtttctgctgagaagtctgctgttaatctgataagttttcctttataggttacctggtgcttctgtctcaaaatgcttaaggttctttcctttgtcttaactttgtatagcctgatgacaatgtgcctaggtgaagatctttttgtgatgaatttctcaggtgttctttatgcttcttgtatttgcatgactagatctctagcaaggccaaggaagttttccttgattattccaactatgttttccaagcttttagaattgtcttcttcctcaggtacaccgattattcttagatttggtggtttaacataatctctggcctcttggaggctttgttcatattttcttattattttttctttgtctttgttggattgggttaattcaaagaccttgtcttcgaactctgaatttctttcttctacttgttcaattctattgctgagactttccagagaatttcacatttctaaaagtgtgtccaaagtttcctgaattttttattgttttttctttaagctatctatttccttgcatatttctcccttctcttcttgtatcattttttggatttccttgcattgggcttcacttttctctggcccctccctgattagcttagtaactaatctcctgaattctttttcaggtaaatcagggatttcttcttggtttggatccattgctagtgaactagtgtgatttttggggggtgttgatgagccttgttttgtcatattaccagggttggtttcctggttccttctcatttgcgtaggttctgtcagagcgaagattgagggctgaagctgttgttcttatttttttgtcccacagggtgttcccttgatgtagtactttcccccttttcctgtggatatggcttcctgtgagccaaagtgcaatgattgttgtctctcttctgggtctaacctcccagtgagtctacccggctccaggctggtactgggggttgtctgcacagactcctgtgatgtgaatcatctatgggtctctcagccatggataccagtgcctgttctggtggaggtggtggagggtacaatggactccgtgggggttcttagctttggtgatttaatgctctatttttgtgctggttggcctcctgccaggaggcgttgctttccagaaagaatcagctgtagtagtgtggagagggactggtggtgagcagggccctagaactcccaagactagatgccctttgtctttcgttaccaaagtaggtagggaaggacaatcagatggggacagggctaggtgtgtctgagctcaggctctccttgggtgggtcttgctgcggcagctgtggggaatgggggtgagattcccaggtcattggagttgtgtacctaggaggattatggctgcttctgctgagtcatgtaggctgtcagggaagtgggggaaagccagtggtcacaggcctcacccagctcccatacaaactgaagggctggtctcattcccaccatgccccccacaacagccctgagtctgtttctaggtggagggtgagtcgggcttgaaaacttgccggaggcttcctgcctcccagctgcaaaagaaaagggctttagttcttccccgatctgtgaagtctgcaattcggagtcataccctcccctgagttctggccaggaggcttctcgccccattcaagttgttacaaagttcagctagagaagtccttctccctgtggagttttaccgcctgctcctctggccaccatcctgatagatctctgtgatgccaagcaataataggctgcttggggatccagcaagctcccagggtccttctgctgcttcctctacccctgtattcactctgcttggctgtctaactcaactcagctccagataaagttgggaacttctctcacaaacagaccttcaggttctccagtgggggtgtgtgttcaggagaggggtttctccctttcccacttccagagttggagcactcacagtatttggggtgtctcccgggtcctgcaggaacagtccacttccttcagagggtctgtgggtcctctcaggattgctgacttgttcctgcggtcaatcttgagctaaaattcacaatgcaagcttccgcatgatgctctgtctggagctgcaattctgtcctgcctcccatctgccatgatgcctggtctcctctgaatgtcattttaattctctttatataaaatatcacaaaccagacctaaaatttctctcaagaccttttctccattctaatattttctttatggttggtggcactacaattattacagttttatccgtttcataaacttgcagttattttgtatttctccctattcttaactccttatatctctttagtaacaagtcttttatgttactaacctttagattcactggaatttcacatcacttttgttggttcttttctttcctctcagatattttcttttcactcaattttctagacttgtctctttctgccaatctatggaatgcaaaggtaaacaagactttcaaaatgtcctcaaaagactaacaggaaaaaacatgtgtgtatgagtaagtgtatgtgtgtgcctggagatctactgagtttactatcctgcgttaattaactagaaaatctgaacaaaaatatatgaacaattgtctttcaacttgaacaagaagcataggagagttgacctctcagagtagtgaaatccatgaggtgagccttatgattatttgaaggctatttccaggctgcagcacacggactgtaatatggtttggctatgtccccacccaaatctcattaaattcccacatgttgtgcaaggaacccagtgggaggtaactgaattatggaggcagatctttcccatgctgttcgcatgatagtgaataagtgtcatgagatctgatggttttataaggggcagtttccctgcgcaagcgttctctttgcctgctgccatccatgtaagacatgacttgctcctccttgccttccgccataattgtgaggcctccccaaccatgtagaactgtaagtcctttaaacctctttttctttgtaatttacccaatctcaggtatgtctttatcagcagtgtgtaaatggcctaatacagagtgataacctttacatagcaaggcaatcttactgggttgattagaaggatattagagttgggagaagtcaagatagctagaattttaggaatagagtactagagaaaaggaaactgcagagagagagagagagagagagagcactttgaagacctccagatgggtctctgaaagtctgccttattactgctttgtgcatgcataagaaaaaaactacttcaggccagagaaagaattattgtaaagcattagactgaaccattctcagagctcacacagaagctgaggataatatatgtttcaaatattcagaattagaagaccttgcaatcatgcagcatcaagtagagtccttggaagggcaaagtcttagtatgggggctaaatgagctctggaatgaaagatggaaataatctgctttaacaaagataagaagcacacctcaaaatgattcaactaaactcaaggactttgcataccagagcaaagttcaccattatttaaagaaatataacaaaatccagcacctagcaatgtaaagttcacaatatctgtcacccaattaaaagttaaaaagcaggaaaaaaaaaaaaccgaaaagtctgacctataacaaggaaaaaatcaatcgatataaacaaagaaattatggtgattatagtactattcagtaagaatattaaaacagctaatacaaaaatgatccaagtattcaagaagacagagaaaaatgtgaatatgaggataaatattaaagttttttaaagatatgaattgaatagataaatataatatttgaaatgaaaagaacactggatagaattaaaagcagatgaaacacagtagaataaaaattaagtgaacttgaaaacatagcaatagaaatggtctgaaacaaagcacaaagacaaaatgactgggaagaaatgaacaaagcattactgacctatggaacaatatcaagtagcctaaaatacatattagagtcccaaacagaggaaagagaatgaaggccaaagaaatacttgaagaaaaatggacagtattttcccaaattggatgaaaaatataaatctaaagagatcaatggctcaattaaacacaaacataaaaaccatgaataaaagcacatcatgacacagaactttcaaccaataatactatacacagctagtggttcttcagaaatgaagaagaaatacagatgttcacataaaaacaaaaacccctagaactgccttacaaaaaaatgctaaagggagttatttgaattgaaatgaaaggacactaagtaaaaacataaaaacatgaaagcataagactcactgataaaggtaaatatataatcaaatttagtatatttcaatatcataatggtgatgcaaaatcactactacaaaagctaaaaaacaaaattattaaaaagtatagtaaaacaatttgtgaatggatacatcctatggtttgaatgatggtgtccttcccaaaatttttgttgaaactttatccccaatgcaacagtattaagagatatgccctttggtgggtgctagagtcatgagggcttttcccctcacgaatgggattaatattgttgtaaaagggatcaagattgaaaagagagctctcttattcttccaccttcctccatgtgaggataccttgacaatgtgccatcttagaagcagagagtagccctcaccagacaccaatactagtgccttaatcttggatttcccagcctccagaactgtaagaaataaatttctgttgtttatacattactcagtctgtgctattttgtaacagcagcagaaaaagacaaagacaaggcataatatgaaaagatgtaaagtgtgatattaatagtgtactacgcagagaagagggaaaagtaaaaatgtacaggatttaagttaagttgttgtcggcttaaaatagagtgtaacaactatgaaatgttgtatgtaaacctcatgataaccacaaaggaaatacctctagtaaatacacaaaagacagagaaaaaaatcaaagtataccaatataaaaattatcaaaccacaaaggaagaaaaaaaacaagaaaggaataaactaccaaatagtcagaaaataattaacaaaatgacaacagtaagtccttacttattaataattacttcaaatgtaagttgatttaaaaaacaagacccaacagcatgctgtctacaaaagactcactgtagctttaagaatacacatagtctaagggatattagaccaatatccctgatgaacatcgatgcaaaaatcctcagtgaaatactggcaaaccgaatccagcagcacatcaaaaagcttatccactacaatcaagtgggcttcatcccttggatgcaaggctggttcaacatatgcaaatcaataaatgtaatccatcatataaacagaaccaaagacaaaaaccacatgattatctcaatagatgcagaaaaggccttcaacaaaattcaacagcccttcatgctaaaaactctcagtaaactaggtattgatgggatgtttctcaaaataataagagctatttatgacaaacccacagccaatatcatactgaatgggaaaaaactggcagcattccctttgaaaactgccacaagacagggatgccctctatcaccattcctattcaacatagtgttggaagttctgcccagggcaatcaggcaagaaaaagaaataaaggatattcgattaggaaaagaggaagtcaaattgtccctgtttgcagatgacatgattgtatattcagaaaaccccatccgtctcagcccaaaatctccttaagctgaaaagcaacttcagcaaaatctcaggatacaaaatcaatgtgcaaaaatcacaagcattcctatataccaataacagacaaacagagagccaaatcatgagtgaactccctgcttcaaagagaataaaatacctaggaatccaacttacaagggatgtgaaggacctcttcaagaactacaaaccactgctcaatgaaataaaagaggacactaaaaaatggaagaacattccatgctcatgcacaggaagaatcaatattgtgaaaatggccatactgcccaaggtaatttatagattcaatgccatccccatcaagctaccaatgactttctccacagaattggaaaaaactactttaaagttcatatggaaccaaaaaagagccggcatcgccaagacaatcctaagccaaaagaacaaagctggaggcatcacgctacctgatttcaaactatactacaaggttacagtaaccaaaacagcatggtactggtaccaaaacagagatatagatcaatggaacggtacagaggtctcagaaataatgccgcatatctacaactatctgatctttgacaaacccgacaaaaacaagcaatggggaaaggattctctgtttaataaatggtgctgggaaaactggctagccatatgtagaaagctgaaactggatcccttccttacagcttatacaaaaattaattcaagatggattaaagacttaaaagttagacctaaaaccataaaaatcctagaagaaaaacctaggcattaccattcaggacataggcatgggcaaagacttcatgactaaaacaccaaaagcaatggcaacaaaagccaaaattgacaaatgggatctaattaaactaaagagcttctgcacagcaaaagaaactaccatcagagtgtacaggcaacctacagaatgggagaaaatttttacaatctacctatctgacaaagggctaatatccagaatctacaaagaagttaaacaaatttacaagaaaaaatcaaacaaccccatcaaaaagtgggcaaaggatatgaacagacacttctcaaaagaagacatttatgcaggcaacagaaacatgaaaaaatgctcatcatcactggccatcagagaaatgcaaatcaaaaccatagtgagataccatctcacaccagttagaatggcgatcattaaaatgtcaggaaacaacaggtgctggagaagatgtggagaagtaggaacacttctacactgttggtgagactgtaaactagttcaaccattgtggaagatggtgtggcgattcctcaggtatctagaactagaaataccatttgacccagccatcccattactgggtatatgcccaaaggattataaatcatgctgctataaagatacatgcatatgtatgtttattgcggcactattcacaacagcaaagacttggaaccaacccacatgtccatcaatgatagactggattaagaaaatgtggcacatatacaccatggaatactatgcagtcataaaaaaggatgagttcatgtcctttgtagggatatggataaagctggaaaccatcattctgagcaaactatcacaaggacagaaaaccaaacactgcatgttctcactcataggtaggaactgaacactgagaatacttggacacaggaaggggaacatcacacaccgggcctgtcgtggggtagtagggggagggatagcattaggagatatacctaatgtaaatgacgagttaatggatgcagctcaccaacatggcacatgtatacatatgtaacaaacccacacgttgtgcacatgtacccttgaacttaaagtaaaatttaaaaaaagctagaaaaaaaaagaatacacatagtctcaaagtgaagggataaaaaaagatattccatgaaaatgagacagagataagagatggctacacttgtatctgacaaaacagactttcagtcaaaatctatgaaaaaataccaaaacatcactatataatgataaagtggtcaattcaccaagaggatataacaattgtaaatatatatccattcaacattggagcacctgaatatgtaaaatgaatattaaaggtcactacagtactccactttcagcaaatgatagattatccacacagaaaatcaataagcaatcagtggacatgaataacactacagatgaaatgaacctaatgaacttaaagaacattccatccaacaggagcagaaaacacattcttctcaagtgcccataaaatattctgcaggatcaaatgttaggatataaaaaagtcttaacaaatgtaagaagattgaaattatatcaagcatcttttctgaataacaggagaaattttgaaaaattcacaagtatgtgaaacttatataacacatcccccaaacaacaaatttttcagagaagaaatcagaaagggaaataaaaaataatcttgagacaaatacgaaaatacaatatactaaaccttgacagatgcagcaaaagcagttctaagagggactttttagtgataaatgcctacattaagaaaagaattgtggtacaactctacaacaaaatgctattcagcagttaaaagtgatttactactgacacatgctacaacatggattaacctcagtacgaccatggtgtgcaaaataaggcagacacaaaagcctgtatactgtataaattctcccaaatcaaattctttaaaaaatacatagtgacaaaaagtgggtctacaatttgaaggcacacagctttggggaagatagtgactgcaaaggagcacaagagaacttttgacatgatagaaatgtgatgtaaaatcattgtatatgattgtaagattttatgaagctatacacgtacagttaatgttattgtatgtggttgtacataatacaataaagttgaaattctgaaaattaaaacaagtcaggatggaaagaatgatacagtaatatctaacagttttttaaattatctcatctatgctggatatcatgccaggtattccaagtgtattattctattacatacccacaatagccctgcaagagagaagtaatactattttatttacaggtaaaaataagaatttatagaaattaaataattacactaagccatacattccataatctttagacccagaatttgcacccagatttgtttgctatcaaaggtcatgctattcatattttgctagtatatctctaagtataaattaagaataataatacagcatattgtattataaagtaaaacaagaaaagaaaaatatctagtcaaacaaagaaaccaaaaaaaatgtttaataaaatgaatgcataaaattatcagaaagctcacctcacatttaggcccttttatctaccacaattaagttcaaaagcaacttacttattagcaagatttataaaacaaaatctacacaaatgcatgaacttgtctttatatgtcttagtattttgcaaagtgtaatatagattcttggtaaacattgaagatcagtaatattacaataataaaaactaaggacatatatgagaaaaaaattctgccagcaaatgaagacattttcaaggtaagttatgaataaaactagcaaacacttcaatttctttttgaattaagtacttagacaggaaaacgaattttaaatgtaggtgactgcgaataaatgaaatctcttacataaacaactattagcaaaaagctaaagtccttggaatatctgaacttgcataactgaactattcctgtctgaatactcatcgggtggtgagaaaattgattaacatagttattcgaccatttatactaatttgataaggctccagaagggtataaaattaaaatgtggtagtcttaaaacagaatatcactaaaaataacgatgggggaattgacaagtttctttaagatccctctgccattctaatgtcctctccattccagtttcatagattacgggagacaaaaagagaatttgcaggatcatcagaaaatactaaccttgaattggaataaagagaacaacaaaatacagaagtagggctgaaagaccttaactgcggatatccataagaatccaagagactacttacaaaggcataccacaatgaggatttctctggacatgtccacatataaagaggcacttcctcaatatgtggaattgagtcccaagagcaacaaacacctgattacttcttaagattcttgattagcagattccacattagcttcccatgtgaactgtattggtacaataacatatgccaaaccaagctctaatatattccctctagggtcttttcaattttttgatttttttttatttctctctttctccctggggaaacaaattaggttatgagtgtgtttctgagctagatctttacaacaaagacatggttattaacttttaatcaaaaccccataattgccgggcgcggtggctcccagcactttgggaggccgaggcgggcggatcacgaggtcaggagatcgagaccatcctggctaacacggtgaaactcctactctactaaaaatacaaaaaaaaattagccgggcgtggtggcgggtgcctgtagtcccagctactctggaggctgaggcaggagaatggcgtgaacccgggaggcggagcttgcagtgagctgagaccgcgccactgcactccagcctgggcgacagagcgacactccatctcaaaaaaaaaaaaaaaaaacccataactgtgaatggcatcccagtagctataaggataatttaagttagtatattgatggaatataacacagtcgtgcattgcttaacaatgaggatacgttctgagaagtatgtcgttaaatgatttcattattgtgcaaatatcatagagtgtacatacacaaaactagatggtacaacctactacacacctaggatatatggtatagcctattgctcctcggtgacaaacctgtacagcatgtgactgtactgaataacagaggcaaatataacacagtagtatttgtgtgtccaaacatatctaaatacagaaaaggtacagtaaagatatggtataaaagataaaaactggtacacctgtataaagcacttaccaggataggagcttgcagaactggaagttgctctgggtaagtcagtgagtgagtggtgagtgaatgtgaagggctatgacatcaccgtacagtactgtagaatttataaacactgtacacttaggctactaaatttatttcaaaattaagtaattgtgctacagtgttatgatagctacaacataactaggcagtagggcagtagaaattccccagctccattataatcttaggggactactgtcctataggtggcccactgacattcaggactgtatttataatcaagatttttttaaaaagttaactacattcaaggaacacatattccctctcaaccaaaatccaacagaagtccctctttaaaaatctgaatctattgtatttaaggggaaaagtaagttctgctgcttgaagacaaaagacagtaattggaaccataattataaagcccagccagctttgcaccacaattagacccctgaatcccaagagatctagctgaagcactccaaatgcttatcaagatacaaatatgtttgatggatttatgtcctagtaaattctaaatctaactagatttacctaggaattagatctaaaaataataaaaaaataacattccttagagcattaagacagtgtttctttcctcatgagttttgatagtttggtcaagttggattcacactatgatataccaggtttacacctcaggaaaggagcagttggttattttccacagagcagtcacattaggcctcctgggaaaatgaaatattttactaatctttataacatagtacaagctgtattttaattttaaactattccttgatgacatttgggtaaaaagacaaaaataagataaagagcttcataaactctaagatactatataggtgaaaattgtagtcactgttattgtttttgacacgtttactggtcaaagaccatatctatgcaatctttttccctacctcactcctgagaacaaaacaggttccatgtagaattttaatacttacacactgcagtatgtttttattggattggctgtgtttaactatgttaactgctctataccctgaggcacaagcacctaatttattttaaaaattacttaagcataagtaataggtatgtagtcacaataataaaaatcaaataagtaaatttaataaattgacatatgctttaaattaaaatatatgggcatgttacttattaaaaaagtaacacaaatgataaatccttgaggcgatggataccccatttaccctgatgtgattattacacattgcctgcctatatcaaaatatctcatacactccataaatatgtacacctactatgtacccataaaatttaaaaattaaaaaaggaaaggattttatatttcatgtgattaatatttagattctattcttgagtcctgcatagtgtgactaagttcatctgttaatggccaactgttctattacagaagatatccctgttagtgactaattattgcactgaccatgtgtagtaattggtttagcatttcaaacgcttggaaaaaaaagcttgttttttgttatagcactctcacaggacgtagcatttccctcgttcagtctaactttcaggttatttcaaattacagctttatagaagtatatactatgtctggcgtcagagacggtcagccaatcattttgcagtaatagtttcttggcatgttttttggtcacaaaggatatttgtttcatgtgactttaaatgaaataaaacaatttcaaggtctagagtgcaggtttctttctataatacagcatgagacactggtctgattcatgctaaaggaagttggtagctgtacctaccagggaccataagaaatatgtgctgtaggacaaacttacctatatattagtgccatgtagtactgtacatctatatcaccatcacccagaaagaacaactggaaactctgagggtggaaaaggaaaaagggacagagaattgtgtcttaatatagaacaataacacagaaagtagtaagattatatagatagttgttttggtcaccttaggtcacttacaacgacctcatatacatgtctgtagctatgtcagaagaaaaataagaattgcactacagccacgaagaacaaaaaacataattttccctattcacaatgcttttgagtagtgctgtatccccaggcttccctgttttatttatttatttatttatttatttatttttgcaaggctgaataagtttttcctaacagcagcaggttttttcatgaaccactagatgctaaactgtgggcagcttcttataactacccaggtcatacagggctagctgtgtgctgggtcaacaagcaaggttatgttcagctcagtgagtagctagatggtagtgtcataaatcaggagttctggggctttctgctagagtcaatatgacctcttgcaactgaggtctattcccattcagatacagactaaactctgataagtcacagatccccaaaatatcatgagaactttacaaacagtctctcatttctaacctcattttctggtagagttttctttgaactcttttctcattactaaagtaaggacttttaaactggaaaatagtcaatactttggatcctggggtgtacttgggaggctgagaaaattcataatatgtattttaaaatttttctgaaccttttctaccccaagatcctttacttaaaagaaggtaatccctccaaaaataagctacctactcatagtatcctttcagcttattcaaatggtgtaattttgaaatattcaacaaataaatgatggctactatttttgagtatactatcacagttggctaggactgtgtcatcaacaaatcccagcctcatctcttcttctaattttccaagtagtacttttctttggaaattaagatcagagttaaaagaggtctagaaagcaacacagttcacccaacatttgtatatgagagcaccttaaagacattttttggtgtttggaaactctaacacttagaaaacattagtaagggagtggtggcataaattcattacaagcacactttactatgtttctactggatatagtttttgaaaaatataaatatagtttttttataaatacaaaactcactcttcacacagattagcaagtactatagctttgattcagcaagttttatatttcagtagagagaagccatcacaggtaaagtttcgtctgcctcacaacactaagaaatcttgcaagatgacacaaaagtaaaatagaaactctatcttaatgctttttggcttgaacgtgtatgcatctttctctataaagaatgtcatcttacttatgtgttgctccaaatgtgtctttgtaatttccttacacacatgacagaacttatcaccatctgttgaacctagaggacacatcaaaaactgaagaatatgtgaatacacttataaaagtacatcaaaatatacatgtatatggatattcattgcagtattattcataatggtaagccatctaaatatttatcaacagtggaatcattaaataaattatgatatttatactttgttatgctttggatctatgtctcaccaaatctcatgttgaattgtagtccccagtattagaggtggggcctggtgggaggtggctagatcatgagggtgaacttctcatgaatggtttaggactaccctcttggtgctgttcttgtgagatcagtttgtaaagtaaaatgataaacagctattaaatatatacatatatacaaatatatgtatatactgatatagaacaattctcaagataattttgataccttgtgcagtgtgaaaatcagtctgcaaaatgctatatttagttttgcaaaaagttaaaaaatattatatacacaaaattttctcaccatatgtttgtattgctttaaaaaataattctatctgaatagacttttctcaaaagaaaacatacaattggtcaacaaatatatgaaaaaaatgctcaacatcactagtcatcagggaaaatgcaaatcaaaaccacaatgagatattatctcatcccagttagaatgtctatatccaaaaagattaaaaaataacaaatgctgggaaggatgtagaggaggaaactcatatactgttggtgggaatgcgaattagcacaggcaacatagaaaagagtagaaagagtactcaaaaaattaaaaatagaactaccatatgatccagcaatcccattactggatatttatccaaaggcaaagaaaacaatgtatcaaagagatacctatacccccatgtttattgcagcattattcccaataaccagaatatggaatcaacctaagtgtctaacaatgggtgaatggataaagaaaatttggtatatgtacataatagaatactactcagccataaatagaatgaaatcctgtcattcttagcaacctgtatgagcccagaggacattatgttaagtgaaataagtaaggcacagaaagataaatagcacatgttttcactcatatgtagaagctaaaaaagttgatctcatagagtagaattacggttgctagaggcttggaaagagagaaggagggagaaaaggcagagattggttaatggatacaaaataagaaataaattctagctttggataacactgtagggtggcgaggtaaactataatttactgtattttttcaaaaccctagaagagaggattttgaatgatacatgctttaaaagtgataaaggtttgaggtaattgttattctaattaccctgatttgatcattacacattgtatacgtgtatcaaaatatcacactgtaccccataaatgtgtacagttatgaattacttattaatcatgtgtcaattaaaaataaataaatgacactatattaagatgagctatatggataattaaattataaaatgtttttctttgcgattttatacgttaaaaataacattaataaccgatattttaaaatacattaacagtcactgaggagtcccactaggccagaaatccagtgtaccagattatagggatttccttttaggaaacttgaatgtatctgcaagtcataaacagttgaatacatttcctggattttctgaacaagtcccagaaagactccttcagcagtctctaaaggctagctgttagtgggtagaaaagatggtgcagatctcatcctgactcagcacatgctaagagctaaactgtctgtcaaaaggaattctttataaaataaaatttaaaagctgagacttaaagtgtacactaatgacctggtaattgtcttaatgacttttcaatgaagtgtgaaattctctgttaacatgtcaacagagtgtgaaatattttacaagcatggctttattataaaactgtgtacttgctgtgtagtctactagtaatccttgttgcttatccagtaaatatttctggttatattctgagcacttagccaattaacatttatattggctggtaatcttttttccattttttcatttgactgtttgtactgtttgtctatttgttaaatctggggaccagagaagactctcctagttttctttgatgacaaatatctcacttgggtgactccaagagaaaaaaacagtttcaggtacagaaaaattaaaatgcttaaccaagttatccagtaatgatattgagataataaatcagacttcctgacctccattcttgcacacatatcatgacttcattctagatatcataggataaggcaaaattaataaataaaacaaaaaatgcattttatttttatattatgcaattaaaacatgaagaaaattgaataaatgatataaatattatttgctgccccattgtcaggattttgcatgatacttctttagtaaatgggattttagcagaagtgacaacatgcaagttgacagcagatcttttacatgcaatcatattgtttgattttctctcccctgccctccactatgagactagcatgtccaagataggagctatttttcagctggtgttctagaaagagaagacataaggagcatagattcaaacactcatagacttgcaaaagagaaatattttgtgctgtaagacactgaaatttgggggtgtggttaactccagaaaaagctaaaagacatacttgcttactattgttttagatggtcaaagtttatttagttttatgcctatgtttattattcccttataactgtttctttgatacttgtccttccttctgggatcactttccttcataaagagaagcccgtagaagttcctttagtgaaaaagttattagtaaacttcaaagtttgtttgttggaatatacctctattctgctataatgttttagagattcttttgcttaggtataaaattctaagtcaacagttacatattgtcttgactcttgactctttagatattatttcactgctttctggcttacagtgctgctatcgagaagtcatctgacaatcttattgtcctaatttttttttttttttgcctccctggcttctttattgttttccttagaatcctaaaattttagtatcaaatgtcaaattgtggatttgtttgcatttatccttcttggaatccattagccttttgagacattgaaactgaagattcacatttcttatcaattctaaaaaatggtcaattatttttccaatattgcctttccccaacttctctattatctttatctgcttctcaaattagatgtgtattgaatcttctcactctagcatttatgacccttaatctctctttcatatttccatcattttttctatctactgcattgtctcatgattttcatatctaatctgcagcttttttattgtttctgtgcctaattagtgatttaactagttcattgaatttctaatttcatatgtacatatatacatgggtatatttctggagtcctatctggttcttcaaatctgcatagtcatttttttaaagtcacctactcctttgttatacgtttaatacttccttttatttcttcaaaaataataagcagatgtattgtttattctatatatgttaacttcaatagatgcagtttttctaaatctgcatgatatgatttattttcatcaagttctttttaaattatttattttttatatttatagatttacggggaacaagtgcagttttgttacatggatacattgcatagtggtgaagtctgggcctttaatgtacccatcacttgaatagtgaatattgtacccaatagataaattttcaacccttacacccctccctcgttcccatgttttggagtctctaatgccccttattttactctgtattttcatgtatacccattgtctatcttccatgtataagtgagagcatgcacattttaacccaaattatatttccagaaatcagaagctccagagacaaatcttgctccactgcttcctttcctctctaaatttgtattttctcatttttttctagccttaactgatttagcttactttctgacccattcaaccatgtatttacaatgaattttatctgccttccataaattttagatgttctacaccaggagtcttccctgtgtatctgatatgccatagttagagaatcaaaagacttaacaataacattcaatattaaaaatttctatattcctgggttaaacctcacttactcaggatatgtttttaaatatattaatgtagctagattactaatattttactaaaaggtctgcatctgttttcataaactagattggtctcattttggcttttatctgtaggttataatagtttcataaatgagttgtaaaatgttccttctttttttttacatgctttaaaacaatgttcaaaagataagaaataaatattcattaaaactttggtaggcctcgagggttttctttggggagtttctgatgactcatggattcactcagttcctatttattcttgatttggtttcaaaatattaaatattctatacatttgtacattttgtgtatatttttaaataaactggcaaaaacttcacatagtattatcttcttattttaaacatctgtgatttatttatacctatgtttcttaattatttttatactggtcttcagtgacttctctttttttcttcatcaatatttcaaaatgtctactttattactattttcaaatatacacctttattttgttcattctcttttttatttgtattaatcacattataaattcttgttctttcttttatcactttagtcctttttctttgagtttattttcatattgtttttctaacttcttgaattgcatgattaattctctgtattaaaacttactttctgttgcatacacttaacattatccactcccttttgagtacaattttaatttccacaaagttagatgtgaagtatttttattgttttaaaattacatttttcttattccatatatgctatttcctttgacccatgaattatttagaagtgttttcttttcaaatgaataacagtaagttggtcatatttttatttttttatttcgaatgtaagtgcattatggtcagagaatatatttgttgtgcgttgagacttgatttatagcctaatatttggtcaatatttataaaagttccatgtgtgtttgaaaataatgtatatttcctaattgtgggatataggattatatgtatattcattaaataaaattctttaaaatgtggttaagatttggtcgattcaatgtttttaaaatacttgatcattcaattaagggaagaacattacaatatttcacgattgtaatggatttgtcaatttctccttgtagctttgtcataattttaaaaatatatgaagctatatgtttatttgcatttatatattccaaagttatggtatcagctacatacaaatccagaactattatgtctttgagcagaatgtgaccatttgtcattatgtaataatcttttttatctctaataattattccatatagtctattttattttatactaatatagttacatcaaatgtattttttagtgcatgcctgatacacctttcccatccatttgttttcaacctttccacatttttaaagtttaagtgtatcatttataaacagtatataactggatttttttttatctacctgatgatctgccttatatctgtataaatccatttatacatattcattaatgacatgttgatttatttttccaatctgattttgtaatttttatttttcacgctatcctttttattgttgttttcctcctttatgccttctattgaattgatcaagctttgttcaggcccttttttctcctctcttagtttacaaccatttaataaacttctgaattttttgtgattaaccttaaatttttaaccgtcatattttaccttaaatatttaaagctaatgcacacctttaagttcctccaaaataatagataccttttagaactatttgattctattaagtacccttctatctttcatccattctagtttttctctccttatggagctattaggtatgttataattttccaatctgtcttccatatctcttcaacttctttcatatttgtcatattttcatgtctctgtgatgcactgtaggtcattttcaattatccaccttctgagtaaatagttttctatttaggtttttttcattttgcttgtccattgaatctcatttttttaacattctatgtagtattttatttcaaatttgactattattttttcataatgttttcttctttccatgtggtttctatttttttaatttttttattaacctgcacttaatttatgttttttcatattgacctattatctcatgttctgtgcttatcctcctaatttgttgtgactgctgactttaactgaagatacattattgttttgtgcatattgtcatttttcatttccttgttttgagctcattttcagcagggataatttttctatagaaaattcatgggaaatgagtgttgcttcttcttccacacgtccttgggatatgtctgacctgagatttatctccatgtatttttttttttaattttggtgactctctaactttatggaaacagtaccttcactctttaatagtgtatgtagttcatctttatagtttcagtttctcaatgtttagtacatttttccgccaagagtctaaggtaaggcaaataattttgtcctctctcaggagcattgggaaaaacttttctagtttccctgtcacttagagtacaactcttcaaaactcagttttattcgggggtcttaggtccaagctctcacctcatggaggattaaggcttaatttctgtctatgcatgatataaaaacccaagcccctaatgttagcacttctaagtttgactaacaaccctcttgtatacttcctaagtcaatgtctttcctctgcctttgaatcttctaagacataaatacatttatgtctaacatttcctttttttttcatattcaggggcagaatatgacccagttgtatttccccctgttgtttctctgtgcctttcaggaagactcaacttaacctgcttcttaagttggtccattttcttttctgacatatgtagaactggtattttttattgaatttaagtgttctctttccttttgttttctatttgatttctgatacatatatttgttttaataacatattcatctaaatttcatttttcacatagtgaaagatatgaaatcaacaaaagttgggcctgtcaaatgtatctactcttcagacaaatcatgtccacctccaccttctacacttaaataatagtactcaagagatgttctcccatcagatcaatgtctaacccaggtctgaacttgaacgatcattatcctgtttcaatcccctttaacatgtctcatttttgatatgcatttcttttgagtcctaattcattaaatttctcaaacttcttctcttggaatacatgttataactaaatttttacctcaaataagtgtactgccttgaaactcccctaataattccttaatactatttttcacagatctttctacttttgtctcatcaaaaatgtccagattttctgtaatcacttggtatagctgcccttaactgtaaattgctttccccattactcttcccaccttccacccagattctttatctgcaagctttcaataatctcctggattctggccccctactggagaatcatatacctgattgttgtctgagaacattcatcttttcctctgctagcttctactgggatctagtcactctttctggtctggttaaaacttggatactttctacttaagaaatttgctatgcagagaagttagatatgaagcaatctttatttccctcttatatcgttctattctggccattgagaattcagttttcctttcacaaaaatagggtctgttatgctaagagctttatctaccttctaagtaaatcttttaattatttttatttttctattgcccttattctgttattaaaattgaagcatacttttcaaataactctaaatccttcttgattccctagacaactctaattcccatagacacaatcccaggaatgagctttattagtttccctcatatatttttatttttaatcatttcattaacttgtttctctacctcaaactatgaaggcatgttttctttacaattcatttgttggtttagtaataaaacctaccgcttttcttcaggtaaagtctcaagttgtgtctgtaatctaaagtcataatttaaatgtaagaaaataatatatctagactcgatttaagaccatttgatgggaagatggcaattgagttttagtgtgggcccaatatatgaattcaaggttaccactatcacactttccttcttaaccccacgtacagaaaacaatttggagaagtcagtgtggcactctagcctccatgagtttggtactaacaccttaaagttagaataaaacacactagtcttctgaaatgcacatgcatttagtatacttgcttgtaaagagctgagaaacaatgaaatagaagtcaataatctttgtctaaacagctgatatccagaaagactcttctttgaattcttgattcagctattctttcttactaaggcctctgcaatactcatgcatctgctgaagatcacatgaagccccatacatatgcttcagccaatgtttgtatacttcagagtcaaataggcatagactgaaaacctcccaccatcaccatttgaccaaaaccatctgtaatataccatatcagactaaacctccctggcctgcttcttggttgaggcttgtggctggcctcacattgctgccaacccctacattgcagaaatgctcgattttccttaaggtggaagagactcacttttcactcaaggcagctattttaataaaaagcataacttgcatctggataaagctgcctaaactgtggtgactcatggtattgaacatgcatttttgcttaacaaattattattggattattgtcttaaatttggtacatttattacattacagtttctgcttagcaggaacctaggcatggtttgaatgggtcatctgtctcagggtgtcccacaaaaatgcaatcaagatgttgcctgaagctgcggtctcgtctgaaagtttaactgaggaagcatccacttccatgttcactcctatggtcattggcatcattcagttctttgtcagctgctggaatcaaggcttcacttacttgctgactgttagatgaaagttgccctcaatttcttgccacgtggacctccccaacatggcagcttgcttcattaaaacatgcaagacaacagccaatagggaaaatgctagcaaaatgaaagtcacatgtttttgtaacctaatcaaggaaatgacatcctatcactttttgtatatctatttgttagaaacaattgctaggtgcagctcaaaatcatggaatgagggaatacacaagggtatgaatattagaaggtagggatcattaaaagggtggcccaataaaagccattacaaactgccaaagtaaaatgtccagtcaacacactgaagttcaaagccaaagttgtctaccctggtcataaatatgttattttggtcgacaattctgttgtcccaaaatttatcagggatctcagtctaacacaccaaaattggggtttaagagagctctagtttgtatttttctgtccacaatctgaacatgtgaagagaaatgattgtaagacagatagcactcaaaatgttacttttgttactattatagcttatattggaaaatgtagcttatatctgtcatcaagttgatttcctattattgaattccacaggtttctctacccagtcttggtgctgttagactagcatacatttctctcacaggagcaggcccctttagagtatttgaaggatcagagcagaaaacctgctctctgtagatatgttcacttctaagaaaataatagaggaaatgctagggatgtataggctctgtttatttaaacttaacaataaaattaagctaatcttcctctcctgaaaaggaataagagaggttgttttcttcactatgaagctttcttcattgtaatggaaactttaagaaataaagtttttccacttaacaacagtagataaaaggaagaattattttacaacttaggctaaaattttctgttaatctgtgccacacctttacattctgtgactaaagatagaaaataaaaaactgtcttaatcaaagaaaaacaaaagattttttaaaaaaaatcactgggacctagaacaatagattaaaagtcaagaaacatgtggtctattccaacaccatgcacaagttaataaactgccaaagtttcaggttcctcaatataagggtaagtatgaactcatttatagggatacaaatgatttacattagataagtgattctcagtgtagaagaggaggcattactttctaggtagggaagtgacttctttttcccataatatgataaattggatatcctgaacaatcttccttgtgaaaataaatagaaaaccagaataggcttgcagtcacttattttaaaaataatgcaagttaaatgcctttccacaataaaaacttcaacgtttgatgacttcactggcaagttctaccaaatgttaaagttccaaataattataatatcaaataagcttttccacaacagcaaaaagaaggaaaactccacaaccaatgttatgacctagatggacctggatatcaaagtaaagacagtttgaaaaagaaaaggcagaagcccattttactcatttatataatgggaaaatcttaaaatattagcaaaacaaaacaataatacaatttaaaaaatgatatgaccacgttagatttattctcagatcaaaagattgggtgaatattagaagccctattgatcaatatagtaagatgtaatatgtttcattacattataacatttatgaagaaaataatatgaatatatcaacatgtgaataaaattgaaaaacattgaacatctgttcacaaaaaaattagggtaggaagagaaggaaacatttttaactgatgaaaatatctacaataactaagcttagaacaaacttaagagtggaatattatactcttcataatcaggatcaaaacaataattcctagttttaatatttctattcagcattttactggaagtcctagccagtgcactaaacattttaagacaaattagaggaggggtggggcaacaatgcagaatagaaagctccgccaatcattccctctccaccccttggtaggtagattaacttcacatcactgaagtggtgggaaaaactcttaaattactggctaaacactcccccattttccagaagtggtggcatggtgcagagagcatttctgaatgctaggggcaagagaacacaccaattgtgaggcattgaactcagtgcagaccttgttatagcagaaagtaaaactggaccaaactcagctgacacccattccaaattgagtgcccgcaagtcttgacaccacgggctaaagtgcttcagggcctcatataaacttgaaaggcagtctacaccatgagggctacaacacctaagggagtgctagtcttgaaatggacccagagccagtggattttggggggtatgtgtactactgagacactatctgggatggctaagggagtgctgccatcactcttccccaaaccccaggatgcacaactcatgattccaaaagagacccctcctttctgcttgaggaaaagagatgaaagagtgcagagaactttgtctcatatcttggataccagctcagccacaacaggatagggcacccgtcagagtcatgagattccctctccaggcactagtccttggatgatatttctagatgcaccctaggccagaaaggaacccactgccttggaaggaagaacccagtcctggcataattcatcacctgctaattgaagcatccttgggccctgaataaccagcagtgataacccaggtgctatgttgagggccttgggtgagactctgagtcttgctggcttcaggtgagactcagcgcatttccagctatagtggctacagggtaagactcctttcacttgaaaaaaagttcaaggaaaagtaaagatgactttgccttgcactttaggtaccagctcagccacatgggggtagagtaccaaacaggcacttggggtccccagtttcgggacttggctcttagatggcatttctggacctgcccttggccagaagggagcccacttccctaaaagatgagcctcaggcctggcagcattcatcacaagctgaatgaagaatccttgggatttaaggggagattggcagtagtctggcagtactccctgtgggtgtaaggtggcgatggccatggggtaaggatcctctgcctttggaaaggggaaagaaaaataggaaggactgcatcttgttgtttgagtgtcaatcagccacaatacaatagaacacagggtagatttccaaggtttatgactttagtctctggcttctggacagtacatcttgaccatcctaaggcctggtggaacttgttgccctgaagggaaggacataggcctgactagctttgccacctgctaactgtagggtgccagaagtttgaacaaacatgggtagtagccagggagtgattacagcaggcctcaggtgagacccagtactgtgctggtttcaggtctgaccctgcacaatcttatgggtggtagtcacagagatgcctgtgtcatcacacctacaactccaggctactcagtacagggagagaaactttgattgtttggcagaaagtaacagaagagaacaaatatctctcctgtgtaatccagagaaatcttcaagaacttgttcaagattatcaaggtggtacatctaagaatgtggaagaatcacagcattactgggcttggggtccccactaaagcagaaacagcctaaatcacaaaatctaagtcctttcgaatatctggaaagtgttcccaagaagaatgggtgaaaacaagctcaaactgagaagacaacaataaatacctaactctttgatgcccagacacagatgaatgtctacaagtataaaaatgatccaggaaaatatttcctcaccaaatgaactaaacaaggcatgagggatcgactatgaagaaacagatatgttgcctttcagacagagaaagctattcaaaatagctatgttgaggaaactccaggaaatccaagataacacagagaaagaattcagaattctatcagataaatttaacaaagatattgaaataactacaaacaatcaagcaacaattctggactgaaaaaaatgcagttagcccacttgatcatggtggataagctttttgatgtgatgctggatttcgtttgccagtattttattgagaatttttgcatcaatgttcatcaaggatattggtctaaaattctcttctttggttgtgtttctgccaggctttggtatcaggatgatgctggcctcataaaatgagttagggaggattccctcctttttctattgactggaatagtttcagaaggaatggtaccagttgctccttgtacctctggtagaattcagctgtgaatccatctggtcctggactctttttggttggtaagctattgattattgccacaatttcagagcctgttattggtctattcagagattcaacttcctcctggtttagtcttgggagggtgtatgtgtcgatgaatttatccatttcttctagattttctagtttatttgcgtagaggtgtttgtagtattctctgatggtagtttgtatttctgtgggatcggtagtgatatcccctttatcattttttattgcgtctatttgattcttctctcttttctttattagtcttgctagcggtctatcaattttgttgatcctttcaaaaaaccagctcctggattcattaattttttgaagggttttttgtgactctatttccttcagttctgctctgattttagttatttcttgccttctgctagcttttgaatgtgtttgctcttgcttttctagttcttttaattgtgatgttagggtgtcaattttggatctttcctgctttctcttgtgggcatatagtgctgtaaatttccctctacacactgctttgaatgtgtcccagagattctggtatgttgtgtctttgttctcgttggtttcaaagaacatccttatttctgccttcatttcgttatgtacccagtagtccttcaggagcaggttgttcagtttccatgtagttgagcggtttttgcttcaaagagaataaaatacctaggaatctaacttacaagggacatgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccacattgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagcaataacaccacatatctacaactatctgatctttgacaaacatgagaaaaacaagcaatggggaaaggattccatatttaataaatggcgctgggaaaactggctagccatatgtagaaagctgaaactggatcccttccttacaccttatacaaaaattaattcaagatggattaaagacttcaacgttagacctaaaaccataaaaaccctagaagaaaacctaggcattaccattcaggacataggcatgggcaaggacttcatgtctaaaacaccaaaagcaatggcaacaaaagccaacattgacaaatgggatctaattaaactaaagagcttctgcacagcaaaagaaactaccatcagagtgaacaggcaacctacaaaatggaagaaaatttttgcaacctactcatctgacaaagggctaatatccagaatctgcaatgaactcaaacaaatttacaagaaaaaaacaaacaaccccatcaaaaagtgggcaaaggacatgaacagacacttctctaaagaagacatttatgcagccaaaaaacacatgaaaaaatgctcaccatcactggccatcagagaaatgcaagtcaaaactgcaatgagataccatctcacacaagttagaatggcaatcattaaaacgtcaggaaacaacaggtgctggagaggatgtggagaaataggaacacttttacactgttggtgggactggaaactagttcaaccattgtggaagtcagtgtggcgattcctcagggatctagaactagaaataccatttgacccagccatcccattactgggtatatatccaaaggactctaaatcatgctgctataaagacacatgcacatgtatgtttattgcggcactattcacaatagcaaagacttggaaccaacccaaatgtccaacaatgatagactggattaagaaaatgtggcacatatacaccatggaataccatgcagccataaagaatgatgagttcatgtcctttgtagggacatgcatgaaattggaaatcattattctcagtaaactatcgcaagaggaaaaaaccaaacaccacatattctcactcataggtgggaattgaacaatgagaacacatggacacaggaaggggaacatcacactctggggactgttgtggggtagggggagaggggagggatagcattagtagatatacctaatgctaaatgatgagttaatgggtgcagcacactggcatggcacatgtatacatatgtaactaacctgcacattgtgcacatgtactctaaaacttaaagtataataataataaaagaaaaaaaaataaaattcaattctatgtcacctaaaaaaaaaagaaaaaaatgcagttagcatactgaagaataaattcagaatctttaatagcagaaccaatcaaccagaagaaagaattagtaagcttgaagacaggcaaattgaacatacacagtcagaggagacaaaagaaaataaggaaagacaataaagcacacctacaggatctaaaaaaaaaatagcctcaaaatggcaaatcaaatagttactagctttaaaatggaagtaaagggagacataggtgtagagagtttactcaaggggataacagagaacatcccaaacctagagaaagatattaatacccaagtatatgaaggttatagaacaccaaacagatttaacccaaagaagactactccaaggcacttaataatcagactcacaatggtcaaggataaagagggatcctaaaagcaacaaaagaaaataaacaaataacatataatggagctccaatgtatctggcagcaaacatttcagtgtaaaccttacagcccaggacagagtggcatgacacatttaaagtgctgaagtgatatggtttggcagtgtcctcacctaaatctcattttgaattatagttcccataatccccacatgtcatgggagggacccagtgggaggtaatttaatcatgggggaggttaccctcatgctgttcccatgacagtgactgagttctcatgaggtctgatggttttataaggggctatttttcccttttgcttgccatttttccttgctgccaccatgtgaagaaggatgtgtttgcttcccgttccaccatgattctaagtttcctgaggtctccccagccatgctgaaatgtgagtcaattaaacctcttttctttataaattacccactctgtggtatgtctttattagcagtataagaatgaactaatacagtacattgatgccaggaatgagatgctgctataaggatgctccaaaatgtggaagtgactttggaactgggaaacaggcagagattggaacagtttacaggacacacaaaacagacaggaaaatgtgggaaagtttggaagttcctagagacttgtcccagcagtaacccacggaacttccctaacatctgccatacttctcctcacataacaaaaactgaatggctttgaccaaaatgatgatagtgatatggacaatgaagtccatcgtgaggtggcctcagacggagatgaggaatttgttggaaactggagtaaagtcacttttgctatgcagagactggcagcattttgcccctgccctacagatctgtggaactttgaacttgagagagatgatttagggtatcaggcagaagagatttcttagtgacaaagcgttcaagaggaaacagagcataacagtttggaaaatttgcagcctaatgatgcaatagaaaataaaaatccattttctggggagaaattcaaagcagctgcagaaatttgtataagtaactaggagccaaatgttaatcaccaagacaatggggaaaatgtctccaggacatgtcagagatcttcatggcagcccctcccatcagagttctggaggcctaggagagaaaaatagttccctgggccaaacccagggcccccctgctctgtgcagccttgagacatggtgccctgtgtcccagctgctgcagctccagccatggctaaaaggagccaacatacagctcgggccattttttcagagtgtacaagtcccaagacttggcagcttccacatggtgttgagcctgcaggtgcacagaagtcaaaaattgaggtttggaaacctctgcttagatttcagaggatgtatggaaatgactggatgtccaggcagaagtttgctaaaggggcagagctctcatggagagtctctgctagggcagtgcagaaaggaaatgtggggtcagagcccccacacagagttaacactggggcattgactagtggagctgtgacaagaggcccaccgtcctccaggccccagaatggtaaatccaccaacagcttgtaccatgtgcctagaaaaaccacagacactcaaagccagcccatgaaagcagccaggaggggagctgtaccctgcaatgccacaggggtggagctgtccaaggctgtgggagcccacctcttgcatcagtgtgacccagatgtgagacatgaagtcaaagaagaccatttaaaaattttaggacttaatgactgctctattgaatttccaatttgcatggggtgagctggccctttgttttagccaatttctctgatttggaatgtgtgtatttacccaacgcatgtacccacactgtatctaggaagtgactaacttgcttttgattttacaggctcataggtggaagggacttgccgtgtctcagatgagactttggacttgaactttcaagttaatgctggaataagttaagactttgggggactgttggaagggcatgattgtgttttgaaatgtgaggacatgagatttggaaggtaccaggggcggaatgatatagtttgactgtgtccccacccaaatcacatcttgaattgtagtttccataatccccacgtgttgtgggagggacctagtgaggggtaatttaatcactagggtggtttccctcacactgttctcatgatagtaagtgagttctcacaagatctgatggttttataaggggcttttcccccttttgctagccatttctccttgcagccaccatgtgaagaaggacatgcttgtttccccttccaccatgattgtaagtttcctgatgcctccccagccatgctgaactgtgagacaattaaacctctttcctttataaattacccagtctcaggtatgtctttattagcagaatgagaacagactaacacatgaagaaaatgaacttttaccctagaatagtataatagtatatctactaaaaatatccttcacacataaaggagaaataaagacttttccagacaaacaaaagctgagggatttcactaatattaggcccatcctacaagaaatgctacagggagtacttcaactaaaaaaaagtacattaatgagcaataaataaatgatcacctgaaggtacaaaacttactggtaatagtaagtacacagaaaaacacagactattataacactgtaactgcagtatgtaaactacttttatcctaagaagaaagaattaacaataagccaataaaaaataataactacaataacttttcaagacacaacagtacactaagatataaatagaaacaatgcaaagttaaaaagtggggggacaaatttaaggcatagagtattagttttctttttgtgtgtctgtgtgtttgtttatgcaaacagtgttaagttgttatcagcttaaaataattggttataaaatagcatttgcaagacacataaaaataaaaagcaatagactaaatcataaaaccagagaaaaacaccttcactaaaggaagacaggaagggaagaaagaaggaagagaagaccacaaaatgagtagaaagaaaatggcaggagtgagttcttatttgtccataataacatcgaatgccaatggactaaattctcctatcaaaagacagactggctgaatggaagaaacaaacaagacccatttacctgttgcctacaagaaacacacttcaactataaagacacacatagactgaaaataaagggatgaaaatagatatcccatgccaatggaaaccaaaaaagaacaggaatagctatgtctaatctatgtcagacaaaatagactttaagacaaaaactataaaaagagacaaagaaggtcactatatatgataaaggggtcaattcagcaagaagatacagcaattttaaatatatgtacacccaacactggagcacagatatataaagcaaatattacagccaaagaaagtgatagatcctaatacaataataactggagatttcaaaaccctactttcagcatagaacagctcttctggacagaaaatcaacaaagaaatacaggccttactctgccctgtagaccaaatggatctaatagatatttacagaagattttatccaatggctgcagaatacacattcttgtcctcaacacatgaatcattctgaaggatacacccatatgttatgtctcaaaacaagtcttacgacactcaaaaaaaaaatgaaatcatatatagcatctcctacgaccaaaatggagtaaaactagaaatcaataataagatgaattttggaaattatacaaatacatgcaaaataaacattatgctcctaaatgaccagcaggtcaatgaggaatttaaggaattaattgagaaatttcttgaaacaaatgatagtggaaatatagcataccaaaacctatgtgatatagcaaaagtagtactaagagggaagtttacagctataagtacctacatcaaaaaagagaaaaacttcaaataagcaacctaataatgcatcttaaaggactagaaaagcaaaagcaaaccaaacccagaattagtagaaaaaataataaagatcaaaaaaatgaaaatgaaatgaaaaaagtacaaaatatcaacgaaacaaaagctgactttttgaaaagttaaacaaaatgaacaaacatttatctagactaagaaaaaagagagataatccaaatgaataaaaccagagatgaaaaaggagccattacaactgatactgcagaaattcaaagaattgttactggctactatgagcaactatatgccaataaattggaaaatctaggagaaatggacaaattcttagagacatatgacctgcaaagattaaaatgggaagacattcaaaacccgagcagagtaataacacataacaacatcaaagtcaaaataaaaattttcccagtaaagaaaaattaaagatcggatgacttcattgctgaattctaccaaacatttaaagaagaactaatatcaatactcaaagtattctgaaatacataggagaaaatacttccaaactcattctatgaggccagtattaacctaataccaaaacatatatttaaaaaaacagggaaatatccctaatgaatattgatgttaaaatgctgaacaaaatattagcaaaccatagtcatcaatacattagaaagatcattctattaatgtgaaaaagcacttgataaaattcaacataccttcatgattaaaaaccctacaaaaatggggctagaagaaacatacctcaacataataacagccatatatgacacaacgagtatcatactgaacgggaaaaaactgaaatcctttcctctaagatctgaaaaatgacaaggatgcccactttcacctctgttattcaacatagtattggaaagcctagctagaccaatcaaacaagaaaaaaataaaggccatccaaattggaatttaagagtcagattatctttgtttacagatgatatgatcttatatttggaaaaacctaaacattcaacaaaataagtattagaactgataaacaaattcagtaaagttataagatacaaagtcaacatacaaaaatcagtagcattctatatgccaacaggaaacaatttgaaaaagaaatcaaacaagttatcccatttacaatagccacaaataaagttaaatacctaggaattaacttagccaaaaaagtgaaagatcactataataaaaactataaaacgctgctgaaagaaattgaaaaggacacaaaaaaattaaaagatattgcatgttcacaaattagaagaatcaatattgttaaaatgtccatactacccaaagcgatctaaagagccaatgcaatttctatcaaaataacaattacattctttatagaaatagaaaaacctatcctgtaatttatatggaatcataaaagaccaagaatagccaaagttatgctaaacaaaaaggaaactggaaaaattgcattagttgacttcaaattatactacaaagctatagtaactaaaacagcatgacactggcataaaatcagacacacagaccactggaacagaatagagaacctagaaacaaatccaaacacctagagtgaactcatttttgaaaaaggtgccaaggccataaacatatacacctaatatgtatccacaaaaattaaaaattaaaaaatgaaataacaaacatacacactgggaaatgacagtctctttaataaatggttggtgctgggaaaactgtatatccatatgcagaagaaagaaactagatctctaccccttgccatatacacaaatcaaattaaaatggattaaatgtttaaatctaagaccccaaactataaaactactacaagaaaacattggagaaattctccaggactttggagtgagcaaagatttattgagtaatactccataagcacaggaaaccaaagcaaacatggacaaatgggatcaaaccaagtaaaacagcttctccacagcagaagaaacaaatcaacaaaatgaagagacaaccaacagaatgggaaaatatatttgcaatcttcccacctgacaagggattaataaccagaatatataaggagctcaaacaactctgtaggaaaaaatctaataatctgataaaaaaaagggcagaagatttgaatagacattgctcaaaagaagacatacaaatggcaaatagacatatgaaaaggtgctcaacatcactgatcatcagagaaatgcaaaccaaaactacaatgagatatcatctcacctcagttaacatggcttatatccaaatgagaggcaataaaaaatgctggtaatgatgtggagaaaaggtaacccttgtagactgttggtaggaatgtaaattagcacgactactatgaagaactttagaggtttctcaagaaactaaaaatagagctatgacacaatccagcaattccacttctgggtatatacccaccaaagaagaaattagtatatcgaagagatatctgcactcccatgtttgttgcagcagtgttcaccatagctaagatttggaaactgtttgtccatcaacagatgaatggaaaaagaaaatgtggtacttttacacagtggagtactatttagccatcaaaaagaatgagattcagtcatttgtaacagcattaatggaactgagggttattatgttaagtgaaataagccaggcacagaaagaaaaacataacatgtgcccacttatttgtgagatctaaaaatcaaaacaattctatccctggatatgagagtataatggttatcagattctgcaaagggtaatggggtttggggggcagatttaggtgattaatgtgtaccttaaaaatagtttaaatgaataaataaggcctagtatttgatagcacaacagagtgattatagtcaatgataatttaattgtacatttaaaaataactacatgagtagaattacgttgtttgtaacacaaaggataaatgcttgaggggatggatactccattttccatgacatgattattatacattgcacgtgtgtattaaaacatcttatgtaccccagaaatacataaaccttttatgtactcccccaaaatttttaaatttcaaaaagttacattattttaaaaatataaaagttacattattattattttaaagttacattaaaagtgtacagattggaaagcaagaaacaaaactcttattatttgtttacatgagaaacagaagaatatacaaactatcacaattagtgaaataattatcctgtattttacatgtaaatcaatatgtacaattatattttatataccatcaacagttggaaaatgtcatttctaaagctataattgcaataataaaataacaaaaataaaaaccacagcaataataatgtacctagaaataaacataataaattttaaatttaagtaaaatattaatatttgttgaaatttatttctaacatattaataaattaaaatgcataccaaattcatatacagaaatacttgatattataaagatgtaatttctcccaaaattgatctatggattcaatatgattcactcagaaaacttgagttattctaaaatgtatatagaagaatataggatacacaatagccaaatcaattttaataaagaaaatataagttgacaatgccctatcagatattattataaatctacaataatttagatggttaagtgacaatccagtatataattagaaagagtacactgtcccaaaacatatgcatgcatatacataagctttagaagacagcattagagattagtggaaaaagcatttttcaagattgagtcagcacccaattacatgaagtcaatctggtgggtcataaaaaaactaaaaaatatgcaaaaggttaccaatagaggaaactaaataaagtgtatttggaatctctctgtatttttttttaaactgtatttgaatctacaattatctcaccaaaaaaagaattaaaactagaatataaaacaatgtagtttatcacacataagtataagcgatatttaatttaagaataaatttgagcctgtatatgtataaatgaggatcagtgctggattacaatgagaaatgcattacttactataatatgagccatggacaaaaacttggaaatggctagacatgtaataagttttctgagacaagtgttaattaatattgcaaaaataataaaaaatagatttttacttcacatcatacacaaaattaattccagatacattaagaacttaaatatagaggcaaaactatttaaattttagaagaaaatataggagaaattttaaacagaagcaaaaaagctacaagctataaaaaatttaattcaattaaaatttaaactttacttctcaaaagatatcaaaaaggaagggataagactggacaaaaataatctatttataaattatatgataaataataattacaatccaacatctctctctctctctctcctgaaaatcaataaagataagcaactaaacagaaaattgcaacaaaatatataaacagatttttttaaagaataaacactaacaacatggatgagtcttataggataaagttttttttttaatttccaactttcatttaaagttcaggggtatatgagcaggatgggcaggtttgttagataggtaaacgtgcatcatggtgatttcctgcacagatcatcccatcgcccaggtattaatcccagcatccactagctattcctccagactctctccctcctcccaccccctgccctccaacaagcctcaacgtgtgttgttccaccccatgtgtccatgtgctctcatcattttgctcccacttataagtgagaacatgcggtatttgcttcactgttcctgtgttagtttgctgtggataatggcctccaactccatccatgtccctgccaagaacaagatctcattcccttttatggttacttagcattccatgatgtatatgtaccacattttctttatccattttatcagtgatgggcattttggttgattccatgtctttgctattgggaataatgttgcaatgaatatacacatgcatgtgtctttataatagaacaatttatattctcttgggtatatattcagtaatgggattgctgggtcaaatggtatttttgcctctacgtctttaaggaatcaccacactgtcttccacaatggttgaactaatttaacactcccagcaacagtgtaaaactaaataatatactgtttaggaatacatgaaagtgtgacattttacatagagaatcaaggaaactataaacacaaaattcaaaacagtgatttctttggatttgaaagagggaaatgcaattcagtaggaagagataggaggcttcaattgtttttataatttcctttttctgagtgaacagtttttactttaccattattctttaaactgtacatatatggataacacggtatgtacatgttatatatttattaaaatattacaaatatatataatgtatgagataaatgcatagattagaaagctcccccaatttgtccccacataattagtcattaggtgaaataaaaattttagttttaatgaatggtggatgaaacctcacaaaatgcatataaaaggtaaagtactgtgctgctataactagggagctttttaatagtcttaaacacaagtaaaatattgttcatgaccctgggaaatgtgggagatgttttaggtcagactcatgctggaattgctttctccatcaaaaatcagtaggatagaactcttcccatatctacaaggcagctgagctatacataaggcagaaaaaaagatatgtagcattaaaaatagtgaacacatcagacagccataaaatcacaccaaagaagcagaaaaactgttctggtattaaggaggtacatgctacctatgaatgcttaatatccccttgaggaaaaaaatagaatagaaataccatttttattccttagaaatataatagaaattctatttctaccttttagaaatataatagaaattctatttctaccttttagaaatagaatgaataaacatccaacatttttaagagaagagtctgtgtaaataagaaaagagaggcagaattatctgtgctttatattaatactttgttataattaagaggctagactaataaatctggcaaggaactcaaaaggaaaaggactgaagtatattcaaggattacaaattcaggtctaaaattgatccatgacataaacttttcttggcctcacatgtctagaaggtgctccaatggctaatgaagagaaataattttgtacaaaaaataacattatgtactatttgtagatttccacatatatgtaatgatgtatgcatgtgaatattcattttaacttgaattcagtaaattaaataattctctaactttatattgtggatttcgtgatttttaatttttttttcacttcttaaaaaatatagtgactttatttccactattttatagtcctcagtattgcagcttataagaatcctcatctatttgtctattaataatagacaaacaaagagccaaatcatgggtgaactcccattcacaattgctaccaaaagaataaaatatctaggaataccacttacaagggatgtgaaggacctcttcacaaagaactacacactactactcaaggaaataagagaggacacaagcaaatgaaaaaacattccatgctcatggataggaagaatcgatatcatgaaaatggacaaactgtccaaattaatttatagattcaatggtataccaatcaagccaccattgactttctcacagaattagaaaaaactactttaaatttcatatggaaccaaaaaagagcccgtatagccaagacaatcttaagcaaaaagaacaaagctggaggcatcacactacgtgatttcaaaccatactacaaggctacagtaaccaaaacagcatggtactggtaccaaaacagatatatagaccaatggaacagaacagaggcctcagaaataatgccacacatctgcaaccatctggtctttgaaaaatctgacaaaaacaagcaacgggaaaaggattttctatttaataaatgatgttgggaaaactggtgagccatatgcagaaaactgaaatgggaccccttccttacaccttatacaaaaattaattaactcaagatggattaaagacttaaatgtaagacctaacaccacaaaaaccctagaagaaaacctaggcaataccattcaggacataggcatggggaaagacttcatgactaaaacacccaaagcaatggcaacaagagacaagattgacaaatgggatctaattaaactaaagagcttttgcacagcaaaagaaactatcatcagagtgaataggaaaattacagaatgggagaaaatttttgcaatctatccatctgaaaaagggctaatatccggaatctacaaagaacttatgaaaatttacaagaaaaaaacaaccccatcaaaaagtgggtgaaggatatgaacagacacttctcaaaaaaagacatttatgcagccaataaacatacagaaaaaacctcatcatcactggtcattagagaaatgtaaatcaaaaccacaatgagatgccatttcatgccaattagaatgatgatcattaaaaagtcaggaaacaacagatgctggaggggatgtggagaaataggaatgcttttacactattggtgggagtgtaaattagttcaaccattgtggaagacagtgtggcgattcctcaacgatctagagccagaaatacgatttgacccagcaatgccattactggtcatatacccaaaggattataaatcattctactataaagacacatgctcaggtatgtttattgcaacactgtgcacaatagcaaagacttggaaccaacccaaatgcccaacaattataggctggataaagaaaatgtggcacatatacaccatggaatactatgcagccataaaaaaggatgagttcctgtcctttgcagggacatggatgaagctggaaaccattattctcagcaaactaacacagaaacagaaaatcaaacaccacatgttctcacttataagtgggaattgaacaaagagaacatatagaaacagggaagggaacatcacacactggggcctgtcagggggtggggggctaggggaggggtagcattaggagaaatacctaatgtagattatgggttgatgggtgcagcaaaccaccatggcacgtttatacctatgtaacaaacctgcacattctacacatgtatcccataacttaaagtataataataaaaaataaataaatttttaaaaaagaattctcatctataaacacaaaaatatttcaagaaagtatgttacaaaatagtacatataagcaataatttgacagaatcttattaactctagtaattcatacccccaaaaatggattttaaaattcaaaaataacattttgccttatttaacatatgttacaacttatcatttaaaatattattatttatttaaatatttcatcaatgatactgtgtagataaaatattacacaaaatatactgtagaaaatgttttggtctttgatctgaacaataaataaaaacataggcacttctatgcagagacagggaagcaatcactagtcagaacaataaacttgtataagcaacatatgaaaatatggcaatgataaatcctggcattttaaactgacaaacacttatgtgaaagtctgcagcttcaatattttcactcaagttcaaaagttacatgttttcctggcccatactgaaacttcacaaacacaatatggttgtcaggggcatttcaatcttcagttggctattgcagaatcatactcattattttcaaatactaaaattaaataacaattatgataccacctagtaaatcaaatacaagaaaaaataaactctctttctcattgttaccatgagaccacaacaatataaattagtgattctcatttagtaaaattaactaacacaagaaaataacactggagtggcagaaaatttcaagagaagtcaatttttctagacaatttttaaaatttagccaaatctcagaagaataaatataactcaatttcacataaaccaccaaatcacaaataacaaagtaattataaccaataggtttataaacacctgaattacagataaatcaatctttattttgggtagtaggaggtattattgggttttaggtagtattatgtaggagggcaaaccaaaaataacaaaatggtcaaattccagaaacatgatttcatatgaaaagaggggataaattaatgaataatgaccaccagctggtaggaaagatcagaatcaatcatcctaccatatcatccataaaaaaaaatatatcatttattttccctcttcacataaatatgaaattgaagggtgtagaggttctcaaatggatactactcataaaatcaattttaatgatttaacatagaaattatggtaggtgggggagaggccaagatggccaagaggcaacagctgtggtagaaggctcctaccaagaagaaagaaaacggggaataaattttgcactggcaactgaggtatccaggttctctcattgggacagactagtcagttggcatgaccacagagagcaaggaaaagcagggtgaagcaatggcccaactgggggtcacacggagcaaagggagctcccactcccagccaaaaaggtagtgagtgattgtgttaactcaccctcgaaatcatgctttatccatcaatctgtgcagcccacagatcaggagataacccttgtgagcccatgccaccagggccttcagtcccaagcacagagctgtgcagattctctgcagcagccactccactggaaactgcctacgactaccaagtttctggaggaaagggtggccatcatcattgcagatgcctgctatctaacacaactgagctcctggtgggaggggtggcagccatcaccgcagctccagtctgctgtttttcctctgccagtgctggggagactgtgtggtttggaaccaggaggaattccccacagcgcagcacagcagctatggcagattgtggacagactgcctctttaggctggaccttgactcatccctcctcactgggtggggccttctttgggaatctcagcaactctagccaggggtttacagagggaactctaatcttgggacagagcccctggggggaggggtggtcatggtctccacagatcagtggatttagtctttacccctgtttgcactgaagaatccaggcagtccagatgagtgggattcctcccagtgcagtgcactccctcagcaaaggggcagccagagtacttcattaagcgggtccctgatcctgtgcctcctgactgtgtcagactcccaacaggggttgccagataccttacacaggagcattgttgcaggcatcaggttgatgcccctctgggacggagctcccagaggaaggaacaggcagccatctttgttgttctgcagcctctactagtgacccctccaggtgtggaagggacccaggcaaatagagtctggattggacccccagaaaaccacagcagcccaacggaaaaggggcctgactattaaaagaaagacaaatgaacagaaagcaacaacagcaacagcatcaaaaaagaagtccccacaaaaactccatccagagttcagcagcctcaaagactgaagctacataaattcatgaagattagaaagaaccaatgaaaaaatgctgaaagctcaaaaagccagagtgtctcttctcctgcaaatgattgcaacacctctccagcaaggctacagaactgggctgaggctgagatagatgaattgacagagcaggcttcagaaggtgggtaataacaaattttgctgagctaaaaaagcatgttctaacccaatgcaaagaagctaaaaaccatgataaaacattacaggagctgttacccagaataactagtttagagaggaaaataaataacatactgaagatgaaaaatacaacatgagaacttcacaatgcaaccacaagtatgaaaaactgaatagacccagcagaagaaagaattttagagccaggaaactatcttgctgaaggaagacaggcagcaagattagaagataaagaatgaaaaggaataaacaaaaccttcaagaacgatgggattatttaaaaaaaaaaaacctatgactgattgggggtacctgaaagagacagggaaaacagaaccaagctggaaacatattttaggatatcatccaggagaacttcctcaacctagcaagacaggccaacattcaaatttttcaggaaatccagagaatcccagtaagacacttcataaaaagatcaaccccaaggcacttaatcatcagattctccaaggttgaaatgaagaaaaacatgttaagggcaccagaaagaaaggccaggttatgtacaaaaggaagcccatcagactgacagaagacctttcagcagaaaccctacaagccagaagagtttgggggccaatattcaacattcttaaagaaaagaattttcatcccagaatttcatatttggccaaactaagcttcataagggaaggagaaataagatccttttcagacaagcaaatggtgagggaattcatcactaccaggactgtcttgctagagctcctcaaggaaacactaaatatggaaaggaaaaaccattactagccacttcagaaacaaaccaaagtataaagaccaatgacactctgaagtaatgacatcaagtctgaaaaaaaaaaaaacacagctagcattatgatgacaggatcaaattcacacataacaatagttacctgaaatgtaaatttgctaaacatgccaattaaaagacacagaatgacaagttggataaagagtcaaaacccatcagtgtactgtattcaagagacccatctcacatggaaaaaaacacataggctcaaaataaaggaatggaggaaaacttatcaagcaaatgaaaagcagaaaaatgcaggggttgcaatcctagtttctgacaaaacagactttaaaccaacaaagatcaaaacagacaaagaagagcattacaagatggtaaagggttcaattcaacaagaagacctaaccatcctaaatatatatgcacctaatatgggagcaccaagattcataaaataagttcttagagacctaccaagagacttaggctcccacacaataatagtgggagactttaacaccccactgtcaatattagacagatcatcgagacagaaaatttacaaggatattcaggacttagactcagctctggatcaagtggacctgatagatttctacagaattctccattgaaaaacaacagaacatacattattctcagtgccacatggcatttattctaaaatcaatcacataattggaagtaaacactcctcagcaaaagcaaatgaactgaaatcaaaacagtttctcagaccacagtacaataaaattagaactcaagattaagaaactcactcaaaaacacaaaactacatggaaactgaaaaacccactcctgaatgactgctgggagataatgaaattaaggcagaaatcaagaagttctttggaaccaatgagagcaaagagacaacatgacagaatctctgacactcacctaaggcagtgttaagagggaaatttatagcactaaatgcccacatcaaaaagctagaaagatctcaaattgacacctaatatcacaacaaaaagaactagagagccaagagcaaacaactcccaaagctagcagaagaatagaaatcaccaagatcagaccagaactgaaggaggcagagacacaaaaaacccttcaaaaaatcaatgaactcaggagctaggttttagaaaaaaataaaatagatggaccattagctaaactaaaagagagaagaatcaaatagaaacaataaaaaatgataaagggtatatcatcactgattccacagaaatacaaacaaccatcagagaatactatgaacaactctatgcaaataaactaaaaaatctagaagaaatggataaattcctggacacatacaccctccctagattgaacaaggaagaagttgaatccctgaatagaccaataacaagttctaaaatttaggcagtaataaatagcctaccaaccaaaaaaagcccagaaccagatggatttacagctgaattctaccagaggtacaaagaagagctggtaccatttcttccaaaattattccaaacaaatgaaaagggacagactcctccctaactcattttatgaggccagcatcatcctgataccaaaacctgtcagagatacaacaaaaaagaaaacttcaggccaatgtccccgataaaatcaatgaaataatccttaataaaataccagcagaacaaatccagcagcacatcaaaaagcttacccaacactattgagtcaacttcatcccaaggatacaaggctggttcaacatatggaaatcaaccaacataattcattatataaacagaaccaaagacaaaaaccacatgactatctcaagagatgcagcaaaagccttcaataaaatttaacatcccttcttgttaaaaactctcaataaactaggtattggtggaatatacctcaaaataagagcaatttatgacaaactcacagccaatatcatactgaatgggcaaaagctggaagcattccccttgaaaaccagcactagacaagaatgtcctctctcaccactcctattcaacatagtattggaaattctcagagtaatcaggcaagagaaagaaagaagggacattcaagtaagaagagagaaagtcaaaccatctctgtttgcagatgacataatcccatatctagaaaaccccattgtctcagtccaaacgtttcttaaggtgataagaaacttcagcaaagtctcaggatacaaaatcaatgtgcaaaaatcacaagcattcctatgtggcaacaatagacagagagccaaatcatgaatgaactcccattcacaattgctacaaagagaagaacacaactagaaatacagctaacaagagaagtgaaggacctcttcaatgagaactacaaaccactgctaaagaaaatcagagatgacacaaacaaatagaaaaacattccatgctcatggataaaaagaatcaatatcgtgaaaatggtcatactgcctaatctatagattcaatggtattcccattaaactatcattgacattcttcacagaattagaaaaactactttaaaattcatatggaaccaaaaaagagtgcatatcatcaaaacagtcctaagcaaaagaacaaagctggaagcatcacattaccagacttgaaactatactacaagcttacagtaaccaaaacagcacagtactggtacaaaaacagacacacagaacaaagaaatggaatagagatctgagaaacaagaccgcacatctacaaccatctgatctttgacaaagctgacaaaaacaagcaatgaagaaagaattcccaccattaataaatggtgttgggagaactggctagccatatgcagaaaactgaaactggaccccttccttacaccttatacaaaaattaattcaagagggattaaagacttaaatgtaacaccccaaattataaaaaccctacaaagcaaatctaggcagtaccattcaggacataggctcaggcaaagatttcatgatgataacatcaaaagcaattgcaacaaaagctaatattgacaaatgggatctaattaaactaaagagcttctgcacacaaaagaacctatcaacagagtaaacagacaacctacacgatgggagaaaaattttgcaatatatatccatttgatgaggggctaatatccagaatctgcaagaaacttaaacaaatttacaagaaaaaaaacaaacaacccattaaaaagtgggcaaagaacatgaacagacatttctcaagagaagacattcatgaggccaagaaacatgaaaaaaagctccacttcactgatcattagagaaatgcaaatcaaaaccacagtgagataccatctcatgccagtcagaatggtgattattaaaaagtcaagaaataacagatgctcgtgaggctgaggagaaaaaggaacacttttacactatggtagaaaagtaaattagttcaaccattgtggaagacagtgtggcaattcctcaaagacctagaggcagaaatatcatttgacccagcaatcccattaccggggatatacccaaaagaatactactcattctattataaagatacatgcacatgtatgttgatttcagcactattcacaatagcaaagacatggaatcaacccaaatgcccatcaatgataaactggataaagaaaatatggtacatatacaccatggaatactatgcagccataaataagaatgagatcataccctttgcaggagcacggatggagctcaaagccattattctctgcagactaatgcacgaacagaaaaccaaccaccacatgttctcacttgtaagtgggagctgaagaatgagaaaacatggacacagggaggggaacaacacacaatggggcttgtggaggggggggggggaagaagagcatcaggaaaaatagctaatacatgctaagcttaatacctaggtgatgggttgataagtgcagcaaaccaccatggcaaacgtttacctatgtaacaaacctgcatgtcatgcgcatgtatcccagaacttaaaaaaaaattaatttttaaaaaatattgtaatgtgagaacacaacacgggaaccactcaaaatacacctttctatgcaaaatttagtttggatatattttagcattttaaataagcattttgcaaccgagaccaaataacaatcatctcttcaggttttccactatgtactaacatcagatctatgtaggaacaaatgttattcttgtttgtctccttcatatcaaatgtcctgaagcctttgtgcttctctggaacaaggctaagtttttgaaggcacattgcagtataaaaatcatcaataggttagagatggacccagtcagtgatatggtacagcctcagagccaggtggctggactagaggaatccgccctcccccttgcatagggtgagtagaggacagagtaaacaacttctagaatgtagtatttcagcttcttatccccatgaggtccagcattgtggatcacatcacctataaacagatctttggctttttttcttgaataagctattcacgtaattcagtatgtaatgggtgttcacaaaaacatcatctttgcccttgaaaacaagctacgtgtctgggcaggaagtacttacccagcgagaaacaacacttctttcagagacaacttgaagaaagtgtctctatagctccgcataaaactatcttgggtgcttctcattctcaaatttcagcatatcagaaaagtccgggtggttgacctctgggggtatctgacccagcaagaaaacttacatcaccctttggtttcccacgttggtttctctgacccaggaatccggaatcacttgccttctggcaaaatgcggagtgaggtacttaatcaccagaaataagaagtgcttctttgcacacttatctggctgatctaaaagcagtgaatcattgcagcatctcaaatacatcagaaagtcatcacatctgtccaggaaattgttaaaatctgtaaccactgacgtgaacctcaagtcaggttcacagtaattcagatggcttatactgaaaaacccgtacacttccccgtctggttggccaacatactcaggatgggattgtaccacttgttcagcttttcttgttctctgttccagtgtgcctcgagaggtgtagcaatcttccaaagcttctctttgggtattattattaacccaccttacatttattattattattattattattattattattattggctactgcttttggaggcttccacaatcaaataaatgaagacatttgccatcatcaggttacccaacaactttattcttcaacgttcaacactcatgtctcatatcttgtccaagactagttccagctcggtggtgcgggggtgggggcacggggtgggggtgggaaatcgctgccatacccacttttcccacgccgctccacaccgctcagccctgagaaggccacagctcagcctctatgggcggtcgggcggtggggacagctctagttcacctcaccttgcctccagcactcgccactgcagccgatgtgcctcagtccgggttccgtcttcagctcctggcactggtgccactggcaccctggggtacctcgcccggcccccttactttttttttttttttttactttttgaaataaagtactggttaacaaccctactaggtacgttggtacatggaatagacattctcttcgagaatggtaacaacaacaattcttagaagtgataactttatgccaggagacacaaaaattcccccaagaaaggtctcaatcaatagcctaatcttccatcctaaaagcctaagaaaagaaaaaatccaaagcaagcacaaggaagaaaataataaacattagcatgtaaataaatggaacagagactaaaaatagataaaatcaatgaaaacaaaggttatatttttgaaaagctcaacaaaatttacaaacgtttagctacactgaccaagaaaaacagagagaagattcagattactagaatcagaaataaaaggggacatgactaccaacattatgaaataaaaagcattggctgggcgcagtggctcacgcctgtaatcccagcactttgggaggccaaggcaggcggatcactagaggtcaagagttcgagaacagcccggccaacatagcaaaaccccgtctctaccaaaaatacaaaaattagctgggcatggtggcacagacctgtaatcccagttacttgggaggctcaggcatgagaatggcttgaacccagaagtagaagttgtaatgagctgagattgcactactgcccttcagtctgggcaacaaagtgagactctgccaaaaaaaaaaaaaaaaaaaaaaaaaaaaaaagaaaatacaatatgcaattgtataccaacaaatcaataaattagatagtttatgtaaatggatacattttccagaaagacacaaacatacgaaactgactcaagaagatatttttttaaaagtccaaatagaaatacagcaaataaagagatcaaattagtaatgaaacaactaccaaaaaaaaaaatcccatgccaatatttcactcataatttcttcaaacatgtaaaagattaccaccaatgcttctcaaacttctccaaaaaggtagaataggaggaaacacttttcaattcactttatcaggccagttttacccagataccaagaccagacaaacattacacacacacaagctaaagactaatatcctttatgaatatagatgcaaaaatccttgacaaaatattagtaaaccaaacccaacaacatataaaaataattatacaagattatacaatataaccaagtgaaatttatcccaggaattgaaagttgataacatttgtagaccaatcaatataacatactgtttcagtctgtgctgctataacaaaataccacaggctgggtaatttataaaaaacaaaaacatatattttttcgtagttctgaaggctgcaaggtacaaaatcaaggtgacagcatttagtatctgatgaggactgctgtctggttccaagatggtgccttgttgctgcatccttcagaggaaatgaatactgtatcttctcatggcagaagggagggaagggactgaagggcaggagagtgcctccatcaaacttgagcgttttataaggctgctaatcttattcatgagggtggagtcctcatgacttaatcacctcccataagccacacttattaatattgctgcattgggaataaagtttcaacatgaattttggaggagacactatctttcaaaccagagtgtgcaccgtattaatagaataaaaggcaaaaccacacgatcatctcactagatggagaaaaagcatctgacaaaatccaatgcctttacatgaaaaaaaaaaaattcaatgcactaggaatagaagaggacatccagaacctgttacaaggaatctatgaaagtcccacagctaacatacttaatgattaaagactggaagcttttgccctaagataaagtataagataaggccatcaatggatgaatgagtaatggaactgtagtatatgtacacaatggaatactattccaccataaaaacaggcaggaaatcctgccatttgcaacaacatagaagaacctgaaagacattatgttaactgcaataaaccaggcaaagaaagacaaatatgacatgatcttattcatatgtggaaactaaaagagtttattttatagaacttgagagtagaatggtggttaccagaaagggggatttgggggaggaggttgaggtgatgttggtcaaaggattacaaattgtatttagataggaggaataagttcaagagattaattgtgctacatggtaacaatagtcaatacagtataactctcagcattggaaaatgttaagagagttaatgttaagtgttctcatcacaaaaataacttatgatgtaatttgaacattatgttcaagttatcacaaaaataacttatgaagtaattatgaacattaactagatttagtcattcaagaatgtatatattgctcaaaacatcacttgtgcataataaatacatgcattttttctgtcatttaaaagagaaaaaaaagaacaagacaagaatgtccacttttaccactgctactcaacattgtactgaaggttatagccaagcaattagataatacaatgaaattaaaagtatccaaattggaaaagaagtacaactatctctgtttacaaatgacatgatcttatatatggaaaatcctaagaaatccattaaaaatataagctaataggcaagttcagcaaagattttgtatacaagatgaatataaaaattcaaatttatatctatgcagtaacaatgagcaatctgaaaagaaattaagaaacaattatacttgtgatagcatcagaacaataaaatacttaggaatgagcttaacaaaaccagaacaggatttgtttgcttacaaccataaaacatcattgtgtggatgatggaacaaatatatacaacaaagtagggtggaaaagatcacagtgcacaaaataatacaaatgagataaagaagttcctttagtttcctatatgcctgggtcagtcgccacctagccctgctctattctatttctcatcctttcaattttctatacttccattcatacatccacttttttcattcatgtaacaaatgtttcttgaatgcccactatataccaaacattattctaagcatcagttttatattggcgaacaaaacaaaggtccttactcctatgaaaattactttctagtggtaggagagagacagaaaatgataagcatcatgtaaattacacaggtgggagaaagtaataagtgctaaggaaaaagaagaaaaactaaatgtgaaagaaactggtagtgtggggtaagggtcaggtagatgggttggcgagttaagacgacatttaaataaagacttcttcaaggaggtgaagaagttggtcctggagatatgggttggggtggagatggagagggctttcagacagatgcaacaaccagtacaaagtccttaatgcagggatacgcctagaatattcaaggagtatcaaggatgaaaatgtgggtggagtgaaatgacttgaaataaagtaaagagaacaaatagtaggacattaagatagagacataacataagggtcgtaaagattgtgtaggaccttgtacttattgatatgactttgttataaaccctaagtgaaatgcagatccattggagaatgttgatcaaaggagtaatgcaatataacttaactttttaaagaataacaattcatactgtgttgagaatagactgtgggtcaagaatgaaagcagagagataagttagatactatgacaataacacaaatgagaaattgtaccttagattagagatacagcactggatatggtgagaagtggacaaatttaaatcagtgctatttgctgatggattagatgtagggtatgaagggacacttccaaactcattttgtgaggccagcacaaccatagtaccaaaccacacaaagataaaacaagataagaaaattacagatcaataaccctgatgaacataggtgccgaaatcatccacaaaacacttgcaaattaaaatcaatagcacatttaaatgattatatactatgaccaagtgggatttatccctgggaagccaggatggtttaaaatttgcaaactaataaatgtgatacaccacattaacagaattaataaaacgcatattatcctctcaatagttgcagaaaaagtatttgaaaaaattcaataccctttgatgataaaaatgctctacaatctattagtagatataggcacctcaacataataaaggtcatatatgacaagcctacagctaacatcatactcaatgttaaaaaaaaaaaaacctgaaaggttttcctctaagatcaagaacaagacaagctagaataggcaaatctacagacagaaagcagattaatttttgcctggggctgggtagggggattgtaggaagatggtgagtgactgctaatgagtacggggattttggggggagtgtgataaaaatgtaaaattgattgtgatgatggttacagaactctgtgaatatattaaaaaccactgtattgtacattttaaatgggtgaattttgtggcaatcacttcacacatgttaggataaccagtatcccattatctaaaaagagagagagaaagggagagagagagagagagagagagagagagagagagagagaggtataggtgaaaatgtggagaaattcaaactttttcacactgttggtgggaaagcaaaatgctgctgccactatacaaaacagtatgtaggttcctcaaaatattaaaaatagaataatcagatgatccaacaatcctacttctgagtacatatccaaaagaactgaaatgaagatctcaaacagatatttgcactcctgtgtttattgtagcattattcacaatagccaagatatggaaagaatctaaatattcatcaacaaataagtgaataaagaaaatatggtaaagacacacagtggaatactattcaggcttataacagaaggaagttctgccatttgcaacaacatagatgaatctggaggagattatgctaagaaaaataagccagtcagagaagggcatatactgcatggttccactcatatgagatatttaaaatattcaaactcatacaagcagagtagaatggtagatgtcaggagcttatgggggagacaaaatgagattttgctcaatgagcataaagtttctgttatgctgaatgagtaagtcctaaagatctgctgtataacatagcacctatagaaaacaatagagtattgcacacttaaaattttattgagtgtagatctcatatttagtgttcttaccacactcatacacacaaaggacactagaaaacttttggaggggatggatacatttattattttgattgtagtaatggtatcattggtgtatgcatatgtccaaactccatgaaattatatacattagacacatgcagtttttttgtgtatcaactatacttcaataaatctgtttttaaaaaaggaggaatcaaagttgccctgctatttctggcctgataagctagaaggatggatgttcataaaactgtctattctattattttaataaatctccctttttctaaaataaaccttgctcttctttgcctatgtcacatgttacaaggtggactattttaagttccaccaatctggaaaatgaacaagggagtgaagactcttccgtctaagaattccttacatttacctcattcccaacagattcctcgcttctctaacctcctgaatagaatggagttgacatcaattagataatttgagagactcgccgtatcgactaagcaaagagtttaaacgtgttggagacacgattccaccgaactgaagagaatcacacatctgtttacattgagaaagcctcctactgctaatgcttcctgagacttttccatcagaggacatggaccaagaaaagcagtggaacataagcagtgtccaaaatgtgctgtgtcccttaggcatttaccagcctgagtgaaatagaaatagcaaaagaaaaatgcttctacatttcagaaaactgtatttcattccagtgtaagggccagaatatagtctgttccactgctttatttcaaaagatctaaatgataagacaggagtagttctttaatgtttaatgactatccatgtttcaagtctaagcataataatgagctctctccaaaatgcaaaatttatgtaatcataacttctttggaaagaataattaagaaaattcaagacattatattagcagctctttcataataggggaaaaagtaatataaggaaaaaaaggcagaaattactgaactttttttttaaaaaaaggacaaatgtagagggttttcaaagcaatgttaacaatattgccctttatttaacataatgcattgctatttcaaaaggcattcatgattgtgctattatctgaaagaagaagaaactgaggctccaagaagttatatgactctcctgcttaaggtcattcaactagatagcaaacaaaaaatgacaagaatctaagccctaaaaattgtgcttacagttttttgctattatatcaatgttacctttcaattttacaactaaaacgaatgaggaaagcaggtagaagaatagagctttatttctccttaatggtatcagaaggaaactatgtaggtttcaagttattgtatgattatacataataaaattcacttacctgtggagtaatttatgattgacaaccaattcatcaattaacgaaaacagaggtaatattctagcaaaggaacatggtttctagaaaaatcaataggttactgtagcatcttactgggaacagaggtgcagaaatatctatactgcagacactttggaaaacagtacaatgttcacaggcctgaaattggtacggtagtttcaactatcagaatcaatctgatctgatggctcctgctagtgattgatagtcactgtaactcttctcacaaagtaccagttttggggagatgtaaaacacaatgcctggcattgatttggcaggaaagtatgcctttcttttgctgagcacagctatcttaggtacactgcagacacaaatagcaattgcaaagtcatcatgataatttgcatgagtgcttatctttagagatgttttgagaacatcagtaggtgggaagtgacttcatttaccctacatgagaactaagagaaaggtggcctttaggtatctaagattttcaaatattgtgtagatataagacacagataccaaataaatatttggatttggggatttaaataagttcatggaaaaagggaattaaaaggtaaaagtagaaactataaattatatttttcaacataaggttcatgaagttctagatacttttgtaagtgataacaccagccatttagttcatctctaaaagctgagggtcctgggaatctaaccatgttaatgtgatcttatttacattattaactgaagaaatatgggtgccttttacagacttttttaatattaggaaacaaatgaagtcagaagaagacaaattatgactttaaggtggatgcttaatgacttcccatcaaaactctaccaaaattgccattgttggatgagagaaatgagcaggagcattgtactggtggagaaggactctctggtgaagctttcctgagcatttttctgctaaagctttgaataactttctcaaaacactctcataataagcagatgttattatttgaccagccacaaagtcaacaagcaaaatgctttgaccatacccaaaaactgttgctacaacctttgctcttcacggtccacttttgatttgagtgaatcacttccacctcttggtagccattgctttaattaggcttcattgtcaggatcatactggtaaagccatgtttcatctcttgttataattctttgaagaaatgtttcaggattttgattttacttgtttaaaatttctatttaaagctctgcctttttttttttttttttttttttttttgagacagagtcttgctctgtcgcccaggctggagtgcagtggcgggatctcggctcactgcaagctctgcctcccaggttcacgccattctcctgcctcagcctcccaagtagctgggactacaggcacctggcaccaagcccggctaactttttttttttttgtattttcagtacagacggggtttcactgtgttagccaggatggtctcgatctcctgacctcgtgatccgcccgcctcagcctcccaaagtgctgggattacaggcgtgagccaccgcgcccggctgaagccctgctcttctcctcagctatgctgggtgcaacaattttggcacccatcaagtggaaggtttgctcaactttaatttttcactcagaattgtgtgagctgaatcatgtgagatgtctgtggtactggctattgtttctgctattaatttttgattctcttcaattagggcatgagcaagatgagtgttttcctcacaaaatttgtaaagttggatggcaaatttatgtggatggtctgctgctgcaggcttcatgttcaacattacattgtcccttcctaatatgagttatctatttgtaaactgctgatttctttgggggattgtctccataaacttttcataaagcatcaataattttaccattcttccacccaagtttcaccataaatttcatgtttgttcttgcttcaattttagtagagttcatgttactctaatacggtctcttttcaaattgcattatccttcttaatgcctcaaactaggtactattcaaaaatattctaactagttagtacaagttagttttggtgcataaatattttaaaatccaagcatagttttttctataatatgcattttccatgaagtttttgaagatcccttatattacagtagacttcttccactgcattagtttcacaggctctcctttataagaaaacaatacaactgattctatcagtaaagcagattttttttttcaattaaaagagagacagttccctgattcatccacattgcctcccagatccccctaaaaattataatacatattttttaaggagttggctgagattacaggtatagtctctggccagggaacaaaatagggctaattgcactgtgaagggagcaaacacttggcatcagctttattaatgatgtatcaatagggctatgtgtccacacttaaagcataagttcaaacataccaaggatgtcattcaactacaaggagaatagattcctgccagctgttgatactttctctttcaaatgtctaaaaaaaattttttttgatgactttttgctaaactctttgtgatacctcctccaaaaagaaaatgatgccaaatggaagtaagactctaatttgacaaatggtaggactttctggtcttttaagaaaataaggaagacctttgagagtttagaatcttagaaaagtttatggaaaaatattgtgaattcccttcctattctgagataatgtgagcatgtcttggtttaaggcaatgttttcgacaaaatttcctttcaagatccattctagtactataaatccatcgttctacttgatataatatcaatattctacataatggggttatggttttgactctacaaactctcgtcaaagtgacaacaagaatagcttttgaaaaatgaaacatttttaatgcagaacatttgatttggacaaagtaaattatatctatttccatattagccagtctgcttcacatgcagaaaaattctattccttggccactggcaattactagaaaagaagtcacttgaagaaatcaagaaggtcacaaagctataagaaatctaagaaaatgtacttctaggtcagagtaagccttggggtttactgctccagacaggtagctaggtgtagaaacgtcaggttctacatacatgagcaaaagtaagactgtcagatggcattagaattaagtgaaaataaagaaacagagttttacccttttcatgaaagaaaaaaccatccatcttgttttttaaatggtattaccattgaaagcatttgaaatcccatctaatttaagcctcaaatgaaactgagacgtttgccttttgtcaagttcagaaatgcattgtcttctcaaaggcgcaataagaaggagacagcgtagaatctctttctcttttaaaactatgtaaattgagaataaacaattttttaaaatgatggtgctgcttttgggctgtgaataattttcttacaactgctgagccatctgttaaacagagaggtcttgcttgttcaaaaagataaacgtagtttttcaaaatttcaatagacaggttttgtttgaaccctccaagcaacaaatactccaataaataaaagtccatggtattcatgggccgattaagtagaaaggaaaataagctatcttttgaaaattatattaaacactgctttccatacagaaacgacaacacaatcacacctctgaggtctttcagctgaaccatctatggccaagtaagagaatgttatgttttggtgttcctcttgaccttgaaaaactagtccttaagtgaaggaacccggggggactatacaatcaatggcgtaattcctagatacacagccttctgactatcaaattctttatgtagcaatcccaatttcaacacaacaaactaccctcttgttactagctcaatgtgtactaaaataagactattttcatttagttttagtgcattacttttgactctccagcttttgtcacttgcagggttatccattgctgtagaaatagtgcataactatggcacagttacattcaaaactataagatgtttagtgtcttagttctatgcattattacattgttcattacaaaataaaatataattctagttgagtcagtagtatctgttgagcagctgcaatttcctcgctaaccacatgctctactcttaaataaaatgacatatactctacttaattcagagcccaacttttatagtcctttgagtttcaaattaatgagatttaactatatttatctattatcagccaatatggcggttagcactatgttaaaaagaagacaatcctataatcaagctgtccatctaaagaagagcaaatttgttgtatattagcaagaaaatatatcagctgccttcattagattagagacagaaatggtcagggctaaaaacaatacaaggaagtgaaatgcattcccgcaaaaatacatacttttccaacaacaattatattttctatcttgatcattgtgctctcctatgcttctcaaacttagaatgaatcaagttaaggacacagagagtatcagaaggagagcatcagaaatccagggtctggtgaagggaaggagagatagaggagaacaaaatcacttggtgaccatccagcaggcccgagacaaaaactccttgtctgagaaatttagaagtaattagacttacctattatctaaagacacctagtttcaggcctgttttcaacttaaaatttatgagtaactagaatttatacacatctccagaatgcatgcatgccggaaacgcactgtgcaacccttgccaatattaaggcaccaaaatgtctacaaatataatcatttatcttgcaaattaccctccaggtcctgcttaaaggtccataaatacccccagggaaaaatccagggtggtgctctcagtccccttgctgaggcaccccactgcactcctgcagtgttctatctctttaataaaactttcctttttcaaacctatactgttattaagttcttcttaccaatccacaagtcaattacttccctatgctgggactctgacaccacacccagcagtataaagtcatagaaggcaactaggacaatttccaatgaagcgtttttagagaaaagtaataggcttttgttggctcattgaaatatgacattttttaagttcttaggctaacaagcatttgagagtacaactaagaatttgttagcagaggggacacaattatgattcccatgtttcttaatcaatgaataacatggcggcatgagatagagaactactgaagggcatattttttagatagagtctcgctctgtcacccaggctggagtgcagtggcacaatctctgttcactgcaacctccacctcctgattcttctgcctcatcctcctgagtagctgggattacaggcatgtgccatcactcacagctaattttttgtatttttggtagagacagggttttaccatgttaggcaggctggtctcgaactcctgacctcaagtgatctgcccgcctcagcctcccaaagtgctggggttacaagcatgagccccctcgcctggccaaaatttttttttgttccatcttgttttcatttcggaatgcctgccaccaacttggtgacttgagtcacagtaggtgctcagaaaatggttgttgaatgaatagattaaaggcatagaaaagaaaatcaatgacgatggtaagagatgggaaaaataggaaagaaagaaagacagaaaccccagtttagtttggcctatcaaagaaaaatgaaataagccacgtggaccttcacacctcctgaacagtgtcacagtatttttatcatcatcctgtaaccacccaataggttcaccttgcctgctgcctagacagagcccatttatcaagacaggggaattgccatagagaaagagtaattctagtggaggtggctgggggggtaaaatggactctgtgagggtcctttcctttggttgcttaatgcactatttttgtgctggttggcctcctgccaggaggtggtgctttcaagaaagcatcagctgtggtcgtgtgaagaggaacaggcggtaggcagggactcccaagaatgtatgcactttgtcttcagttaccagagtgggtagggaatgaccattaggtgggggcagggctaggcgtgtctgggctcagactctcctttggcgggtcttgctgcagctgctgagggggatggggtgtggtttccaggtcaatagagctatgttcctaggaggattatggctgcctccactgtgccatgcaagttgtcagagaagtgggggaaaggcatcaatcacaggcctcacccagctcccacacaacccaaagggccggtctcactcccaccgtgccccccaccccccaggccctgcaacagcccgagtctgtttccaggcagtgggcaagcagggctgagaacttgccccacgctacccaacttccagctgcaaaagcaagaagggctttcattctttcccaacctgtagggtctgcacaccaggttcatgccctcccccaagctctggacaggagacttctcaatcacttcaaattgttacaaagctcagctggaagtttccttctccctgtggctttttcccagtgcctcaggcctcctacctccccaaggacccctgtgaggcagggcagaaatggcttgctaggggccccagtgagcccacagggcttttcccgctgcttcctctacccctgtgtttcacttggctctctcaattgactccgatccaggtaaggtcagaatcttctcctgtaatctagaccctcgggttccctagtgggggtgtgtgatctgaggtggacaatccctctttcccacttccatggtttggacactcacaatacttggggtgtctcccaagtcctacaggagcaatccacttccttcagagggtctgtgggttctcttggctgtcctaatgtattcctgcagtttttctgaagcaaaagttcacaatgcaagcctcaacatgctgctctgtccatctgagtgggagctataatctagtgctgccttccatctgccatgatcctctgtcgttgtttgctgacgatatgactgtttacctagaaagccacaaagactcctccaggaagctcctagaactgataaaataattcagcaaaattgccgaatacaaaattaatgtacacaaatcagtagctcttctatacaacagcgaccaagcagagaatcaaatcaagaactcaaccccttttacaatagctgaaaaaaaaagatacttgggactattaggaatatacctaaccaaggaggtgaaagacctctacaaggaaaactacaaaacactgctgaaagaaatcagatgacacaaacaaatggaaacacatcccaagctcatgtataggtagaatcaatattgtgaaaatgaccatactgccaaaagcaatctacaaattcaaccagttttcatcaaaatatcatcatcattcttcacagaattagaaaaaaacaatcctaaaatttatatggaaccaaagaagagccaacatagccaaagcaagactaaacaaaaagaacaaatctgggggcatcacattacctgatttcaaagtatactataaggccatagtcgccaaaacagcatgatactggtataaaaataggcacctagaccaatggaacagaatagagaactgagaaattaacccaaatacttatagccaacagatgtttgacaaagcaaacacaaatataaagtgggaaaaggacaccctattcaacaaatggcactgggataattggctagccacatgtaggagagcgaaactggatcctcatctctcaccttatacaaaaatcaactcaaaatagattaaggactttaagacatgaaactataaaaattctagaagataactttggaaaaacctttctagacattggcttaggcaatgacttaatgaccaagaacccaaaagcaaatgcaataaaaacaaagataaatagctgggacttaattaaactaaagagcttttgcacagcaaaaggaacagtcagcagagtaaacagacaacccacagagtgggagaaaatcttcacaatttatacatctgacaaaggactaatatccagaatctacaacgaactcaaacaaattagcaagaaaaaacaaacaatcccatctaaaagtgggctaaggacatgaataaacaattctcaaaagaagatacacaaatgaccaataagcatatggaaaaatgctcaatatcactaatgatcagggaaatgcaaatcaaaacgacaatgtgataccaccttactcctgcaagaatggccataatcaaaaagtaaaaaaataaaagattttggtgtggatgtggtgaaaggggaacatttctacactgctggggagaatgtaaactagtacaaccactatggaaaacagtgtgcagattccttaaagaactaaaagtagaactaccatttgatccaccaatcccaccactgggtatctacccagaggaaaagaagtcatcatacaaaaaagacacttgcacacacatgtttgtagcagcacaattcacaaatccaaaaacgtagaaccaacctaaatgcccatcaatcaacaagtggataaagaaactgtggtatgtgtgtgtgcatatatatatatatatatatatatatatatacacatatatacatacacacacacacacacacatatatacacacacacacacacacatatatatatatatatatacacacacatatacatatatatatatacacacacatatatatatatgatggaatatggctcagccataaaacaggatgaattactggcatttgcagtgacctggatgagattggagactattattctaatgacttcattctaaatgaagtcactcaggaatggaaatccaaacatcgtatttttgcattcataagtgggagttaagccacgaggatgcaaaggcataagaatgacacagtggactttggggactcaggaggaaagggtgagaagggggtgagggataaaagaccacaaattgggtgcagtgtatactgcttgggtgaagggctcaccaaaatctcacaaatcaccactaaagatcttactcatgtaaccaaacaccacctgttccctaataacctacagaaataaatttttaaaaatttcattaagaaaaggagaaagagtaattcactcagagccagctgtgggggagactggcgttttactattactcaaatctgtctccctgagcattcagggatcagagtttttaaggacaacttggtgggtcaggggaagccagtgagctgggagtgctgattgtttaggtcagagatgagagtcgaagctgtcttcttatgctgagtcagtgcctgggtgggggccacaagaccagatgagccagtttattgatctttgtggtgccagctgattcatcaagtgcagggtctgcaaaatatctcaagcactgatcttaggagcagtttaggaagggtcagaatcttgtagcctctacctgtatgactcctaaaccataatttctaatcttgtggctaatttgttagtcctacagaggctgtctagtccccaggcaagaaggatgtttggggaaagggctgttatcgtctttgttttaaagtataaactaagttcctcccaaagttagttcggcctacacccaggaatgaacaaggacagcttggaggttagaagcaagatggagtcggttaggtcggatctctttcactgtctcagttacaaatgtgcaatggtggtttcagtccccaaatgatttttaactgaaaagtaaatcatttttccttccctcaatgtgtataaacagtactcaagggatattctaattccttcataaaatattagtttttatcaattataataaatgtctgttgtttagaatttactcccaataatccattaaaatttctaatcttccctatgtgttagtcttaaagattaaattcagtgacagaatgataaggaatctgcatttccaatttaactttttcaattgaaattgggattcagacttttggtaaaaagcaaagctcactgaccactgtcaccattctgacaggcagtagctatcttccatgaaccaatgtctcaactagcctgacatattctctgtaaaaagcccattataccttcagtaaatagtttataaattggaaaacataaatcttcaatcagtgaatctggctcaagccttcctagaaccaaaagaaaaataaaatgtgaatgtgtctatgtgcttacattttgaattaaatacacctccctttaaattatccctattgaagtaatagctagccaatttttctacatatactaagtgtgtttatgattattttccttaagaatatataaaaagtatcaggtaagagaaacctgcaaacattacagatatataaggaagcataatctgtgaatttgttcctaaccatattttcatcaaagcatttgaccacagcaagacatcaagctttgccttatgtcaatagtttttaaaaccagtaatctaaaacaaacaaaaaagttgcagaagaaggaaagtattaaataaggaaactgagaggagatgttcaatggcctcaaagcataataattaagaacacaccttgaataaaacagtcctgagccagaatatcaaatatgacattgactaggtttaaaattaaaacaaggtgtctacttatatgtcctttctatctccattagtgagctggggacagtgatgtctactttgcaatttaagatatatatgtatatagaaaggagcagatagagatgtatagatacatatcacaaaatgattggcacccagtggatgttcaattaatagtagttattactactactactactatgactactactactgctattgttattaccacagcctgtttgttatacctggtagagaataagtaacatagaaagcaaatggtatgtccaaaaggagcagttaataaatttgaatctatgcacattcaatccttgtgtttaaccacttgatttatttctctaatttaactgattacattttaatatcttatgctggtatacccctttataattttcacagggctttcaaaaactcctgtcttattctgtttgtatttctatcaaggaacacccaaggctgggtaatttgtaaagaaaatacatttatttggctcacagttctgcgggctgcataagaagcatggcaccagcatctgcatctattgagggcctcagactgcttttcctcttagcagaagtcgaaggggagcaggcaaaggaaagacgccatgtggagagttcatagggtgagagaggaaatgagagagaggaaagagaaggatcaagacctttttaacaaccagctctcatgggaactaagagtgataactgaaggagggcaccaagtcattcattaggggtctgcccccatgacccgaatatttcccattaggccccacctctaacagtggcgatcaaatttcaacatgaggtttggaggggttaaatatccaaatcatagtgcaccaattgctatttgaattattttcaacaattttttggtctattttatcacactgaccaaatattattctgaggcagctgcagtattatacgtagcattctcaaattatgaaataacagagatggaaaattatttaggttggtggctcatttgacatcaaaagaaagcgaggcctaagaaggttgaaatcgcttgcacaaagctacttagaaataaatgaaattctaaaacttttgcaataaataaaacaattaacaaaagatatcataaggaaatattcaaagttcaaccagtacagcaaccattctaaatgatatttaatacaaaaacaaattcaaaacaacaaaaaaaaatgtgggcagtttctcagcacatgcttgctatgcaatgtggacctgagactaagtatgtcaatatccatagcacaagcaccgcatcaccccagaacacagatgagtacattctgtgtcaatcccacatatgtttccagagccacattttgagctatgtttaaagtcattgatgatctttaaattgtgcacactgcattacaggatgtagagagatgtttcataaacatctgacttattttgactttcgatattgatgtaattacattttgaggagagtttcttattcctatagtatagaaatgccaaccaataattctcttttggggcatgactttataatagagcactcttcaattttttttagttgtctgatccttccagtgatacaaaatattcatgacatgtttacctcattctctttggtttaaccccgggaaaaaaaatcaccagaattgatacaaagctatcattcttttcaaattcagtttttaaaattgtaagtaaaatattattcacaacagaaaccaatgtagataacattaccacattatatatataaacatttaggtgattaattcatagactacctaaatactcttaaatattaaaatttacatagtagaatatttacagttttcacttcacaccaagcactaggtttagcattgtaatattgttatcatgattaatcctaatgatcactctcttagacaagtgtttttttttaaattatatcttgacattttacaaataaacaaactgaaagtttaagtaatttgatcatagtcacataataggaatgtgaaccaagtttggactgactctaaattttattctcttttcactatggtatgcttcccctctaaaaaacacattcaaatattgtttataaaaatttaagaaaagcaaatgcttctcaggattgccccagatccgatatcaaataaaagtaaaattttgctgtggtacacactctcattatggccagaacactcctccatcctgttctctctgtagatgccacagaatatttggtggttgtatacatatcagaggcagcagtcacaggagggacactggagattgtccatccctggcaaggatgaacaataaaataccagcaaaaggaaaagtcacttgcattgcatagcagttctacccttctcttatatagcctttcctttaccactcccatacattgtgtttttactttatttcttttctcttcctcatttgcctgctcagacacatcacatttaccagtgaactccctccaaataaaagtagagagtattgagataaatacataaaaccatagtaaaatatgaataacattctctactctcattttatcctgatattttactatccaatagtgactggtatatgtgtttctgattcagttcctaatatacatgaaatcccaatttgcatgaagaaaaatatctttcgaataatctcagcaaatgttctgcaagctcctagtagggtaccaggtacacagtggttcctcaataaatatatattcataaagacagtgatgatgcatataataattttgatggacttgttacatttcaaggcagctgtagttcatgacactagagtaccatttaagttatctcagtgactactaatcagtgtctcctattaaaagcatattgtttattaagataaagttaatgtaagaaactttaaagtgctactttgcacatttagattttcttggtgtttaaaactctactttagctttacctctaaggagtctaaaatgtgagatgacagctggcacaggatttcagagaaaacagatcaaataaaatgagaatgttcccagcatgttggacttttcaccaaaattaatgtcaacaatcagccaaaattgtgaaatatatcagaacacacatctgatgattcacagggaaattagcaccactcaagatttccttgagcaacaattcctgttacccagcctcaaacagtacacaccagtgtgtactctgacactctgggaaatcactaatggcatctaggacctctccagcatcatatattagggcaaaggcaggccccaatgagctagcctccaagaatatacctgggttgcttgttcataacattctccacttccaacatatatttaagggtttcttaagttccccacttaagtaattttggaatttactcttaaagaaaaacatttaacaataatttaaaccaatgtgcttttagattatatgatctgtccaggaagtgaaaaaatcattattggcaacagtttttggctgggtttaagaaaggaatacgttgacatttgcacatatatcaatgcataatattaaattgttatgattcaaattcactgatcaggaaaggctatgagtaaaaagaacttctggtgagtcaatgtcagctctcttttgtctggtattctggagaatgggagttcactaacaatataaaacttctccaagctaaagagctctttcatgactctcaaaagtaagctgggattctttcaagatcaaacattctcctaaaatcttcacaacttcgtgaacttaaaaatggcatgaaaaaaatttttatttccagtctttttacaaccctgaaattccagaaaaatgttaaatatgatattaaacattcataaaatatgtaaagatattctattgttgaggttgagattaaaaaagaaatggaaatagttctcttatcactagcaaataaacagcactgctataatgcaattaacacaggcattaaaatatttgctattttaataggtaaaaagcaatatgctagttaaatgaatttagacactcatgcatagtattaagtgatgcttttataatatttgcaaaaccttaaattggagcattttttctctaaaatgtagatgcccttgcattatagcttttcacagaaaccttgttatttatgagcatctggttaccttctcccatctctatagtctgcctggacttggcataattgtgatacgaacatagatggcagatgccttgacttttgatgtagttaatcatgactggaggcattccaagacattgttcctgaagaaatgtggcagtgtgtgggctcttgtgtaatggtaaacaaagcaatgaagttcctgcacagtttctctgcttattaaagattttggggtatatttcctctgtctttaattgctattaagtagacctcttttgacaatattgagagaaagaaaaagctgtcttctgcatactatgtttaatgctgctcaataattaatcatagaaaatcaattgcctgtattttatacctgattgtagaaatttggtggaattcttttgcatgtgaaatgttgataaatcatcaactcaacaagtatctgttctcgtttctgacagtgagaaaaaccttacaaattagaaaatagaggaaaatatggtgagtgtgcttcccaaaattaaaacaagaaaagcaatcaacttcagagtattcttgtttatgtaaaatctcattttctttcaacaattttacttaaccagttaaaatatttattctttctcccaatgcaatcattctctccactaattggcagaacacagtaccatcaatgcagccaaaaacagaggttttactctgactttcaggcttttctgtggaagttagcaacattcaatgtcaaattgataatagaatagaagagaatggaagattataacaccaaagccagagacaatattcttggtagaatgaattcaaaaagcaaatgtgtactaaacaaagtggagacattcctcctaaatcattggtgttgataggcattatttcaagcttagccttttcatacagcaatcatcctgcaagttgccttttagagcattccttatctcatacaaagctgtgtgaattcaaagactgaaacaaacaaacaaaaatggtccagaaaaactaatgtaaaatagaagatcagcatgcagagataccacttcagtgtggaagcatcttaaaaagaagtgtcagtagcccagaaatgaataacaaatattgctcagtgaatctggccattaaaccaggagttgtcaagttcaagaagtttcacatttttcaaaaattgtagcaatttgccctaatattaaactgctaattgatttggaaattttttcttccaggttgcatctctctttccatgtgatgtacagctctttgtgtttccttttttcatttttaataaatgctctgatacaaaaacaatacaaaaaacatattgtttccattgatctttgctgcaccagcctaatatttctttctgttctttaaatattgagtgtttttagagctctcctcctacttgtcactttgcttcctcctagaagcaactcatttctctgtcatcttctccagttgcttgttcaacatttgctaacattttcctctttgaaagatatagccaccttcaggattcaaattaaaggcagcatcacgtaaagaatagccaatcttgaaggctatgacctacacatttttgcctggtaaattctggagtataaattcatatatctacaaatgcatttagtaatttatatagtcttatcttctgaaatataactttatacattgcttggaatttagggtagagtttgtatggcatgcctagcagggcaatagatgacacaacttcactacagacaacaatattgcacaggataggtggtctcttttcacttcacaaactaattaattcacaaaccttctaattgtctttcaagaaacaaatggttataaaacaatgtcttttgcttaattttctcataataaaatatattatctaattagaaacttttttgctatatctattttcttgaaatttgtacttccttcacattgtgcacttgcaagaaagtgaaacaataaagcaattaggtggggaagaactatgaattctaatattgctatattattatgtattccatagctctttattcactagcttccctggaatctggctaagaactaagaactaatgctatcccacttttgagaggaagtggaacacaagtttcattccctctgacctggcctactcagtaaactatacccctgcagtgggaattagaatgtattccccatcctgcctgccactacacacacatatatcaagcatgagtagctctttttctcccctccatgacactaaacttatatttaactaggtctgccacacattgagagaaagattgtttggttttgaagttggacttgcctttaccaaatatgtcagtagttcatctctgtttctgaaattggatttgcataactccccctctgttaccattaaattaaactgctaagacataacacatattgaattctgttcagagacattctgtcattactaaaagtgtgatcctctctttaaaaggtaaaagaaatcatatgcgtgagtgtgtacacgcgaacaaaacgtgtgtgggagtaaaatgtgaactgcagaggttgcctgccagcagcccattaattgaagcttcccttgtttttccaaattcgaaataattcccatctgccttggcttactctgagcatgaaatccaagtcccttagcaggagatcgggggagctacagactagatcactgaggcagtttatgaatgttagttttgccccatggggaatatgaaacagaggtttcaaagtactctgcaatgcttgcttgtccctgaaacaacatgcaattgcagataagatgataatctgctgcactgattaccaactacacatttgcacaagtgggttggttatgtgcaaatattttctttcagaaacagtgcaggtgccctgtagccttttgctaccctgactaaaagtatcattaagttctgtgccgctgttatgatttaattcctgtacatagcagtctgtcacctccattcatatagagttcctcaattttatattcccagggctatcttataaaattgcaccacccctcccttcagccacccatttgcttttccttgatagaaagatgggatctcactcctgagtcagcggctttttaaattattatttaccccactgcacattcaggctttccgtaataatagctcttcaattgctgtacacagagtaaatccgtactttctgctcatttctttttggggccctatctccatttataacttttctaaacttaatacaaacagataatgatgtaccatcattttattgctcatgacaggtgagtttttaggacctctggtctttcaactttctcttttcatcagcatactctatataatacctcttccatccaaatttttttatttcatagtcttttgcctatataagtttattctgaaataacacaccataccgattatatatctacttaaaactaggttctacttttgatcactcatgtttaccatatgtatttctctcatattctgcaacttttcatcttgagctaattgttcaatttatttaaaaaatatgtttttctgtgaagaataatgcctcagaaagtattatcttaaaaaaatgaagtccatcagtaacatgcccagaaattgtcagaagtcatgcacaactgtacttctctctgtttgagacggaatctgctgctaaaggacatccatggaagtaggaagaggaatatcctgaaaattacagcgaatggttaactgaaagaaagacagattggtaagccatctgtggcctgactagctttgggaagaaactagatcagctggctatctgtcgttgctctaatttacaattcccagaaaataatcacactgccatttctcggcctgttctcatgtctctgccacctaatatccgcacaaccataggcaagtaacttaacccagatattctctgtgcctctttgtttttgtaaataaagtgctgataatggtcattcgtacctcacaatgtcacgtgcgggtttactgagataaaatatggcacgactctaaaaacaatgaataatgtacctgacaaaatgtctaccacactgttaaatattaggtgctcacactgtcttggttactcttactgtctaatatttaatgtgaagtagtctgttaatcttgtggcatttgcgtttttgctttactggatattatatttttgttaataaattgtttcttctccaattaaaatcaagataggcatcttcctaaatcacacaccttggcaggcttcactttttatttcacaaatcctatgcatagatgcttatacaaaacattagtactttatgtacaagtctattcaacacttatgcctatcacccaccaagatatgaagaattcagtcaataattaaaattgaaagcctatacttatcctttgtatgtgtgggaagagggtggttttcatccggacaattcaaatcagtcttcttatttatattaaatataagccactctttttacccatgaatatcaagcagaccatacagatttccaatcagagaaagaagtactaagcctgcttcagtgtacaggatttttttcagtccctttctgcagtctattccactgtttatcatattctgttctttctcatttgaccagccagacattgagtgtaacaccgttgcttgtttcaccatatctgaaaaccaaaaaccaaacacaaaccaggcatgtctcttgtagatgactatttagcatggtctagcagagtgagtcacctaagctaacaaatagctgccatctttatgcacagcaaacaatgactatcttttactcatttatcatccaattccataaacaatattaggctcacaatgcatgctacaattagatcgtttaaatatagaaagaatgtgcctaccacctgccttcaaagactaacacaataaccacatcatctaatccagctgctgttttctgttcatgagttatttaaaaagaaaactccagcatgatataaaacatgctttaatcactatacctaattatcaagaacagtaaataactttcacattaattgacttcaacatagcaaagttaataattaatcattacagactgaaattccagcatgatattgtcaaacaggacaaaggcccagaaactgtgaccttacccaccactgattccacccacatttcccacgggtgttttggagaaaatgtctgtcactagacatcagctgtttaaggtgagatttcactgggctttaagctaatgcttgtaatatattctgaattaattggatgaatagcattaaatattaataaaatattatagtttagttgtcttaatcttattaatcttccagtccataactcattctctctgcctgtctctctacccgactcgttttttttttgtttgtttgtttgtttgtttttgttttttttgagacagagtctcactcttgtcgcccaggctggagtgcagtggcgtgatctcggctcactacaacctccgcctcccgagttcaagtgactctcccacctcagcgttctgagtagctgggattacaggcacctgccaccacgccaggctaatttttgtatttttagtagagacggggtttcaccatgttggccaggctggtcttgaactcctaacctcaggtgattcgcccgcatgggcctcccaaagtgctgagattacaggcatgggccaccacgtccagccctgactctcatttttactcttactacatctcctttttttcttaagaatcagaaaacacttttattcgtaatttactgaatgtttctgttttatgtcttaaatgacaagctgttccgtagactgcattaactaatccaaagggttcaatgactacctttggagctttctccacgtaactgaaagaactaacccaggaacaggttttgagcaggaatgtcaagggttagatagttgtactattttttcaaaatgtaggtatttttctattgtgatatgcctctcattcctcagtgagatggaatttttaaaagcttaacgtaatataggtgtacttttaacgtaaaagcttttgtttatctaactaccctagttggccttcaattctagctggatgatgatctgtacataaatagctggaaagagaaataggctacattttactcagatttactgtatcccacaacacaattataattgagcttattctaaatcatttttcaattataatttaatttttcaatcataaatttttttgagatggagtctcgctctgtcacccaggctggagtgcaatggcacaatatcggctcactgcaacctccacctcccgggttcaagtgattctcctgcctcagcctcttgagtagctaggattacaggcgcatgccctcacgcccgggtaatttttgtctttttagtagagacagggtttaccatgttggtcaggctggtctcgaactcctgacctcatgatccgcctgcctcagcctcccaaagtgctgggattacaggagtgagccactgcgcctggcctcaatcataacttaaaaatagagactggcatgaggagatttgatagtctcctaattgtaagccccctggcttggaagtagtgtcaaggctttaatgatcaaatacttggagatataatgatattacactttattgtcaccaattggacatctgtatctttctcctacatttttcaggtctgtatttcctgaataaagccttggcattgtacaacaatgactttttctcaatcactttcagttcaataagttgctttcattgttttctttatttcctttcatataaattccagtaggagagtatgagaaatctattatataaaaccaagtttttaatgtttctgttcaaaatgtttgaaaacttcagaattgaaaggggatggggaaatgggtaatgttactttaggaggcctaaggcctaagatatatagaaaaaatataagctagcttgaggaagttgttgtagtatatcggctattttttataaaggagtgcagagtgaagatgagagaagcttaataacccatgcttcagtgttggaaggaggaaataagtgagctgacagcataaatattaagaaaattgacaataatctcagacttttgaaactgaaggaactcatgatggagtgatgcctgatcaatggctattctattataataaacttttcttcatttttacattctggctaacatcatttataaaagaggccctggtgagggaagatagggttagataaggtcacagctaagagtaattagaattaacaataatcaaaagtttgacaattgaattatgatgccagaaaattcagaaccagaaacaggagagtgacttgtaggggctagacagtctgcaactcacagctactttcaaatgacaagaagcttgatggaaggcttgcatgctttggatgacatcagaattaaaacattgcatgtaagtattagaacataaagcgaagcccctcctttttagatgaggaaactgaaatccattgagaaaaagtcatttctgcaggtgattcaattagctactggcaaaaccaagataagaactctctcttgactcgcaatctagcactctttctacattacacaggaaattaaaaagttgaagttaggcagaattcattcattttttccaggtggtattatttgttcaaattatactttgctgttccttttaatagtaataagcaattagttgattagtatttaatctacattagggtggtgtgatagttaatattaggtgtcaacttgattggattgaggaatgccggatgactgatgaagtattgtttctgggcgtgtctgtgagggtgtttccagtagaaattgacatgtgagtcagtggactgggagaggaagatgcactctacatgtgggtgggcaccattcaatcagctgcaagggcagctagaacaaaataggtggaggaagcatgtattcagtttgctgagcttcctctctctctttcctctctctctttcttccagagctagatgccttttctcctcctgctcttagacatcagactccagattcccaaattctttggcttttggcactagcatcagtggccttcgatgggttctcgatgaggcccttggcctcagactggggtctgcattgtcggcttccctggttgtgaggcttttgaacttggactgagccatgctactggcttttctaatttcccagcttgcagatggcctgtagtgggactttgcctttgtaattgtatgagccatttctccctaataacctccttttcacacacacacacacacacacacacacacacacacacacacacagagagagagagagagagcgagctatacatatatatatatatcctattggttctctccctctggagaaccctgactgctacactacgacaggtggggaaagagagaggtcaatgttacataattgaaagagcactaaactagggagacctaggttctagttccaggtatttacacaaactagcagtgtgaccttagaaaaactacttaacctcactagatccaaccttccaaattacaaaccaagaggcttgaactaaacagtatctgtgatagttagttttgggtttctcaatgtcaggaactacatcctttatttctgacatatgccttctccttcctttagtagtagtgcctagtctggggctctgttttactggttactgagtcaatgctgacagaaataaggattaacagttatcatacgatgtcaagggatgcagataatcaagaaatccactgattccaaaggtaggtaatttgaggtctaaaataatacgtaaatgccttatgttcaacaagtacagggggaaagattgaagctttgctgaggagggtgttctttcaacacatctctgcttctgatcctttatctttagcattctctgtattggtcaagaatgtttggtttcgggtgtccagaatcctacttgagaaagcttgagcagaaaggggagtttgtttgttcctttaactgggaagtctagcagtggagttcacctctaatatgactatatcaaggacacaaacaagattagggcccttccatctctactttctgcttgttgctacatactggaatagctggccatttccacagaccagctcttccaaatatgaaggatgtggacaccagtatttcagccctcccatactcactatttgcaatctgagagacaaaaaggccatactaccagcatcagtgagaaaaatccctggggaagactttgattggctcagttggaatcactttcatctcttgtatagttatcatggccaatggccagtaagatagagtattattattgtcacaccctggccacatgaggaaattgcttttgtttctttaagccttggttttacttttttaattatataatgaacttaattgctcttaccacccaacctgagaaccataacaatgacagtaacgtacatccacttttgtgcttctctgctagttcatctcctacttccctctacctaagaagacactacttgatttttattttatcatttccttatgttttcaagtaagttttatctcatacttatatattacatattacaggattatactattaatgagatcaaacctctctgtatacatttattagccatatgtattttttatcatttgcgagatgacttttattgactttgcccatttttctgttcatgttctttgttgtttttgtattgattgatctatgggagttttatttacattgtgagtagcaggtctatgacagctatgtgttgcaaatgtcttctctcagttagtaggttgtcttttcactatatttaaggtatatgttaatgaaagttcattgttaatatatttaaaataatcattattttactttatggttagtattttatatgttttcattaaaaaatctttcatcttccttaaggtgatagttatttaaagttcacacaaatagtactaatgtttgcttttggcatcaaaccacttaattcacatggagtttattttttgtatatagtttgaggtagagatttattttattttttccatgtggataactccagatctatttattgaatacttcatcctttcatcacagatcttccccaacatcagtgttaaattgcaaagtttccagtacgtatgatatacctagtatttaactacttgccaataaataatttgaaaactttcctccaaacatataaaagctggattcactttctatatatgaggcacttgcaataaatgagaacatttcaacagttcattcaagtggaaaaagaaaggttctgtatgtagtttccactccatcatttatcaggtaggtttgtgcttcataaggtaaagtcatgtgaaaggagtgatcgagacagtgaattttctttgtgtttgtgctgctaaccacagtcagttcatgaaatatttggaagaagataaacaagataagatatttaattttgttgaatgctgtcagatggctaggtcataaaacttgctaaagaaattcactgagcatggactttggaattaaaagagctctaatgggctaaaatttttggatccccatggttcataatattgtactttctcactgatgtgacaagatatctgactgcactaaacttgaaacttcagggaaaaacaaacgcactgctgatacattcaaggaagtatgtatttgaacttgaactgaccatgaatttagcaaatattatcggaagattgtatgcatttaatattacagaatggcactaaactcattttttaaatgtagagctatttgtagaaagaaagttgcaattttgaaagagaggcaggagttttaataaatataggtcatgcttcaaatttctttagctaagaaagaaaataaagttaaaagacaaatgcagaaaggtatgtatagcatatatttgcaattcatgatatacaacatgttcatattttaatatactaagaccacctatatatcaacatgataaaacatcaatagaaaaaaatggacaaaagatatgaaagggcaattcacagtagaagaaatacaaatggcaaacatgaacatgaaagtatatttaatcttactagtaagaaaagaaggcttttgaaatatgaagtgtcattttcttcaattggaatagctaaaatttaaaaggttgacaaattccagtgtagctgagagtagagataaataggacctctcatgaatcattgataggagtggaaattagtataacctttaaatagggcagttttggcaatacttacaatgcacatacactctgattcaataatcccattgagagacaattctcccgtccatgggtctcttgcattactacctatcttgacagcgaggcactgacaattctttgttcttgaccacttttccaaggatgtttatgtagtggaagatggaggtattgcctccctctagtataaagggacagattttcttacaacttgagatgacagagatagtgtctcaccccagagcaaacaggaagcatgattactgcccattataagattcaggttccctaaactctgggtttttctcctataatataattcactatgcatgaaagtgtcacctggtcctctttcagtcactctggaaattagtacttaaggaattggtacacgcacgtacacacacacacacacacacacaatgctgatactctgggctactgtgaatgttgtgaatagtaaactgttctctatctttcaccagggaattttatgtcttctaccaacatccatgaaactgtgggaggctaacatgtttcctttgcaaataaggcaaaatctcagattcttcacccttattgctagttattactttgagaactttatcttgatatggtactagcacaataattcaaagataattgcaaaaatatgtttatggcactaatacttctattgcagaaaaactgaaaacaacctaaatgtccatgaaaattgctcattaaataagtcattacctgccaatgatagaatactgtgaagccataaaaaatgaatatatcgtcctatagttattgaacatgatagatatctgtgacaagatattaactataaaatcaagttattgaacagtgtagtatagttctatttttgttagtaaattaatttctttctggcttcctctctttcacacacacacaaacacacacacacacacacacacacacacgtcccacacgcatttcaagatagatatatatcaatatgttagtaatggttaactcagaatagtggattatagaatgattttaagtttttctgcttatctatattttctgattttcctaaaattatcatgtgttatttgtacatttaaaaaataaatgattcatgctaaaaaaattctgcagctgcctttggaattcatatctcaggaagtatctgaattatcacacatctgacccattagtgaagctcatttcaaagaggaactgattgagctgaaagcaaactacacccactacataggcataatatctgtcaaattttggagaggaaaatataattgcacaaataattctaaaacttctggctatgtgaccaaactctgggctatgtctgggtccatctggctctatgaaagcatattttcctttatgtaacttctgaaatcactattaaggccactagagatggaaagctggagttactgctttgagtaaatttacccttggttccagaataagtcctctgatcacagcaatattctcattgatttgtaactgtgcattttgtataaacacaatttttaaaaaataatttaactgatttttatcactgcttaaatgcatgttttaaaatatggaaggttatacttcaccatgatctttatatataaattacataaatatgtctttcttttttcctcactttaaatcctcaagctcacaaaagtaatagaatatataaatatactattctctagtattatcaaaatgcttagtttttcaaacttaacattctatttcatacttccttttctgttctcatgttattccttttgcttacagtccctccaccaccctttttaacctagataactggttaatgtttaagactcagtttagccatcatcccttccaagaaattcacctcaaattccaacatgtgatctgctctcctcactgataccatgacacccatcatatatttgtgtttacttcttgaacaaacatttatatataaaacaatgtacttgatgatcaggatataagtgagcaacattagtcatgactcttaccttcatgggacttatggtttatcttgtcagttaccacattaaaataaaattcactattttatctttctaccctttctaagttataagctccttaataccaaggcctgtgtatattcatatcagtccccttagggactagcactatcctgaaatataataggcacacaacttgtgtttgttgaactaaactgtctgattattccaaagacaaaaatgtcatttttccaaatcatcagtgccttgactctcttatgtgatctgtccctactctctgctacggatttttataaggataagagatcctatcccattaggataagtggggagtgggagatgttggaggaaaagaaggtataactcagaaatataaagaggttaactcaaaactgtagcacgttttctacttgctcttcctgcattctcaccacattaactctatactatcatgtattctcaaatcatgtcttctctcacatagacgaattaaagaaaactatgtgtgtgtgtgtgtgtgtgtgtgtgtgagagagagagagagagagagagataaattggacatcttcctaaattctgatgtagacgagccttacatatgaatcaatgagtcagcattaagtagcactcataacacacctgagatgccaaaaatgatacaggcacccaatccactaaatgaaatcgggtcaatattaggatcaatttggcattttcacttgacttccattgtcctcaaaactcagtttcaatccattcaccccattcacctgcgtttttatgttccaaatgactggcttccacattatcacacatgagagctcttgggatggtattttaccaattcacttttggaaactaaaatagcaatggctaaggtagtcaatgaaagataatactgtatgttacctagtagtattagatgcagtgagatccaggaagttgtcactctgtgttagagtgacaaaaacgcaaggaactggtctgacctactgacatgacaattatttagatataattgttcagatgatttacagaactaataccctgagtagatctttattatttaacccttccatactccattccttgcttcacccagctccctctccctattgcttaccctcaccctccccctctcccaacacacacacacacacacacacacattttcacaatctacaaatatttctctactcaagaagatagtgtggctcctgtatttatcttcacctgcttcttctctattatttgcataataaaaaaataaatgttaaatgttttttaaaatgtgtttcttgtccattttactttagtgttaatcacattttccactttcctcttgtgttatgaaggaaaattaagctccctcctccaaactgtagccactgttgtttctcagccttttggctgaaatcatgtgcaaattgtaccacctacaagattatctttgccacaacaggtaagcacctttaaattctattcttgtaccaattaattcttataataaatagaggtgactcagtctctgtaatgcgaataaagtaactctattatgccctatagctatgcatctttattttaaagagctgaaattaaaataaagcacagttaactaaattgtatttcaatctcataattattagaactttaatcaaattacttggtcattttttctctctttgccaatattgtaaaagctattttgtagaatatgtttcagcctactttccagcaacttaaagaaaagatgaaataggtacttgtcctctggaagctctgtagctacctgtgtgtattttttatgctatgcaaaaatgagctcattttttctatgaatgggctaggtaaatgcaggtagatttgacattttaagattgtcatcaattctgagacttgttaccttccttgttcctttaagaaatcaatttcattcaaggtccttttccccctagaatttggcactggggtttcaaatgtatgctatcaaaggcaagattaaataggattgtatcaagttgaccaaggttcatgctaggaaccatttcagatattgtctaacattgaaaatacaattcttcaattatacttcccagacaaaattaaattaccttgaatacatggtctagttggcttactcctgataatacaatgctaaatgatgaaatccatccttatagcaaagtggatctgataaaacatttaatatatcataaaaaggaagaaaggtaaatgaaaagcaaaagacccaggaactagtaaaatgtgatctctcaaacagtttgccgtctaaagaacctcacttaccccttctacgctaatggatgtaattacgtgttgacttgttgaatttatctttcacttacctattattaatataacacatttatttgggctctttgctacttttaaggctttcaggtttctgaagtattattttcttcatgcctattgaagtttaatgaattctgagtacctcacttattgtaggtaggctctgaatggactcatattctgctttgttatgagatttccatgaggtggggtggatttcaacaattcagtgtgaacattctgaatcatcattttttaaatttatcattattattttggagatggagtctcgctctgttgcccaggctggagtgcagtagcgcgatcccggctcaccgcaacctccgcctcctgggttcaagcaattctcctgtctgagcctcccgagcagctcggactacaggtgcacgccaccatgcccggctaagtttttgtattttagtagagacgaagtttcaccgtgttgcccaggctggtttcaaactcctgagcgcaggcaatccacctgcctcggcctaccaaaacgctgggatttcaggcgtgagccaccacacccagcctgaatcatcatttttaaaataacaaaaagtagcacaaatccactgaagaaaatttagaaaatacagaaaatctaaaaggggaaaaaaaaaactaaaaattacttgaaatctcaccatgaattcattaaataaacattgttaaaaattgtgtgtctttagtattttctatacatgtatgtgtgcataaatatcataaaatcacattcaaattctttgttttatatcctgctttatgtaaaattaaattatatacatttctcatgtcattacatattattttaatacatgcttcttgatggtgtcaatattccatcatttgaatgcatcataatttatttaaataatccctcatctttgactatttagactgatttcaaatgcttgttattaaaataatgttgtggtcagcatccttttaaatatgtctttctatgcatctctgattgtttctttagaataaattccaatatgtggaattactaggtcacagagtataaagccatttaaggatttttgtatacatatcgctacaaactctgaataaactaggtatcgatggaacatatctcaaaataataagagctaattatgatgaacccacagccaatatcgtactgaatgggcaaaacttggaagcattccctttgaaaaccagcacaagacaaggatgccctctctcaccactcctattcaacatggtattgcaagttctggccagggcaatcaggcaagaggaagaaataaagggtattcaaataggaaaagaggaagtcaaattgtctctgtttgcagatgacatgattgtatatttagaaaaacatcgtctcagcccaaaatctccttaagctgataagcaacttcagcaaagtctcaggatacaaaatcaaagtgcaaaaatcacaagcattcctatacatcaataatagacaaacagagagccaaatcatgagtgaactcccattcacagttgctacaaagagaataaaatacctaggaatactacttacaagggatgtgaaggacctcctcaaggggaactacaaaccactgctcaaggaaataagaaaggacacaaacaaatggaaaaactttccatgctcatggataggaagaatcaatattgtgaaaatggccatactgcccaaagtaatttataaattcagtggtatcccgatcaagccaccattgactttcttcacagaattagaaaaaactactgtaaatttcatacgaaacaaaaaaaagagcccgtatagccaagacaatcataagtaaaaagaacaaagctggaggcatcatgctacctgacttcaaactatactacaaggctacagtaatcaaaacagcatgatactggtaccaaaacagatatatagaccaatggaacagaaaataggcctcagaaatagtgccacacatctacagccatctgatctttgaaaaacatgacaaaaacaagcaatggggaaaaaattttctatttaataaatggtattgggaaaactggtgagccatatgcaggaaactgaaaatagaccccttccttacaccttatacaaaaattaactcaagatggattaaagacttaaatataaaacctaaaaccataaaaaccctagaagaaaacctaggcaatacccctcaggacataggcatgggcaaagacttgatgactaaaacacccagagcaatggcaacaaaagacaaaattgacaaatgggacataattaaactaaagagcttctgcacagcaaaaggaacaatcttcagagtgaacaggcaacctacagaatgggagaaaatgtttgcaatttatccatctgacaaagggctaatatctagaatctacaaagaacttaaacacatttacaagaaaaaaaacaagcaaccccatcaaaaagtgggcgaaggatatgaacatacacttctcaaaagaagacatttatgtggccaacaaacatatgaaaaaaagctcatcatcactggtcattagagaaatgcaaatcaaaaccacaatgagataccatttcatgccagttagaatggcaatcattaaaaagtcaggttacaacagatgctggagtgggtgtggagaaataggaatggttttacactgttggtgggagtctaaattagttcaaccattgtggaagacagtgtggcaattcctcaaggatctagaaccagaaataccatttgactcagcaatctcattactgggtatatacccaaaggattataaatcattctaccataaagacacatgcacatgtatgtttattgcagcactattcacaatagcaaagacttggaaccaacccaaatgcccattaattattgactggataaagaaaatgtagtgcatatacaccatagaatactatgcagccataaaaaatgatgagttcacgtcctttgcagggacgtggatgaagctggaaaccatcgttctcagccgactaacacaggaacagaaaaccaaacactgcatattctcactcataagtgggagttgaacaatgagaacacatggacacaggaagggaaacatcacacacaggggcctgtcaggggatgggggactaggggatggatagcattaggagaaatacctagtgtagattatgggttgatgggtgcagcaaaccaccatggcacgtgtatacctatgtaacaagcctgtaccttctgcacatgtatcacagaacttaaagtataataaaaagacagatgatagatagatagatagatagatagataggtgatttgtcaaagttttgtctagttttattatcttcacagattattaagcaagattgtggagaatatatgtaaaagtattgacagtggtaagggagagtagtccagataatttgaaatggataagccaagtaccttcacaaactgtgattacactaaggaagcttgtaggtaaaaatgactttggaattatttatcctgatagcgactgcacttggtgtgggcggagaaaacccctttggtactgtctgtattaaaagatactttgacaggctattaccaataaggtgttttgctgaaaatttagataaattagacagttagatgtgtgttaattgtactctcatattcgaaagagcaagatttactatagccaagatcctcatagagaacgaatgtaaatgatggcatgatttttaaccttaatattattgtaaataatggacatctttcttaaaatacctaggcttaaccactgacttgcattagaaatcatattttaaaagatgatatatacatagaataagattaataaatataaacttttacctaagattcctttctcagtaattatgaaccaatatgctaattattaatctttgttcactttgtccctaacctcaggattaatgagaatactgcttgaggatcaaaaattttctactgcaacattacaactctttgtcccatttaaaatgaaaattcttgcaaataccacttgatatgttttcctaaagaataactgtctttaacaaaagatcaaactgcttccaaatcttatcaaagaggaggcatgaagttatctttccagcatccccaattatgattattaattactacaattttcctctatcattgtaaaactctgtgcaaatctctttgcttgcatggcattctttcattcaaaggactgtaattttcccttcctcagtactaattatttgccctttgaaaaaatattttatttatacttacatattttgaatcaaactatttcctaccaacacaacacacaatatcacaaacataaaacttcagactattttttaaaagtttgatgttcaaaaccaagtttaccgtagcttactttaaaaatcacatttatacacaacttaaattttgaactcttgtcggacctataatagtttcaacacagcatgttgaaaaacaacagcatgaacaagaaatttcagggcacccagaaagtgtaggtacatcttaatagccatctgtctatccttctaaatcaaataaagcacacatatttatctgttcactcttcctcaatacggtgggagatactttatgagtagagataagcagtatttagctatgtttatcttttcacttaagggtagaagatgagagtgaattggctgtgaaagcaaatattgtttcattaggttatacaagattgctaaaagtcacctgaataagtgagggcactacagttaaagcaccaaatctcctatgatctttgaccagtagtatttttttttaacagtgtgtcatcacagtgtaaaatatgagttaatcttgatcaaaaagcactcactaatgatacaaaagttctgatacatcacgtatgggatgctctaataggtacatcacatcaattcaaaatggagcttgttggtggtaaaaatatgattaacgaaatgcaccaacactcaacagaactgagatgtttagctactgtaaagatctaaaccatcactgatgctttagttccagtatttatcccacaatccagagaagatatggttctcatttttgagtgagttgtggtgaccatgaggctatatagtaactttggagtcagcccagaggattccctgagtcctccaaacctagtgtttgcttgcactgattcttaagtgccacaacctgtctccaggaatctaaaactacaacatccagaagaaagccaagttgaacaagaaactgtggatcttctttactctaggccaacagtggtagacagaggcaaatccatttaatagatacttgctaagtacctatgatgtcccaggtactgttctagcactgtagacaaaagatataaacaaaacaggcaagatccttggcctatgaaacttacattctgattctgcactgatgctctataattgaaaaataataggtaaaaaatatcacagcaaatgttatcatttcattgtttgttttctgagaagacggctcttctggaatgcaatttaaagatgggaagacatgatataatcagcaaaaaaagggcaatttcaaagttctgagacaatttaaataaaaggctctttttggaaaaaaaagtaaagggagtgaatggaaagaagctttgtttcataggacaaaaataaaataacgtggaatgtagtagaagaaataagaaaggtctgtgtcaattttctaaagctaattagtattataattattgagcacctattctgtgccaggcactatgttaaggattcaacagtaaacaaaacatactttgctgtctccagtctgtaatcaacatgaagtatgttgagcataatgatggaggtgatggggcctatgggagtatacattagattttgaacaagtctgaagggtaaagggaacctttttgagagagtaatatctatctgagatttgaagaatgggttgggcaaggagagaaggtgaaagaaagagtgtttcaagccgaatgtatagcaaatgtgaaggcctaaactacgagaaagggcatggcatgttccagggacagaaagatcagagtgcctggaggttggaaaatcagattgtgcagactctaaaaataaggtgatgattttggatgttatccactgaagggaattagtcatgtgaatgttattgcatttacattttttgaaaaacgatctttctgtctagtgtgaagaatggactggaaaagaaaatgatatgatagaagctctgagaagacctacttttaaattccatatcaaagaacatcatatctgaattctctaatattggtggaaaggagaacattaatggaatttagaattatgagagttacatcaaagttgctttagataccctccccacccctgtgattcttgaagggtaagattgggatacacctggagccctctctcttatatcggatttgagggttcttgttcctggggcccaactccttaatccaaaatacattaatctacttctgaactaagaaattgaggagacaagatgtaagtcactgtcaaaatttattaattcattcaattaataaaggtgtcattccagttattaaagatatacctgtgaacaaggcaacaaggtcccgctttccctggacttatattctagtgaggggagacaaataaaaagtatacaattccagatagagataagtgctatgtgtatagtcctaagaagttaacagaaaattggaaaatgggcttagctggcaggaacagaaacaagggtagaggggagtaaatgttatgagaaattaggccaaccgcaaatggctcactagctcccaagcatcctattacaagcacctggctcacagcccacctgcatccaagcagtctgtcttcaagcattcagcctaagcagcaccaccttataaaactcccctccagcccgtgcctcttggcagacagccttctttcttctgtcttgccttttgctcccttgcaatgtatctcctcctttcctctaaataaatctgcctttctaaactcattactgtcttggtaaatccctttaccatccatgcactaccttcagatagtcattgaccatgacattatgaagaagtacttaatatgaagaaataagcaatagagagtgactgccaatgatagatggtattggataaacatgtgtttagattcagtggtcaggcaaagaatctctatggcaataatacttgagctgtgatctggatgaaaagaacattatcctagatcagagggcatagttttctagggaggaagaatgaaaagtgaaaggatccctaggagagaataagttggatgtgtttgagggtcagaaaagtcaacatggcaggagctttacaaggagaaaaatggcagagtatgaggttaaacaggtatatagtgggaaccagataatgtcagataatgtaaagcattctagataattgtaagtattgggggccaattataagtatgatgggaaaccccaacaactcaatactaattaagcacaatcctaaatgtacagattacatccacctaatagagcatcatccactcttaacctggaatatctagctgatacctatatctaggcaaattaaggtctctatgaacaataaagagatcaattattgccacttgtgagtttaatttagcaatagtgagaagtgtgtaatagggtttggactgaacttacactgacttcacataaactcaaagagtaatcagagagtagctatatatacaatcatttaaaagcttgaacttatggcttggaaatacttaacaggcttcacttcaggaaatccttgagagtaatcaccagtagagtgagcaaaggcatttgtctatcaaacggtgaaatttcaaaattatcaagaatcggtctttaaattgtttccagatttttgggcataaaattatgactgttcaatatgttttctgtacaaagataagacagcctatgagttttcatagcaaaggcaaatattatcaaaaaatgaattcttaagagcttattttgcttctgaatcaataagaaaaagaactcttttcttttggttaaaaagagtttgtgactataagcgtctatattaaatcattttctttcttgagagtaataatagagtgagtaagccagaatagaaacaagtaaaaaccagaatttcttgcagttggaattgccatggctctatcttacattcttcagaaagttcacttctgtttagtcagtcatttaaatgctcttttccttacttgtcttgattcttttccataatgattatctttcatgtgactgttaagcttctgcattgtgacagtctaaactagtgttttgatagttccccctttcaaagaaggcaaaaagaagacaactgtcaaatacatgacaggagcaatacaaactggggataccgtgccccattaaacccagaagaggttccatcatattacctgattactagttaataagaacttttgaaacaactcatttggtaggctttgggactgcttaaactgggaggttttagtttgtccaatatatgcacatatcaggtactcaacaaatgcttgagtatataagcataaatatgtgcttatataaaataattaagtaataggagattaaggtaaatgaggttcaacaatgttaactaatttgtccaattttcacaattagtacactttggagctataatttcagcccaagtctaattccaaaatgcatgctatctccactacatcattgattatcaaatgagtaagtgaataaatgaacaaaacagaatttcataaatgaaagaatatttatgactagaaataaagcgttttcttttataagtaaagttcaggtgctctatttgacaaacttagacgtttaatatatcacaagctaagcacacaaattacaaggattatcttacattataaaaaactcttgctcataactaaatttctgtcaaaaatcaacttatgcttctgtcatttttatatccaaattaaaaagaaatatagaaagtctctatttcttcccgatttaatctagcagagttgtatatttccagaaatttatccacctcttctagacttctagattttctagtttgtgcatgtaaaagtgttcataggagccttgaatgatcctttgtatttctgtggtataaattttaataatttctgttaattacaaataaatgtaattgagtttatttgaatcttctctcttcttttcttggataatcttgctaatggtgtatcaattttgtttaccttttcaaagaactagctttttgttttctttaccttttgtattgtttttgtttgtttgttcgtttcaattccatttaattctgctctgatctttgttatttattttcttcttctgggtttgagtttggtttgttcttgtttctctagttccttgatgtgtgacattaggttgtctatttgtgctctttcggacactttgatttaggcatttaatcctgtgaactttcctcttgataccatttttgctgtatcccagaggttttgataggttgtgctaatattattgttcagctcaaagaatttttttagatttccatcttgatttcatttgtaacccaaaaatcattcaagaacaggttattttatttccatgtatttgtatagttttgagggtttcttttggagttaatttccagttttattctaccgtggaataaaattaacacttgatatagtttccagttttattccattgtggtctgaaatgatacttgatataattttgattttcttaaatatattaagacttgttttgtggcctatcgtattgtatatcttggaggatgttccgtgtgctggtgaaaagaatgtatattctgcacttgttgggtagaatgttctataaatatctgttaagtccatttgttctagggtatagtttaagcccattgtttctttgttgactttctgtcttgactacctgtctagtgctgtcagtggactattggagtctcccactattattatgttgctgtctatctcatttcttaggtctagaagtaattgtttaatgaatttgggagctcccgagttaggtgcatatatttttaggatggttatattttcctgttgggctaatccttttatcattatacaatgtctgtctttgtccttttttactgttgttgctttaaagtctatttttttttttcgaatataagaatagctactcctgcatgcttttggttttcatttgggtggaatatctttttccactcctttaccttaagtttatgtgagtccttatgtgttaggtgggtctccagaagttagcagatactttcttggtggacttttatccattctgccagtctgtgtctttaaaatggggtgcttaggtcatatacattcaacgttagtattgagatgtgaggcactgttctattcatcatgttagttgttgcctaaataccttggtttttttttttcattgtgttattgttttataggccctgtgagttttatgctttaaggagcttctattttggtgtattttgaggttttgcttacagatttagaagtctttttagcatttcttgtagtgccagtttggtagtccatttgtagctacttggatggagttggagacaattattctaagtgaagtaactcaggaatggaaagccaaatatcttatgttctcacttataagtgagaactaaactatgaggatgcaaaggcataagaatgatacaatggactttggggactcagggacaaggatgggagtggggtaagggacaaaagcctataccttgggcacagtgtccactgcttggttgatggcatcaccaaaatctcagaaatcaccacgaaagaactccacgtaaccaaaaaccacctgttccctaaaagctattgaattaattttttaaaaaaggaagggtgcaaaacaaagacacaagtgatcagaataaatttttaaagtctgctgttagccattgcttcaaaacacgcagaacatagtatatttgattgtatattgcaaactatacagatatttctacaaatatacagtttcataaaactttgtcatactattcactatttgagcataatacttttcattcatgtgcatcttcatatataatatattcaattagatttgcagttgatgttttacaagtttaattgtctgtgtctatacttgattgtttatctttgtgtcctgtcataatttcaaatgattggggactgatcaaagagtacgatatgaccacaggtacagtaaaacaaacattgggtgacatttacacagggctgcaagagggaggaactccctcacagcaggagtctctctacagactgtggtgaagggggctgtctcatcagaaggggagaagaacaaggaactcccaggggagaaggggatcagggagtgggcttatgtgtttaggttatattactcagaaacatggtggggagttactgggtcagagactcctaaggacccaccgcagcttggagttttataaccagaaggctctatcttatcactggtgagcacatgtggggtaaggtttcatagggtatgcaaataaggtgggctccaaattgctaaaaatctgcttttggagataatttttaaaatagttggatgtataaaaatttgaatttggtgttggtgggcttatgagctaatgggttttatccttcagtgaagaaataacataggggccaatatacagaggccatctttggctcgttctgtctgtaaaataatggtaaaatatttgtgtatattcatagttgctacttatgagttttcatggtttcaatttcaatatccctacatatacacatatgtggctatttagagaatacagtcagatgtagtcacattctcaaagtcttcatacctaaataaaaaataagtgattcaaactaaaggacatctttagtatagtaaaaatttccagtgatttgaaaaacataattgtattatttatgatataagcagtcatgtaagttcagtttcaaagacaatggttttgacatgaaccatatatacacacttatgtatttaaagtacagttgacctttgaacaacatgagcttgaacttcaggggtccactcatacattgatttctgcatctgtcacccctgagacagtaagacaaagttcttctcttcctcctcctcctcagcctactcaagatgaggaggatgaagatctttatgataatctacttccacttaattaacagtaaatatattttctttatgatttccttaataacattttctttcccctagcttccttttttgtaataaaacagtatataatacatataacacacaaaatgtgtgtcaatcgactgtctatgttatcagtaaggttattggtcaacaataggctattagtagttaatattttgggaagtcaaaagtcatatttggatttctgactgtgcaggaaaggtcagtgcttctaattttctttttttttcagtagacaatgatgtcgtttatttaaaatgtttactccaagaaatatatatataaaaaaataagacaattacagcactaaaccaggcaccttcgaccaaatcacaacctcctctttgattccccttcacactaagcctctttcaaattctttttcctgagctggaagaccagtcagatgcccgcagggtcgcgccaagcacgttcccagccggacaactgtgtacctttctctaggagtgcgtgacacccttcccccacaactccttgttttaaaggatttaacctattaggaagcccatttttcaatctaagccagaaggaggtgcgggacaaggcagtcttcactttgaaggtccttttcctgctccagtccctgggctagggttctagaagaggctggctgccggatttacatgaggccaccgaagatccgagtccagctccgcccagggcggctcctgcaaaggctgggacctcgggtggtgcgtcctcaaccctctcggtgaccacgactcaaaggagagacctcaagggtgccaggagcacaggtgtctgggctgcattccaggaaagagacttctccagggaaatggatcaggctgtcacatggaagcttgagtcagagatggtggttatggggtgatttggacaaattaggttagtttagcaaagctctgaagtagcagaagcttctcccctggactactgattgaacacagaacaagagatgtgcgtggcgtcagactaagtcttagagagatgcaggccagtctcctcccacagggccttgggactggcaggacagatactgctacatgccctccaagggcaggagtcacggtaaggagcgactggggtggaaaatagggaaaaaagcaacaacaactagatcatttttggcattttaacatggagacagtgacaagtggtaacaatagcaaaagaaaaaaaaaaaaacttgaagagaccaataattaactttcccatccacccaagtctcacacttaagttctagtcccatctcccccataagcaccactgaactaaatatctattttaaagcacccaaaccagtccagaccctctggaaaccaagagccccagccacagctgtcgcctctcttgggtccgggcgagaggagggttccgggaaaggcacctcataactcaatcagcgcagcacacacggcggcggcgagctcgggcacaggcacttgacggggacgcgggtggcagtcacagcatctgtgctgacacgcgaggaaggggactcttcggtaatcccaactatttggtaccagagccaagcaaacgtgactaaagggagctgggtcagcagaacggtaccccgagtctcagcaacaggacggcccgcgcgaggcaggatccaagcaggggagaaaaagagaccaaagcacaaggcgatcgaggctggcacagaaaaggctgatccttcttgcaaggactggagaatgcatttgactgctggctgatcaatctctaattggcgagtgcgcgtcacaaggctcagccctggctccacagggagccacgaagctgacttaactgatacaaatgttcccacctctgccccacccccaagtccccatggttccaccat
